United States Patent 10,260,073 (ISOLATED POLYNUCLEOTIDES AND POLYPEPTIDES, AND METHODS OF USING SAME FOR INCREASING YIELD OF PLANTS) - sequence listing, part 3

SEQ ID NO: 5108 - DNA, 2631 bp, Tabernaemontana elegans
agaaaggggaggggttttgtcattttgtatttgtgagggacacaactgtcatttgaagacaagaattccggggggcttaaatctcaccgacgaagtattggtttgccagtataaatcttccagtcgtggattgaagtcctttgcttttcttttcctttctctttctcagtgggcattggcttcaagatctctgtagctgctcgaatctaagctgcacagagtgtttcttctcgatttcttatgctttctcctctgaagatctcgagttaatctctcagaccaaattgaaaccgcgttgatcttggcatattaatcagctttcctgatctggttcaaccagatctgttcaagaaaatggtaaagatggagtctttccgcaaatttaagatctgggttttatttttctgcatgatttctggagtgggttttgggttttatcttccgggtagttaccctcacaaatacggggttggtgacttcttgagcgtgaaggttaattcactgacctcaattgatactgagatcccctttggctattatagtttacctttctgtcagccaagtgagggcattagggacagcgccgaaaatctgggtgagctccttatgggtgacaggattgagaattctccctataggtttaagatgtacacaaatgaatcggatatcttcctgtgcaaaacaaagcccttatctggtgaggagtttaagcttttcaagaagaggatcgatgagatatatcaggttaatttgatccttgataatttgccagctatccgttatactaggaaggagggctatttcttgcggtggacagggtatcctattgggattaaggttcaggatgcgtactatgtgtttaatcatttgaaatttactgttcttattcataagtatgaagagaccaatgtggctcgtgtaatgggaactggggatgccgctgaggtaattccaacagttggaaatgcaggatcagaggcacctggttacatggttgttggctttgaggtggttccttgcagtgtcccgcataatgctgattcagttaaaaacttgaaaatctatgataagtacccctcccctattaagtgtgatccatccatggtgtccatggctattaaagaaaatgagcctatctctttctcatatgaggtctcctttgtggagagtgatattaagtggccatcaagatgggatgcttatttgaagatggagggagcaaaggtacattggttctcaattctcaattcccttatggtgataactttcctggctggaatcgtgtttgtaatcttcttgaggactgttaagcgggatctgacccgttatgaggagctcgacaaagaagcccaagcgcagatgaatgaggagttatctgggtggaagcttgttgttggtgatgttttccgggctcccagctatccatcacttctgtgtgtgatggttggagatggaatccagattcttgggatggcagttgttaccattttgtttgctgcacttggatttatgtctcctgcttctcgtggaacattgatcactggtatgctgttcttctacatgattctaggaattgcagctggatatgtggctgttcgaatgtggaggacaatattctgtggtgatcataagggatgggtttcagtctcgtggagggttgcttgtttcttccctggtgttgcttttcttattttaatcatcttgaatttcctattatggggtagccacagtacaggagccattccattttctctatttgtcattctaatcttgctctggttctgtatttctgttccccttacgcttgtcggtggttactttggggcaaaagcacctcacattgaataccctgttcgaactaaccagatcccacgtgaaatcccacctcaaaaatatccatcttggctgctagttctgggggctggcactctcccatttggtacacttttcattgagctcttcttcatcatgtccagcctctggatgggtcgtgtctactatgtgtttggattccttctcattgttttgatccttttggtagttgtttgtgctgaggtgtcccttgttctgacttacatgcatctttgtgtggaggactggaaatggtggtggaaatcattctttgcttctggctctgttgccatatacatctttttatactcagtcaactatttaatatttgatctcaagagtctgagtggacctgtctctgccaccctttacctgggttattcactcttcatggttctagcaatcatgcttgcaacaggtgcagttgggttcctttcttcattctggtttgtgcattacttgttctcgtcggtgaagttggattaaaaactctttttggctcaaaggttgactttggaagagcagaaatgatcggccctagaagtaaagattgttcttgttactttactgtcatcaattttatttcctagagagttttcaaatacaagaacaataacctcgtcaagtgttattaaattttttaatagcaggagttgcatgctagcaaattgaacttattcagtcctaggtggttggcatgaaagatttcatttggtgttatctagattcatattaataggtattaaagctgttacatcgagtattacagtatctcgctta

SEQ ID NO: 5109 - DNA, 2723 bp, Cannabis sativa
tcattttctgatctgggtttctcagatctgacgcaaattcgccgtgagaaattggaaaaatggagttttttgatcgatttaggatctgggttttggtcatttgcttgatttttaatttgggtcatgggttttacctccctggtagttatccccataagtatgttgatggagattacttgaatgtgaaagtgaattctctgacctcaatcgataccgaaatgccgttcagttactatagtttacccttctgtaagcctccagagggtgttaaggatagtgctgagaatctcggtgagcttctcatgggagatcggattgagaactcgccttataaattcaagatgtacaaaaacgaatcggatatctttctatgcaaatctgatgcattgtcgcctgatcactttaagatcttgaccaagaggatcgatgagatgtaccaggttaacttgatccttgacaacttgcctgccattaggtatacccagaaagaaggttacaccttgcggtggactggttaccctgttggagttaaggtcaaggactcatactatatctttaaccatttgaagtttaaggttcttgttcatgagtatgaggatgccaatatggcacgtgtgatgggtactggtgatgcagcagaggttatcccaacgatagcgaaaggagatgaagtgcctgggtacatggttgtaggatttgaggtcattccttgcagtattatgcataatgctgattcagtgaagaacttgaagatctatgaaaaatacccatctcccattaaatgtgatccaacctctgtgtctgttccggttaaggaagggcagcccattgttttcacctatgaggtcgaatttgagaagagtgacataaagtggccttcacgttgggatgcttatttgaaaatggagggatccaaggttcattggttctccatcctcaattccctgatggttatcactttccttgctggtattgtccttgtaatccttttgaggactgttcggcgggatcttacccgctatgaggagctcgacaaggaggctcaagctcagatgaatgaggagttgtctggttggaagcttgttgtaggggatgttttccgtgccccaagtcatccagctctcctgtgtataatggttggtgatggagttcagattcttgggatggcagtggtcaccattttgtttgctgctcttggattcatgtcgcctgcttctcgagggacactcatcacaggtatgctatttttctatatgattcttggcattgtagctggatatgttgcagttcgcctgtggaggacaattggctgtggagattccaagggatgggtttcagtctcatggagagctgcttgtttcttccctggaattgccttcttgattctgactactctaaatttcctattatggggtagtcacagcaccggagccattccattttccttgtttgtcattttgcttttgctctggttctgcatttcggttccccttacacttgttggtgggtactttggagccaaggctcctcatatcgagttcccagttagaaccaatcaaattcctagggaaatcccaccacagaaatacccatcttggctgttagttcttggtgctggcacacttccctttggcaccctcttcattgagctctttttcatcatgtctagcatttggatggggcgtgtctactacgttttcgggtttctcttcattgttatgatcctccttgtcgttgtatgtgctgaggtttctcttgttctgacctatatgcacctctgtgtggaggactggaaatggtggtggaagtccttctttgcctctggttcagttgccatatacattttcttgtactcagtaaactaccttatctttgatctgaagagtttgagtggacctgtgtctgccactctctacttgggatactcactcttcatggttctagcaatcatgcttgcaaccggcacagttgggttcctttcttcgttctggttcgtgcactacttgttctcttcagtgaagcttgactgaagaatgtattccagcaaagattggaaaaggagaaagcaaaggaaatttacaggagttgttctactatgtgttacttcatttttaaaatttggtagggaacttagtgaaatgtaataactaataacaatgattcgttcagttttgttattctttaatagatgaacctcatggcatattatagatatgaaattggagttatttgcattctgtaggtgcataagaggcttttctagttgattatagatgttatttctgttatatcattaatgtgtattttgctagtctttttaatgattattattattgttttaaagatttcactccaaaggctatttttctggtattattattttgctagtcatcttgtccatttttaaaccactttcattcttttatgtatggcattttgatttgttctccattttgttgtgttttttatttttttattttaatatgttgggagaggggtttcgaagttgagagttgagatgaaattattagactatacctacaactactactattgtgttgtaatttttttttttgaaaattgtaacttcattgaaataggcaataagcataagttacataatacttaaatttggaatacaaccattctaaacaacctctctatctaatcctaaagctctttttgcaagattatgagccaatacattcatgtttctagcaaca

SEQ ID NO: 5110 - DNA, 2271 bp, Tropaeolum majus
catttcagagatccccaaagctcctggtgttggattctctcgcctaccctacgactctctacacctttttcatttgttgatttcttctcttaaagatctgttacaatttggataaaaaaatggacttagggagtggtttcaggatcgggagtctgatcatatgcttgctattccaatttgggtatgggttttaccttccgggtagttatccacacaaatacggtgtaggtgactatttgtcagtgaaagtgaactcgctcacttctattgatactgagatgccctttagctattacagtttgcctttttgtactccccctgaaggtataaaggatagtgctgagaatctgggtgaacttcttatgggggataggatcgagaattctccttataggtttaagatgtacaagaatgagagtgagatctttctttgtcgaactcctgctttatcagcagataactttaagctcctgaagaagaggatagatgagatgtatcaggttaatttgatcctcgataatttgcctgcaattcgttataccgtgaaagaaagttataatttgagatggacaggttatcctgttggaattaaggtgcaagatgtgtattatctgtttaaccacctgaaattcaaggtccttgttcacaagtatgaggagaccaatgtggcaagtgtgatgggaacaggggacgctgctgaggtgattcccgctgttccaaagggggaacctgaggtgcctggatacatggttgtagggtttgaagtgattccttgcagtttcatgcataattctgaaacagttaaaaagttgaaaatgtacggaaagtacacatctccaataagatgtgatcccacaaccgtgtccatgcctatcaaggaagggcagccaatggtttttacctatgaggttttatttgaggagagtgatatcaaatggccatcccggtgggatgcatatctaaagatggagggatcaaaggttcattggttctcgatattgaactctctaatggtgatcacattccttgctggtattgtccttgttattttcttgaggacaatcaggagggatctgacccgttatgaggagcttgacaaggaggctcaagcacaaatgaacgaggagttatctggctggaagcttgttgttggggatgctttccgtgctccatctaatccttcacttttgtgtgttatggttggaaatggtatacaaattcttgggatggcagttgtgacaatcttatttgctgctctaggattcatgtctcccgcctcccgaggaacacttatcacaggtatgctgtttttcttcatgatacttggtattgctgccggttatgttgcagttcgtatttggaagacaattcacttaggtgaccacaagggttgggtttcagtatcatggaaggttgcctgcttcttccctggtattgccttttccattctaacaactttaaactttctactatggggtagtcatagcactggagccataccaatttctctgtttgttattcttcttctgctctggttttgtatatcagtaccccttacactcattgggggataccttggggcaaaggcacctcatattgagtaccctgttcgaacaaatcagattccaagagaaataccagcccagaaatacccatcatggcttttagttctgggtgctggaactcttccttttggtacactgttcattgagcttttctttatcatgtctagtatttggatggggagggtgtactacgtctttggatttctgttggtggtgatgattctgcttgtggtggtatgtgctgaagtatcacttgtgttaacatacatgcatctatgtgtggaagactggaaatggtggtggaagtccttctttgcttctggttcagtagccatctacattttcctctactccataaattatctagtgtttgatcttaaaagtttaagtggaccggtttcggctacactctacttgggttattcactgttgatggtttttgcaatcatgctagcaacaggaacagttgggttcctttcttcattctggtttgtgcattacttgttttcttcagtgaaattggattgaaggaaggtcaaatttagtttgtatttggatttgggtttacatttacatattgtagggaacttggtagtgcatgtaacagcaataattttcttcatcggcctttgcttaattcattagtagattgagagtattgcatgatatttgccttttatagtgaaacacttgtgcctctgtgatt

SEQ ID NO: 5111 - DNA, 2306 bp, Aquilegia formosa
atgggatttttagatcaatttaagatatgggtattgattatttcttgtttatttcttcaatctggaaatgggttttatttacctggaagttatcctcacaaatatgaacatggtgattcattatttgtgaaagtgaactctcttacttctattgatactgaaataccttatagttattacagtcttcctttttgtaaaccattggaaggtattaaggatagtgctgaaaatcttggtgagcttttaatgggtgataggattgagaattcgccttataaatttaaaatgtatactaatgagagtgatctgtttctgtgtcgatctgatccattaacggcggatgattttaaaatgcttacgaaaaggattgatgaaatgtatcaggttaatttgatacttgagaatttaccagcaattaggtatactaagaaagaaggatattatcttagatggactggttatccggttggaattaaggttcaagatgtgtattatgtgtttaatcatttgaagtttaaggttctggttcataagtatgaggaacctaatgtggctcgagtgatgggtactggagacgtccctgatgtgattcctaataaagtaaaaggtggttctgatgttcctgggtacatggttgtgggatttgaggttgttccctgcagcttccagcatgatcccaattcagtaaagaacatgaaaatgtatgaaaactatcaggcgggtattaagtgtgacccaacaactgtcgcaatggctgttaaggaagggcagcctttggtgttcacctatgaggtctcgtttgaggagagtgatatcaagtggccatcaaggtgggatgcctacttgaaaatggagggggcaaaggtccattggttttcgattctgaattctgttatggtgatcactttccttgctggaattgtccttgtgatctttttgaggactgtgaggagggacctgactcggtatgaagagctcgacaaggaggctcaggcacagatgaatgaggagttatctggatggaaacttgttgttggggatgtgttcagggctccaaccaatgcaaaactcttgtgtataatggttgggaatggggttcagatacttggtatggcagtggtgaccattttatttgctgccctaggtttcatgtcaccggcatctcgtgggacccttatcactggaatgcttttcatctacttggtgctcggaattgcggctggatatgttgctgttcggatgtggagaacgatttgttgtggtgtaatcacaggatgggtttcagtttcttggagagctgcctgcttcttccctggtatagcttttctgatactaactgttttaaacttcctcctttggggaagtcacagtactggggccattccattctctctgtttgttgtcctgctcttgctatggttctgcatttctgtgcctcttaccctcataggtggataccttggcgccaaggcaccccatattgagtacccagttcgaaccaatcaaatccctcgtgaagtcccagcacaaaaatacccatcttggttgctggttcttggagctgggactcttccatttgggaccctcttcattgagctctttttcataatgtcaagcatttggatgggccgtgtttactacgtttttgggttcacgttcatcgttctaattctcttggttgtggtttgtgctgaagtatctttggtcctcacatacatgcacttgtgtgtggaagactggaggtggtggtggaaatctttcttcgcttctggctcagttgccatctacatctttttgtattcgataaactatcttgtatttgatcttaagaatctgagcggccctgtatctgcaacactttaccttggttactcactcttcatggtgctagctatcatgcttgccactggaacagtggggttcctttcttcattttggttcgtgcattatctgttctcttcagtaaagctagattaaacttgtgctgcttgatgagacatccttggcagagaaagattggagatccatttgttatttgctcacctgtgtttggttacttgaaatgttttcaatgttgttaaaggtagtaacacctcgaccatttttcttaaatatgttagatccattgtaggagataagagacgcagtagtttttgaagtttgtgtatctggctagtgagaggaaatattatatgaacctttaaattcatgtatcctgatatttgatgtttaagtctacactttccttcatacaatcatacatttctgtgagtctccattgcagggacacgtttatgtgattgtgt

SEQ ID NO: 5112 - DNA, 2431 bp, Silene vulgaris
ttgaatcaattgatctgaaattgataaaccctaaaaaaatgtttttttagctaatttgcctgatttctgatctgggtttgcaagatctgaggaaattactgttgggttttgtaaaaaatgggatctttaagcaatttggggatctgggtaattgtgatttgcatgatttttgaaactggaattgggttttatttacctggtagttaccctcataaatataaagttggggatgttttatctgttaaagttaattctttaacctcaattgatactgaaatcccctttagttactatagtttacccttctgtaagcctgaggaaggtgttaaggatagtgctgagaatttgggggagcttcttatgggtgataggattgagaattcaccttataggtttaagatgtatcagaatgagagtgagattgttttgtgtaagactaatgcgctttcgcccgatgagtttaagcttttaaagactaggattgatgagatgtatcaggttaatttgatccttgataatcttcccgcgattcggtataccaagaaggataatttctttttgaggtggactgggtaccctgtcgggattaaggttcaggacgcgtattatttgtttaatcatttgaagcttactgtccttgttcataagtatgaggaggctagtgtggctcgggttatgggtactggggatgctgttgagatggtccctggagggaatggtgttggtggatctgatgagccgggttatatggttgtgggttttgaggttgttccgtgcagtgttcaacatgatatgaatgccattaaggatttgaagatgtatggcaagtaccctgggaagattaactgtgatcccaccactgtatcgatggctgtcaaggagaatgagcctgtggcttttagttatgaggtgtcgtttgtggaaagtgatattaaatggccatctagatgggacgcgtacttgaagatggagggtgccaaggtccactggttttcaatcctgaactcactaatggttatcaccttccttgctggaatagtccttgtgatattcttgaggactgttcgccgagacctgactcgttatgaggagttggacaaggaagcccaagctcagatgaacgaggagttgtcaggatggaaacttgtggttggtgatgttttccgagctcctagtcacccggtgttgctctgtgtaatggttggggatggtgtgcagcttcttggtatgggtgttgtgacaattatgtttgctgctctaggttttatgtcaccagcatctcgaggaactctcctcacaggtatggtgttcttctatatgattctgggtattgctgctgggtatgttggtgttagattgtggaggaccattgggtgtggtgatcacaaaggatgggtttcagtgtcttggaaggcagcttgcttcttcccaggcatcgcctttttgatactaacggtattgaatttcttgctttggggaagtcacagcactggtgcaatccctttctccctctatgtggttcttattttgttgtggttctgcatctctgtacccctgaccttaataggtggttactttggtgcaaaggccccacacatcgaatacccagtgagaaccaatcaaattccccgggaaatcccccctcagaaatacccatcgtggttgttagtccttggtgccgggaccctcccatttggcaccctattcattgagctgttcttcatcatgtcaagcttgtggatgggtagggtatactatgtattcgggtttctttttgttgtgctgatcctcttggtggttgtgtgcgcggaagtgtcactagtcctaacatacatgcatctgtgtgtggaggactggaagtggtggtggaagtctttctttgcctccggttctgtggccatatacatcttcctctactccatcaactatctcatatttgaccttaagagtttgagcggccctgtctctgccacgctttacttgggatactctcttttcatggttctggctatcatgttggtcacaggcactgttggattcctctccagtttctggtttgttcattacttattctcctctgtgaagctggattgaagcaacttggttttttttggttgagagatgcaggggcatcgttttgggcgaacgtgcgacaccgagtgcagcttcagtagtagttactgctatgttttaggaaatttggtcgagatatgtaataaaaaaacctcttattaagttttgcttgattatttgattacatggaaatttacctgcttgagattacatagttaaccttcgtgtttagagtctgtttagtttttatcttagtgcctattgtgcatgagagtcctgtgtatttgagactcccttcatttgaaaatgtatttcggattcgtcttccttaaatgtttttgcttataatgatctgatt

SEQ ID NO: 5113 - DNA, 2176 bp, Solanum phureja
aaaccactaaaaatgagatcttttgagaaattcaagatttgggttttgttaatctgcttggtgtttgaattgggttatgggttttatctgcctggaagttaccctcataaatatgaggttggcgatttgttgaatgttaaggtgaattcattgacttcaattgacactgagttgccttatagttattatagtttacctttttgtcaaccacaagagggtgtgaaggatagtgctgagaatcttggtgagcttcttatgggagataggattgagaattctccttataggtttaagatgcatagtaatgagactgagattttcatgtgtcaaactaaacctttgtctggtgaggagtttaagcttttgaagaagaggattgatgagatgtatcaagtgaatttgattcttgataatttgcctgctattcgatatacgaggaaggcaggttatttcttgcggtggactggttatccggttgggatcaaggttcaagatgcatattatgtgtttaatcacttgaagtttacagttcttgttcataagtatgaagagaccaatgtggctcgtgttatgggtactggggatggagctgaggtgatatcaacagttggaaaggatggatctgaggaacctggttacatggttgttgggtttgaggttgttccttgtagtgttcaacatgctcctgattcagcaaagaacttgaaaatgtacaataagtacccgactccaattaagtgcgaccctacaactgttgccatggctattaaagaaaatgagcctgtttcgtttacttatgaggtgaactttgtggaaagtgacattaagtggccatcaagatgggatgcttatttgaagatggaaggtgcaaaggtgcattggttctctatccttaactcccttatggtgatcactttcttggctggaattgtgcttgtaatcttcttgaggactgtcaggcgggatctgacaaggtatgaggaacttgacaaagaggctcaagctcagatgaatgaggagttatccgggtggaaacttgtggtaagtgatgttttcagggctccaagtaatccaggacttttgtgtgcgatggttggagatggggttcaaattctagggatgggtgttgtgactatcatgtttgctgccctcggatttatgtccccagcttctcgtggaacattgattaccggcatgctattcttctatatgattcttggtgttgccgctggttatgttgctgttcgtctctggaggacaatcttctgtggcgatcacaagggatggatttcagtctcatggaaagctgcttgtttcttccctggaattgcttttctcattctaaccacattgaactttctgctatggggtagtcacagcacaggggccataccattttctctgtttgtcgtcctcattttactttggttctgcatttccgttcctctaaccctagtcggtggttatttgggggctaaggctcctcacattgaatacccagtccgaaccaaccagatcccccgtgaaatcccaccacaaaaatatccatcttggcttttagttttgggtgcaggcacccttcctttcggtactctgttcattgagctcttcttcatcatgtcgagtctctggatgggtcgtgtctactatgtcttcggcttcctcctcattgtcatgatccttctcgtcatagtctgtgctgaggtctctcttgttctgacttacatgcatctttgtgtggaggactggaaatggtggtggaaatccttctttgcctccggatcagttgctatatacattttcctctactccgttaactatctaatctttgatctcaagagcttgagcgggcctgtttctgctaccctttaccttggatattccctcttcatggtccttgccatcatgctcgcgacaggcacggtcgggttcctttcctccttctggtttgtacatttcttgttctcttcagtgaagctggattaaagaagtctcttatggcagaaagaaacaaaagaaccattgaagaaacagctgcagatgtgtctttaagtcattcttgtttactttttattgtcatattactatcattttgtagggtatttggaagagaaagccaataaactcctcaagttttgttaaattctttaatagtcaagtgttacttgatatagtt

SEQ ID NO: 5114 - DNA, 2116 bp, Eucalyptus grandis
ctgggttcgtccagatctgacgcggatcgagagatatcgtcgtggaaatggacttctttgatcggttcaagatctgggttttggccgtctcccttgtcgtgaactgtggatgtggatattacctccctgggagttacccgcataagtattctgtcggtgatactctgtcggtgaaggtgaattcgctcacttccatcgacactgagatcccctacagctactacagcttgcccttttgccagcctctggagggtgtgaaggatagcgccgagaacctcggcgagctcctcatgggggatcgcatcgagaactcgccgtatcagtttaagatgtacaccaacgagtctgagatcttctcgtgccgcaccgatccgctcacggcggatagtttcaagctcttgaaggagaggatcgatgaaatttatcaggtcaacctgatccttgataatttgcctgctataaggtacacgaagaaggaagagtttttcctccggtggactgggtaccccgtgggaatcaaggttcaggacacctattatgtgtttaaccatttgaagttcactgttctggttcataagtatgaggagaccaatgtcgctcgtgttatggggacaggggatgctgccgagatgattccaactattggaaatgatggttcagatgtgcagggctatatggttgtgggttttgaggttgtgccttgtagtgtcatgcataatgctgattcagtgaagaacttgaagatgtacgagaagtatccttcttcgattaaatgtgatccgaccactgtgtcaatggccattaaggaagggcagcccatcgtgttcacttatgaggtcgccttcgaggagagtgatatcaagtggccatctcgttgggatgcttatttgaagatggaaggatccaaagtccactggttctctatcctcaattctcttatggtgatcaccttccttgctggtatcgtcctcgtgatctttttgaggactgtccgtcgtgacttgacgcgatacgaggagcttgacaaggaggcacaggctcagatgaatgaggaattatctgggtggaagcttgtggttggggatgtgttccgcactccgtcaaaccccgcacttttatgcataatggtcggagacggtgtccagattcttggaatggcagtggtgaccatattatttgctgcactcgggttcatgtcccctgcttcacgtgggacacttatcacaggtatgctgttcttctacatgattcttggtgtagttgctggttatgttgctgtccgactttggaggaccatcggctctggtgatcacaagggatgggtgtcggttgcatggaaagccgcgtgcttcttccccggtatagcctttttgatcctgaccgttctgaattttctcttgtggggtagtcacagcactggagctatcccgttttctcttttcgttatcctgctgttgctctggttctgcatatcagttccacttactctttttggtggatatctcggagcgaaagctccccagatcgaatatcctgtgaggactaaccaaattcctagggaaatcccacctcagaaatacccatcttggttgttagtccttggtgctggcactctcccgtttggcacccttttcatcgagctattcttcatcatgtctagtttgtggatgggccgtgtctactatgttttcggtttcctcttcgtcgttttgatccttctagtcgtggtttgtgctgaagtatctctagttttgacatatatgcacctttgtgtggaggactggaaatggtggtggaaatccttctttgcctctggttctgttgcgatatacatcttcttgtactccgtaaactaccttgtgtttgaccttaagagcttgagcggaccagtctccgccactctttacctgggctattccctattcatggtcaccgcaatcatgctcacgaccggcacagttgggttcctctcctcattctggtttgtgcattacctgttctcttctatcttgtattacttgctttccttgagtttttacttttgctagggatacagtcaatgtaatctgaataattcatttggtctttctaatacaatttttttttcttgctaaga

SEQ ID NO: 5115 - DNA, 2499 bp, Gossypium hirsutum
cccttcacgttaatctctccgctatttctcatttctcttttcataaaggttagtcagatccatttctttacatactttcttcattatatttacatccaactgctacactcataataatcccttgtttcttcaaaaacccacatcgaaaacctttgaatatttgcttataatcccatttctcgatctgggtttacccagatctgactaaatctgaactcaatggcgagttttgggatctgggtattaacgattttcttggtttttcaatctgggtatgggttttatttgcctggtagttaccctcacaaatataaagttggggatcctttatctgttaaagtgaattccttaacttcaattgatactgaaatgccctttagctattatagtttacccttttgtaaacctgctgagggtgttaaagatagtgctgagaatctgggtgaacttcttatgggagatcgtattgagaactcaccatatagattcaagatgtatactaatgaaaccttgatctttttgtgtcaatcgggtaagttatcggctgatgagtttaagttgttgaaggagaggattgatgagatgtatcaggttaatttgattctcgataatttgccggcgattaggtatacggtgaaagagggctttgtttcgaggtggaccgggtatccgattggggttaagtttcaagatatgtattatgtgtttaatcatttgaaatttaaggttcttgttcataagtacgaggaaacgaatgtggcgcgtgtgatggggactggggatgccgttgatgttttccccagtggtggtaaaggtggatccgatgtgccggggtatatggttgttggattcgaggtgattccttgtagtgttatgcataatggtaacgtggttaaggatttgaaaatgtatgataaatacccatccgagattaaatgcgatacaactaccgtcacggtgcctatcaaggaaggtgagccaattgtgttcacgtatgaagttgcctttgaggagagtgatatcaagtggccgtctcgttgggatgcttatttgaagatggaaggatcgaaagttcattggttttcgatcttgaattcccttatggtgatcactttccttgctggtatagttcttgtgatctttttaaggactgttaggcgggatctgactcggtatgaggagcttgacaaggaggctcaagcgcagatgaacgaggagttgtcggggtggaagttagttgtcggggatgttttccgtgccccgtcccatcctgctcttttgtgtattatggtcggtgatggagttcagatccttggtatgggagttgtgactatattgtttgccgctcttggattcatgtctccagcatcccgtggaactctcattacaggtatgctattcttctacatgattcttggaattgcagctggctatgttgcagttcggctttggaggactatcggctgcggtgatcacaagggatgggcttcggttgcatggaaagctgcttgctttttccctggtatcgcatttttaattctcaccattttgaatttcctgttgtggggaagtcacagcactggagctatcccattttcgctctttgtcattctactcctactatggttctgcatctcggttccactcaccttagtcggaggatacttcggagccaaggcacctcacattgaataccctgtccgaaccaaccagatccctcgagaaatcccagctcaaaaatacccatcatggctgttagttcttggtgctgggactctacctttcggtaccctttttatcgagcttttcttcatcatgtcaagcatatggatgggacgcgtgtactacgtcttcggctttcttctcatcgttatggtcctcctcgttgtggtttgtgccgaagtatcattggtgttaacttacatgcatctctgcgtagaagactggaaatggtggtggaaatccttcttcgcttctggttcagtcgccatctacatcttcttatactccgtaaactacctcatattcgatctcaagagtttgagtggaccggtctctgcaactctctacttggggtattctctcttcatggtcctcgcaatcatgttggccactggcacgatcgggttcctttcatctttctggttcgtgcattacttgttctcttccgtaaagctggattgaagaggtaaatcggtaacccgagaggcaggggaggaaagaattggaccttttacattacttgatcatatattacatgtgttatattgagctcatttactctgttaggggaactttagtaaaatgcaataacaataatatggcgcagtttcatttaaattctttattagttgttactatgatgcatggtactgcatttgcattatgaggctggtttttaggttgtgtttgtaacatttcttggtgctactttatactatttatttggggatctgtaatgcaagctgagcacagttcactttttttattgctctaaaa

SEQ ID NO: 5116 - DNA, 2940 bp, Gossypium raimondii
caaatcaatggttgaagacccgaatcctttaggacatttgggttgacggttatatatatatataaaacaagctctaaaaagaaatttagaaaaaaaataattaaattaaaaagaagataaaacaaaaaacaaaaaatccgtctcaacatggtgtcggtgagttgtggtttagcagtaacgcacaaagctctagtagtacgaggcccgttatatcttaccttcctttgccgctttctttctctcgaaatttccgtttccttggagaattaaaagaaaaaaaaatataatacactttgaagatctctatgtttggacttcaattttcttcatagagactacccttcacgtcaatctctccgccatttctcatttctcttttcataaaggttagtcagatccatttctttacatactttcttcattatatttacatccaactgctacactcataataatcccttgtttcttcaaaaacccacatcgaaaacctttgaatatttgcttataatcccatttctcgatctgggtttacccagatctgactaaatctgaactcaatggcgagttttgggatctgggtattaacgattttcttggtttttcaatctgggtatgggttttatttgcctggtagttaccctcacaaatataaagttggggatcctttatctgttaaagtgaattccttaacttcaattgatactgaaatgccctttagctattatagtttacccttttgtaaacctgctgagggtgttaaagatagtgctgagaatctgggtgaacttcttatgggagatcgtattgagaactcaccatataggttcaagatgtatactaatgaaaccttgatctttttgtgtcaatcgggtaagttatcggctgatgagtttaagttgttgaaggagaggattgatgagatgtatcaggttaatttgattctcgataatttgccggcgattaggtatacggtgaaagagggctttgtttcgaggtggaccgggtatccgattggggttaagtttcaagatatgtattatgtgtttaatcatttgaaatttaaggttcttgttcataagtacgaggaaacgaatgtggcgcgtgtgatggggactggggatgccgttgatgttttccccagtggtggtaaaggtggatccgatgtgccggggtatatggttgttggattcgaggtgattccttgtagtgttatgcataatggtaacgtggttaaggatttgaaaatgtatgataaatacccatccgagattaaatgcgatacaactaccgtcacggtgcctatcaaggaaggtgagccaattgtgttcacgtatgaagttgcctttgaggagagtgatatcaagtggccgtctcgttgggatgcttatttgaagatggaaggatcgaaagttcattggttttcgatcttgaattcccttatggtgatcactttccttgctggtatagttcttgtgatctttttaaggactgttaggcgggatctgactcggtatgaggagcttgacaaggaggctcaagcgcagatgaacgaggagttgtcggggtggaagttagttgtcggggatgttttccgtgccccgtcccatcctgctcttttgtgtattatggtcggtgatggagttcagatccttggtatgggagttgtgactatattgtttgctgctcttggattcatgtctccagcatcccgtggaactctcattacaggtatgctattcttctacatgattctcggaattgcagctggctatgttgcagttcggctttggaggactatcggctgcggtgatcacaagggatgggcttcggttgcatggaaagctgcttgctttttccctggtatcgcatttttaattctcaccattttgaatttcctgttgtggggaagtcacagcactggagctatcccattttcgctctttgtcattctactcctactatggttctgcatctcggttccactcaccttagtcggaggatacttcggagccaaggcacctcacattgaataccctgtccgaaccaaccagatccctcgagaaatcccagctcaaaaatacccatcatggctgttagttcttggtgctgggactctacctttcggtaccctttttatcgagcttttcttcatcatgtcaagcatatggatgggacgcgtgtactacgtcttcggctttcttctcatcgttatggtcctcctcgttgtggtttgtgccgaagtatcattggtgttaacttacatgcatctctgcgtagaagactggaaatggtggtggaaatccttcttcgcttctggttcagtcgccatctacatcttcttatactccgtaaactacctcatattcgatctcaagagtttgagtggaccggtctctgcaactctctacttggggtattctctcttcatggtcctcgcaatcatgttggccactggcacgatcgggttcctttcatctttctggttcgtgcattacttgttctcttccgtaaagctggattgaagaggtaaatcggtaacccgagaggcaggggaggaaagaattggaccttttacattacttgatcatatattacatgtgttatattgagctcatttactctgttaggggaactttagtaaaatgcaataacaataatatggcgcagtttcatttaaattctttattagttgttactatgatgcatggtactgcatttgcattatgaggctggtttttaggttgtgtttgtaacatttcttggtgctactttatactatttatttggggatctgtaatgcaagctgagcacagttcactttttttattgctctcaactttgttgaggtgtgttggtcaaattacagttttggtccttttactatgttcgaattcttaatttaacttattttcattttttataatatctttgattagttaa

SEQ ID NO: 5117 - DNA, 2474 bp, Gossypium hirsutum
tactcgaaatttccgttccttggagaattaaagaaaaaaaaatataatacactttgaagatctctatgtttggacttcaattttcttcatagagactccccttcacgttaatctctccgctatttctcatttctcttttcataaaggttagtcagatccatttctttacatactttcttcattatatttacatccaactgctacactcataataatcccttgtttcttcaaaaacccacatcgaaaacctttgaatatttgcttataatcccatttctcgatctgggtttacccagatctgactaaatctgaactcaatggcgagttttgggatctgggtattaacgattttcttggtttttcaatctgggtatgggttttatttgcctggtagttaccctcacaaatataaagttggggatcctttatctgttaaagtgaattccttaacttcaattgatactgaaatgccctttagctattatagtttacccttttgtaaacctgctgagggtgttaaagatagtgctgagaatctgggtgaacttcttatgggagatcgtattgagaactcaccatatagattcaagatgtatactaatgaaaccttgatctttttgtgtcaatcgggtaagttatcggctgatgagtttaagttgttgaaggagaggattgatgagatgtatcaggttaatttgattctcgataatttgccggcgattaggtatacggtgaaagagggctttgtttcgaggtggaccgggtatccgattggggttaagtttcaagatatgtattatgtgtttaatcatttgaaatttaaggttcttgttcataagtacgaggaaacgaatgtggcgcgtgtgatggggactggggatgccgttgatgttttccccagtggtggtaaaggtggatccgatgtgccggggtatatggttgttggattcgaggtgattccttgtagtgttatgcataatggtaacgtggttaaggatttgaaaatgtatgataaatacccatccgagattaaatgcgatacaactaccgtcacggtgcctatcaaggaaggtgagccaattgtgttcacgtatgaagttgcctttgaggagagtgatatcaagtggccgtctcgttgggatgcttatttgaagatggaaggatcgaaagttcattggttttcgatcttgaattcccttatggtgatcactttccttgctggtatagttcttgtgatctttttaaggactgttaggcgggatctgactcggtatgaggagcttgacaaggaggctcaagcgcagatgaacgaggagttgtcggggtggaagttagttgtcggggatgttttccgtgccccgtcccatcctgctcttttgtgtattatggtcggtgatggagttcagatccttggtatgggagttgtgactatattgtttgccgctcttggattcatgtctccagcatcccgtggaactctcattacaggtatgctattcttctacatgattcttggaattgcagctggctatgttgcagttcggctttggaggactatcggctgcggtgatcacaagggatgggcttcggttgcatggaaagccgcttgctttttccctggtatcgcatttttaattctcaccattttgaatttcctgttgtggggaagtcacagcactggagctatcccattttcgctctttgtcattctactcctattatggttctgcatctctgttccactcaccttagtcggaggatacttcggagccaaggcacctcacattgaataccctgtccgaaccaaccagatccctcgagaaatcccagctcaaaaatacccatcatggctgttagttcttggtgctgggactctacctttcggtaccctttttatcgagcttttcttcatcatgtcaagcatatggatgggacgcgtgtactacgtcttcggctttcttctcatcgttatggtcctcctcgttgtggtttgtgccgaagtatcattggtgttaacttacatgcatctctgcgtagaagactggaaatggtggtggaaatccttcttcgcttctggttcagtcgccatctacatcttcttatactccgtaaactacctcatattcgatctcaagagtttgagtggaccggtctctgcaactctctacttggggtattctctcttcatggtcctcgcaatcatgttggccactggcacgatcgggttcctttcatctttctggttcgtgcattacttgttctcttccgtaaagctggattgaagaggtaaatcggtaacccgagaggcaggggaggaaagaattggaccttttacattacttgatcatatattacatgtgttatattgagctcatttactctgttaggggaactttagtaaaatgcaataacaataatatggcgcagtttcatttaaattctttattagttgttactatgatgcatggtactgc

SEQ ID NO: 5118 - DNA, 2575 bp, Prunus persica
atcagatctggcatttcagacattgtgtaggggcatttaggatccatccagaaaaaaggccaaaacagtggcgctctctcgaagaaagaccaaccatatataatatattgattgtctatttgcattgcgctccaatcctcgctcctatttggccttttccttcctaaaatcccaaacccagcagatttccggagctccaagatctctgccgcttcactcagagacgtcttctctgggttgtccatgtctgacactctgctaaagatctgacacaaaccttgaagaatggaattttctcatcgacttacgacctgggttctgaccattttcttgatatttcaatcgggatatgggtggtaccttccgggtagttaccctcacaagtacgttgtcggggacaccttaggggtgaaagtgaactctctgacctccattgatacagaaataccctttagctattacagtttgcccttttgtcagccccaagatggggttaaggacagtgctgagaatctcggtgagctcctcatgggagaccgcattgagaactctccatatcagtttaagatgtacaccaatgagtctgagatcttcttgtgtcacacgggtccattgtcgggagatcagtttaatctcttgaagaagaggattgatgagatgtatcaggtcaatttgattctcgataatttgcctgcgatccggtataccaagaaggagggctttgtgttgcggtggactgggtatccagtaggaattaaggttaaggatgtgtactatgtgtttaatcatttgaagttcaaggtacttgttcataagtacgaggaacccaatgtagcacgtgtgatgggtactggtgatggggcggaggtcatcccaacagttgccaaatcagattcagatgtccccgggtatattattgtaggatttgaggtgataccttgcagtttcatgcataatgcagactctgtgaagaagtcgaaaatgtatgaaaagtaccctgctcctattaaatgtgatcccaccactgtggcaatgcccgttaatgaaaagcagccaattgtcttcacatatgaggttgaatttgaggagagtgacatcaagtggccctcacggtgggatgcttatttgaagatggagggatccaaagtccattggttctcaattctcaattctctgatggtgatcactttccttgctggtattgtccttgtgattttcttgaggactgttcggagggatcttactcgttatgaagagcttgacaaagaggctcaagcacagatgaatgaggagttgtctggctggaagcttgttgttggagatgttttccgtgctccaagcaatgcttccctgttgtgtataatggttggtgatggggttcagatcctcgggatggcagtggtgaccatattgtttgctgctcttgggttcatgtcaccagcttctcgagggacacttattacaggtatgctatttttctatatgatccttggtattgcagctggttatgttgctgttcgtctttggaggacaattggttgtggagatcacaagggatgggtttcagtctcatggaaggttgcttgtttcttccctggaattgcctttttaattctgaccactctgaatttcctattgtggggtagtcacagcacaggagccattccattttctctatttgttattctccttttgctctggttctgcatctctgttccccttaccctcattggtggataccttggggccaaggcacctcacattgagtacccagtacgaaccaatcagattcctagagaaatcccggcacagaaatacccatcctggctgttggttcttggggctggcactcttccgtttggcaccctattcattgagctcttctttatcatgtctagcatttggatgggccgtgtttattatgtgtttgggtttctcttcatcgtattgatccttctcgttgtggtttgtgctgaggtttctctagttctaacctacatgcatctttgtgtggaggactggaaatggtggtggaagtccttctttgcttctggttcagttgccatatacattttcttgtactccataaactaccttgtatttgatcttaagagcctgagtggacctgtctcagccacgctttacttggggtactcgctcttcatggtggtggccatcatgcttgcaactggcacagttggattcctttcgtcattctggtttgtgcactacctgttctcttcggtgaagctggactgaagaactttagcgactcaaagattggcactttaaagagtagcagtgaatgatatcattaagggaagaaagaatgcaaactctacagatgtgctctatcatgtgttactttttcattttgttgtgttagggaacttagttcattgtaataacaataattcgtccagttttgctaaattctttaatagatggacatcatgggttatagctttgataccaaagtttatttgcattctggcggataggagagtcgtatcgttctgtactcgattggtttatatggtttttagaatgcaaaagctgtttattattatttcta

SEQ ID NO: 5119 - DNA, 1316 bp, Sorghum bicolor
ctggaaagtgaggcccatgaggcgtatcgatcaagcaccgtccactctcacatcaaaggccgaggtggcctcgcctccttcgactaaacgccttgcggataacgggagggcgagcgagcgacgggacggcaccaatggcgatgcgagcagctccggcggcggcgacaggcttcttctctccatcctccgtctctccgaggcgcttctcgtccgccacaccgccggcgtcactctccaccgggcgctgcatccagcgccatcgtctccgcgccttcccaagttcggaaatacctctagaggaactcaacccatccgtcgatctacttaggaaaactgcggaggccgtcggcgatttcaggaaaacgcccatctatattgtcggcacggattgcacagccaagcgcaacatcgccaagctgcttgcgaattccataatataccgctacctctgcagtgaggaactgcttgaggatgttcttggtgggaaggacgccctcagagccttcaaagaatctgatgagaagggctatcttgaagtcgagaccgaagggttaaagcagctcacgtccatgggtagccttgtgttgtgctgtggtgatggcgctgtcatgaactcaaccaatctggggctactgaggcatggtgtctccatttggattgatgttcctcttgaaatggcagcaaatgatatgctgaagagtacgggaacacaagctactacggatccagactctttttctcaggcgatgagcaagctccgtcagcggtacgatgaactgaaagagcgctatggagtttctgatattactgtttcagtacaaagtgtcgcttctcagcgtgggtacagcagcgttgactcggtgacacttgaggacatggtccttgaaatcgtgaggcaaatcgagaagctgatccgagcaaaggagatgatggaagctgcagggaggcccttctaaactagatagtagataccatgctgcatacacaatatttatgctccggcataccaattgcctgaactccaacgcttcgctgctcaagaaactgattgcaagcgtgtgaagtccaaggagctgaaggtcgttgttccactcgaacatgcttatattgtaattgcaagatcatttgccatttgatagtgcaaatgcattacgtgttcatctgccatggctgaatttactgtctattggaaatggcagttttgcctgtatacatgggcccagcagccaaaatttgggaattttggtgaaaggaaaatttcagaatgcatttatagtgactatgttacaatgctaaggttttctacctaaaaattt

SEQ ID NO: 5120 - DNA, 1405 bp, Sorghum bicolor
ctggaaagtgaggcccatgaggcgtatcgatcaagcaccgtccactctcacatcaaaggccgaggtggcctcgcctccttcgactaaacgccttgcggataacgggagggcgagcgagcgacgggacggcaccaatggcgatgcgagcagctccggcggcggcgacaggcttcttctctccatcctccgtctctccgaggcgcttctcgtccgccacaccgccggcgtcactctccaccgggcgctgcatccagcgccatcgtctccgcgccttcccaagttcggaaatacctctagaggaactcaacccatccgtcgatctacttaggaaaactgcggaggccgtcggcgatttcaggaaaacgcccatctatattgtcggcacggattgcacagccaagcgcaacatcgccaagctgcttgcgaattccataatataccgctacctctgcagtgaggaactgcttgaggatgttcttggtgggaaggacgccctcagagccttcaaagaatctgatgagaagggctatcttgaagtcgagaccgaagggttaaagcagctcacgtccatgggtagccttgtgttgtgctgtggtgatggcgctgtcatgaactcaaccaatctggggctactgaggcatggtgtctccatttggattgatgttcctcttgaaatggcagcaaatgatatgctgaagagtacgggaacacaagctactacggatccagactctttttctcaggcgatgagcaagctccgtcagcggtacgatgaactgaaagagcgctatggagtttctgatattactgtttcagtacaaagtgtcgcttctcagcgtgggtacagcagcgttgactcggtgacacttgaggacatggtccttgaaatcgtgaggcaaatcgagaagctgatccgagcaaaggagatgatggaagctgcagggaggcccttctaaactagatagtagataccatgctgcatacacaatatttatgctccggcataccaattgcctgaactccaacgcttcgctgctcaagaaactgattgcaagcgtgtgaagtccaaggagctgaaggtcgttgttccactcgaacatgcttatattgtaattgcaagatcatttgccatttgatagtgcaaatgcattacgtgttcatctgccatggctgaatttactgtctattggaaatggcagttttgcctgtatacatgggcccagcagccaaaatttgggaattttggtgaaaggaaaatttcagaatgcatttatagtgactatgttacaatgctaaggttttctacctaaaaatttttcatccatcccgtcgagtctttggacacatgcatggaatattaaatgtagacagaaaaaaaactaattgcacagtttggttgtaaatc

SEQ ID NO: 5121 - DNA, 1223 bp, Saccharum officinarum
caaccccccgtccgaaggatctggttcctttgccttcgcctccttcggttacgccttgcggataacggggagccggggaggagggcgagcgaagacgggacagccaccatggcgatgcgagcagctacggcggcggcgacaggcttcttctctccgtcctccgtctccccgaggcgcttctcgtccgccacaccgccggcgtcactctccatcgggcgctgcatccagcgccatcgtctccgcgccttcccaagttcggaaatacctctggaggaactcaacccatccgtcgatctacttaggaaaactggggaggccgtcggcgatttcaggaaaacgccaatctatattgttggcacggattgcacagccaagcgcaacatcgccaagttgctcgcgaattccataatataccgctacctctgcagtgaggaactgcttgaggatgttcttggtggcaaggacgccctcagagccttcaaagaatctgatgagaaggcttatcttgaagtcgagaccgaagggttaaagcaactcacgtccatgggtagccttgtgctgtgttgtggcgatggcgctgtcatgaactcaaccaatctggggctgctgaggcatggtgtctccatttggattgatgttcctctcgaaatggcagcaaatgacatgttgaagagcacgggaacacaagctactactgatccagactctttttctcaggcgatgagcaagctccgtcaacggtacgatgaactgaaagagcgctatggagtttctgatattactgtttcagtacaaagtgtggcttctcagcgggggtacagcagcgttgacttggtcacgcttgaggacatggtccttgaaatcgtgaggcaaatcgagaagctgatccgagcaaaggagatgatggaagctgcagggaggcccttctaatctataaataaactagatacacatacacaatacttccgctccggcgtacgtattttctctccagctgcccgagctccgatgcttgcctattcaagaaactgattgcagttgcccacgaatcaaagcacaagcgcgtgaaatctaaggagctgaagctcgttgttccactcgaatatgcctatattgtattgcaaaatcatttgccatttgatagtgcaaatgcattacgtgtcaatctgccatggttgaatttactgtctattggaaatgacagttttgatttggagaatttt

SEQ ID NO: 5122 - DNA, 1165 bp, Panicum virgatum
gggcgaggaggaaaagcgagggagcgagcgtcagtgcgtcgcggacgggagaggcgccatggcgatgcgagcagctacggcggcggccacaggcttcttttcttcgccctcctccgtctccccgaggcgtttctcgtcctcctcgccgccggcgtcgctctccgccgggcgctgcatccgtcgccatcgtctccgcgcctttccgagttcggaattgcctctggaggaactcaacccatccgttgatctactgagaaaaactgctgaggccgtcggtgatttcaggaaaacgccaatctatatcgttggcacggactgcacagccaagcgcaacattggcaagctccttgccaattctataatataccgctacctctgcagcgaggaactgctcgaggatgttcttggtggcaaggatgcccttagagccttcaaggaatcagatgagaagggctatcttgaagtcgagaccgaagggttaaagcagctcacgtccatgggtagccttgtgctttgctgtggggatggcgctgtcatgaactcaactaatctgggcttactgaggcatggtgtctccatttggattgacgttcctctcgagatggcagcgaacgatatgctgaagagcacgggaacacaagctactacagatccagactctttctcacaggcaatgagcaagctccgtcagcagtatgatgaactgaaagaacgctatggaatttctgatattactgtttcagtacaaaaagtggcttctcagctgggctacagcagtgttgactctgtgacccttgaggacatggttcttgaaattgtgaggcaaattgagagactgatccgagcaaaagcgatgatggaagctgcagggaagcccttctagacaataggcgtgacattccgctccggcatttacatattatctccagttgccagagcaggcatttggctcttccatggagctgattacagttaacccacgaatcaagcacaagcattttcaaatccgaggagcagaatcacactgttgtgctcgaatatgcttatttcgtattgtaaaatcgcatgtcatttgatagcccattgtgtaaatctgccatggtgcagcaactttcagattgtatttactgtcaatggaaatgacagatctgcctgtccatgctcc

SEQ ID NO: 5123 - DNA, 1403 bp, Setaria italica
ctggaacgtggggcccacgcggcggatcattctagcaccgtccaggctcacatcaacggcggaggttcgttctcggttcgcctcgcttcctccggctctgcgccttgcggataacgggggaggaaaagacctgcgagaagagcgagcgagacggacgggagaggcgccatggcgatgcgagcagctccggcggcggcgacaggcttcttttcttctccctccaccgtctccccgaggcgcttctcgttcgctacgccgccggcgtcgctctccgccgggcgccgcatccgtctgcatcgtcttcgcgccttcccgagttccgagttgcctctggaggagctcaacccatccgttgatctactcaggaaaactgctgaagccgtgggcgatttcaggaaaacgccaatttatatcgtcggcacggattgcacagccaagcgcaatatcggcaagctccttgccaattccataatataccgctacctctgcagtgaggaactgctcgaggatgttcttgggggcaaggatgcccttagagccttcaaggaatccgatgagaagggatatcttgaagttgagactgaagggttaaagcagctcacgtccatgggtagccttgtgctttgctgtggggatggcgccgtcatgaactcaactaatctgggcttactgaggcatggtgtctccatttggattgatgtacctcttgagatggcggcaaacgatatgttgaagagcacgggaacacaagctactacagatccagactctttttcacaggcgatgagcaagctccgtcagcagcatgatgatctgaaagaacgctatggaatttctgatattactgtttcagtacaaaatgtggcttctcagctgggctacagcagcgttgactcagtgacccttgaggacatggttcttgaaattgtgaggcaaatcgagagactgatccgaacaaaagcgatgatggaagctgcagggaagcccttctaggctgataatgcgcaacactccgctccagcatttacatgttatccccaattgccagagctcctgcagttagatcttccaggaagctgattaccgttaacccacgaatcaagcacaagcattttgaagtccgaggaacagaagcgcgctgttgtgctcgaatatgctttatttcgtattgtaaaatcgattgccatttgatagcgcattatgtaaatctgccatggtgcagcaggtctcagaacgaatttactgtctaatcgaaatggcaggtctacctgcatatggcccaaaggctgaaatctggagaattttgtcaggacaattttgagaatccctttacgatgaacatgctgccctgttaaacagaggcttgtgcaggaacttgagaattttcctggaacgatttacgc

SEQ ID NO: 5124 - DNA, 1244 bp, Panicum virgatum
aaagcgagggagccagcttcacggacggccggacgggagaggcgccatggcgatgagagcagctacggcggcggcgacaggcttcttttcttcgccctcctccgtctccccgaggcgtttctcgtcctcctcgccgccggcgtcgctctccgccgggcgctgcatccgtcgccatcgtctccgcgccttcccgagttcggaattgcctctggaggaactcaacccatccgttgatctactgagaaaaactgccgaggccgtcggtgatttcaggaaaactccaatctatatcgttggcacggattgcacagccaagcgcaacattggcaagctccttgccaattctataatataccgctacctctgcagcgaggaactgctcgttgatgttcttggtggcaaggacgcccttagagccttcaaggaatcagatgagaagggctatcttgaagttgagaccgaagggttaaagcagctcacatccatgggcagccttgtgctttgctgtggggatggtgctgtcatgaactcaactaatctgggcttactgaggcatggtgtctccatttggattgacgttcctctcgagatggcagcgaacgatatgctgaagagcacaggaacacaagctactacagatccagactctttttcacaggcgatgagcaagctccgtcagcagtatgatgatctgaaagaacgctatggaatttctgatattactgtttcagtacaaaaagtggcttctcagctgggctacagcagtgttgactctgtgacccttgaggacatggttcttgaaattgtgaagcaaattgagagactgatccgaacaaaagcgatgatggaagctgcagggaagcccttctagactataggcgtgacattccgctccggcatttacatattatctccagttgccagagcaggcatttggctcttccatggagctgattacagttaaccaacgaatcaagcacaagcattttcaaatccgaggagcagaatcacactcttgtgctcgaatatgcttatttcgtattgtaaaatcgcatgtcatttgatagcacattgtgtagatctgccatggtgcagcaactttcagattgtatctactgtcaatggaaatgacaaatctgcttgtacacggtccaaaggccgaaatctggagaattttgacacgggaaaattttgagaatccctttgctatgaacatgctgccctgttaagcagaggcttttgca

SEQ ID NO: 5125 - DNA, 875 bp, Cynodon dactylon
ggggacgagagcgcggcgcgagagtaaggagcagcagccatggcgatgcgagcggcggcggcgaccttcttctcgtcctcccacgtctccccaaggcccttcttctccgccacgcctccggcaccatccttcgcggggcgctccgtccactgccgccgtctccgcgccttcccagccacggaattgactctggaggagctcaacccgtccgtggaactactgagaaaaactgccgaggccgttggcgatttcaggaagacaccaatatacatagttggcacggattgcactgccaagcgcaacatctccaagctcctggccaacaccatcatatatcgctacctgtgcagcgaggaactgctcgaggatgttcttggaggcaaggacgccctcagagctttcaaggaatcagatgagaaaggttatctcgaagttgagactgaagggttgaagcagctgacatccatgggaagtctggtgctttgctgtggagatggtgcagtcatgaactcaacaaacctagggttactgaggcatggagtctccatctggatcgatgttcctctcgagatggcagtgaacgatatgttgaagagcatggggacagaagctagctcagatccagactccttttctcaggcaatgggcaagcttcgtcagcggtatgacgatctgaaagagcgctatggaatctcagatattactgtttcagtacaaaatgtggcttctcagctaggttacggcagtatcgactcgttgactctagaggacatggtcctcgaaattgtgaggcaaattgagaggttgatccaagcaaaggcgatgatggaagctgctggaaagcctttctaggctagagttgcaaggtttcacta

SEQ ID NO: 5126 - DNA, 1174 bp, Eragrostis curvula
  misc_feature (70)..(70): n is a, c, g, or t
  misc_feature (565)..(565): n is a, c, g, or t
cgaaagcagagtccgttccgccttggcgttgcggataacggggaggaagcaggcgacggaacgagaacgnggcgcgagggggagagcggcagccatggcgatgcgagcggcggcgaccttcttctcgtcctcccccatctccccaaggcccttcttctccgccacgcctccggcgccatccttcacggggcgctccgcgcactgccgtcgtctccgcgccttcccaaccacggaattgactgtggaagagctcaacccgtccgtcgatctacttagaaaaactgctgaggccgttggcgattttaggaagacaccaatctacattgtcggcacggattgcaccgccaagcgcaacatctccaagctccttgccaacaccatcatataccgctacctctgcagcgaggaactgctcgaagatgtacttggaggcaaggacgccctcagagatttccgggaatccgatgagaaaggttacctcgaagtcgagaccgaagggttgaaacagctgacatccatgggaagcctggtgctttgctgtggagatggtgcagtcatgaactcnaccaatctagggctactgaggcatggggtctccatctggatcgatgttcctctcgaaatggcggtgaacgatatgttgaagagcatgggaacagtagctacttcagatccagacacctttactcaggtaatgggcaagcttcgtcagcagtacgatgaactgaaagagcgctatggaatctctgatattactgtttcagtacaaaatgttgcttctcagctaggctacggcagtatcgactctctgactctggaggacatggtcctagaaattgtgaggcaaattgagaggttgattcgagcaaaggcgatgatggaagctgctggaaagcctttctaggctagagttgcaaggtttcaccagggcatgtattctctagacacccgaggccgtggcatttgactaaacccaggccctaacatttggctcatctaagaggcaaactgcagtactgctgttggtctacgtatgggatgacaaaatttgacatccagaataaagcacattgtttcctcccaacaggttcttttgtactaaaaaaagatttacggcttttatattacttttttgtatgaaattgaggttgggaggttaggggttgttttttct

SEQ ID NO: 5127 - DNA, 1151 bp, Triticum aestivum
gtggtggcgcggataactcgagggagggagattgaggtcggtcgaagcggcaatggcgatggcgatgcgggcggcagcggccttcttctcgccctccgtctccccgagcccgaagcagcagcagacgcacgccgtcttctccacacggcgcggctccacccgccgtatccatccccgtcgcctccgcgccttcccagccaccgagctgaccctcgaggagctcaacccctccgtcgccctgctcaggaagaccgcggaggccgtcggcgatttcaggaagacgcccatctacatcgtcgggacggactgcaatgccaagcgcaacatcgccaagctgctcgccaactccatcatataccgctacctctgcagcgaggacctgctcgaggacgtcctcggcggcaaggacgccctcgccgccttccgggagtccgacgagaaaggctacctcgaagtcgagaccgaggggctgaagcagctcacgtccatgggcagcctcgtgctttgctgtggcgatggcgccgtcatgaactccaccaacttagggctactgaggcatggagtctccatctggatcgatgtccctctcgaattagccgtgaacgatatgttgaagagcaagggggcacaagctatttcagaccctgattccttttctcaggcaatggcaaagctccgtcagcgttatgatgatctgaaagagcggtatgcagtttctgatgttactgtttcagtacagaacgtggcttctcagctaggctacagcagcatcgactctttgagcctggaggacatggtcattgagattgtgagtcggattgagaagctgatccaagcgaaggcgatgatggaagctgctgggaagcctgaatgattcgagcatcgactgaggtccgaggaatcaagttccgccgcttgatttcaatatttttgcgacatttcatatacatagtgcgcgccgatgaaggctttgggggcatttcgtgtaaacgagtctttcacgacattatagtaacacggtactcctcgctgcaagttattcatgtggccagttgtaaaatgtatatggctcaacggccgaacattaaacaggagattttttccgatgagtaagaaagtagaagaggagcaccagttcactcttgatgaaa

SEQ ID NO: 5128 - DNA, 1589 bp, Sorghum bicolor
actcccggctcccgctcgcccgggtccctgtcctgtccatctatagcgttccattggaaagtgcaagcacgggcccatggccgccggtctgtccggcgccgcgatgaccgggttcgtcgccaagaacccgctgctcgcggccgcggccgcggcgcgccgcagggcgcatccccttgccgggcgcgccctgccgttctcgccgctcaccaccaccagggccgcgcgccgccgcgggctcgggaccgtcacgtgcttcgtgccgccagacacggagcacccggcggcccgggccccggctgctccggtgccggtgccggtgccggagacggcgctggacgaggaggccagggccgcggcggcgcggcgcatcgcggagaagaaggcgcggaagcggtccgagcgtcggacgtacctggtggccgccatgatgtccagcctcgggttcacgtccatggccgtcgccgccgtgtactctcgcttcagctggcaaatggagggcggcgaggtgccggtgagcgagatgttgggcacgttcgcgctctccgtcggcgcggcggtcgggatggagttctgggcgcggtgggcgcaccgggcgctgtggcacgcctccctgtggcacatgcacgagtcgcaccaccggccgcgggagggccccttcgagctcaacgacgtgttcgccatcatcaacgccgtgccggccatctgtctcctcgcctacggcttcttccaccgcggcctcgtgcccggcctatgcttcggcgcgggcctcgggattacgctgttcggcatggcatacatgttcgtccacgacggcctggtccaccgccgcttcccggtcggccccatcgccaacgtgccctacttccgccgagtggctgccgctcacaagatacaccacatggacaagttcgagggcgtcccgtatgggctcttcctgggaccaaaggagctggaggaggttggtggcctggacgagctggaaaaggagctcgcgcgaatcggccggaccatctgatgatgggttcgtccgcattccgccgcggcgagctccgctgtgcaaagctccgtggttttcgtttttgctcggttttgttgagttcattgtcggtaccggatgcttggtggagcagacgaccagaaggggccgatttggatgcacgggcgttgatcttctcctgcatttcgaatgggctgggaggcacagttcgtacatggagatgtccggtgccatggaattactttttttttttcctttttgctttgctgccattgtcacgtcggcgtctttgtggagacgtcgcacgttctggtccccctgtgttgctgtttcttgtggctaggattctgtgtatataacttgtagagacatgttatgaaaaaccacctgaatgaagctcaattcggtggttggaaacagagctgaaaattcagaagctccctgctttcacattcagaagcgctggcgtgatagagggttttcgttcccaaaatcacatagattacatattgtacatgtatatgtttcgtaggttccacaaactacatactactagtccatcgatttctttattgaaattttggaatgcgtt

SEQ ID NO: 5129 - DNA, 1787 bp, Sorghum bicolor
gcggcggcaggagctgagctttaccagtgacatggaccgttgtgagccagtgagagccacattccaattcggccacttcttcgtccccgcggacgcgtcgcaaagcgagcctctgggagactcgaggtcttaagtatcgtgcacctggtctcctctgccttcccctcctgtcctgtcacgcttcacactcccggctcccgctcgcccgggtccctgtcctgtccatctatagcgttccattggaaagtgcaagcacgggcccatggccgccggtctgtccggcgccgcgatgaccgggttcgtcgccaagaacccgctgctcgcggccgcggccgcggcgcgccgcagggcgcatccccttgccgggcgcgccctgccgttctcgccgctcaccaccaccagggccgcgcgccgccgcgggctcgggaccgtcacgtgcttcgtgccgccagacacggagcacccggcggcccgggccccggctgctccggtgccggtgccggtgccggagacggcgctggacgaggaggccagggccgcggcggcgcggcgcatcgcggagaagaaggcgcggaagcggtccgagcgtcggacgtacctggtggccgccatgatgtccagcctcgggttcacgtccatggccgtcgccgccgtgtactctcgcttcagctggcaaatggagggcggcgaggtgccggtgagcgagatgttgggcacgttcgcgctctccgtcggcgcggcggtcgggatggagttctgggcgcggtgggcgcaccgggcgctgtggcacgcctccctgtggcacatgcacgagtcgcaccaccggccgcgggagggccccttcgagctcaacgacgtgttcgccatcatcaacgccgtgccggccatctgtctcctcgcctacggcttcttccaccgcggcctcgtgcccggcctatgcttcggcgcgggcctcgggattacgctgttcggcatggcatacatgttcgtccacgacggcctggtccaccgccgcttcccggtcggccccatcgccaacgtgccctacttccgccgagtggctgccgctcacaagatacaccacatggacaagttcgagggcgtcccgtatgggctcttcctgggaccaaaggagctggaggaggttggtggcctggacgagctggaaaaggagctcgcgcgaatcggccggaccatctgatgatgggttcgtccgcattccgccgcggcgagctccgctgtgcaaagctccgtggttttcgtttttgctcggttttgttgagttcattgtcggtaccggatgcttggtggagcagacgaccagaaggggccgatttggatgcacgggcgttgatcttctcctgcatttcgaatgggctgggaggcacagttcgtacatggagatgtccggtgccatggaattactttttttttttcctttttgctttgctgccattgtcacgtcggcgtctttgtggagacgtcgcacgttctggtccccctgtgttgctgtttcttgtggctaggattctgtgtatataacttgtagagacatgttatgaaaaaccacctgaatgaagctcaattcggtggttggaaacagagctgaaaattcagaagctccctgctttcacattcagaagcgctggcgtgatagagggttttcgttcccaaaatcacatagattacatattgtacatgtatatgtttcgtaggttccacaaactacatactactagtccatcgatttctttattgaaattttggaatgcgtttggaagtacact

SEQ ID NO: 5130 - DNA, 1504 bp, Setaria italica
ctctcccttcccctgccgtcacactcccccctcccgctcactcggtccctgtccgtctattccccagaaagtgcacgaacgggaggagccccggcgccacacggaacgccagcccgagccatggccgccggtctctccggcgccgcgatgaccagcagcttcgccgccaagaaccccgcgctgctcgccgcggcgcgccgcagggcgcctcccctcgccgggcgcgcgctgccgttctcgccgctcaccaccgccagggccccgcgccgccgcgggctcgggaccgtcacgtgcttcgtgccgcaggccacggagggcaagacggccccggccgcccccgtgccggtgccggtgccagtgcctgatacggcgctggaggaggaggccagggccgcggcggcgcggcgcatcgaggagaggaaggcgcggaagcagtccgagcggcggacgtacctggtcgccgccgtcatgtccagcctcggcgtcacgtccatggccgtcgccgccgtctactaccgattcagctggcaaatggagggcggcgaggtgccggtgaccgagatgttcggcacgtttgcgctctccgtcggagcggcggtcgggatggagttctgggcgcggtgggcgcaccgggcgctgtggcacgcgtccctgtggcacatgcacgagtcgcaccaccggccgcgggaggggcccttcgagctcaacgacgtgttcgccatcatcaacgccgtgccggccatctccctcctctcctacggcttcttccaccgcggcttcgtgcccggcctctgcttcggcgcgggcctcgggattacgctgttcggcatggcctacatgttcgtccacgacggcctggtccaccgccgcttcccggtcggccccatcgccaacgtgccctacttccggcgagtcgctgccgctcacaagatccaccacatggacaagttcgagggcgtcccgtatgggctctttctgggaccaaaggagctggaggaggttggtggcctggacgagctggagaaggagctcgcgcgaatcagccgggccatgtgacctccacggcgccgtggacggagcgcccaccgccgcgcgggctctgctccgggatttttgtttttctgtcgcttcgttgattcgatttaggagggagtcgaggccgacgagaagttgatttggtgacaggcgccctgatacaccgcgcgtattctggttgtacggggcgtggatgctgtgaacatttgtatggtctggggaggcacgggtcgtacatagaaactttagtgccatgaaattgtttcttctttttttcctgccattttcacgtcggcgtctatgtggagacgtcgcacgttctggtcccctgtactgttcttatggctaggatcctgtgtataacttgtagggaaatgttgtgaaccacttcaaggaaagcaaaattcggtggttggaaacagtgctgaaaattcagaagcttcctgctctctcattcagaggtggtggc

SEQ ID NO: 5131 - DNA, 1236 bp, Panicum virgatum
  misc_feature (528)..(528): n is a, c, g, or t
  misc_feature (735)..(735): n is a, c, g, or t
  misc_feature (1200)..(1200): n is a, c, g, or t
  misc_feature (1209)..(1209): n is a, c, g, or t
gcgccgcagggcgccgcctgccctcgccgggcgcgcgctgcccttctcgccgctgaccaccgcgagggccccgcgccgccgcgggctcgggaccgtcgtcacgtgcttcgtgccgcaggacacggagcgcccgacggccgcccacgtgccggtgcccgagacggcgctggaggaggaggccagggccgcggcggcgcggcgcgtcgcggagaggaaggcgcggaagctgtccgagcggcggacgtacctggtggccgccgtgatgtccagcctcggggtcacgtccatggccgtcgccgccgtgtactaccgcttcagctggcagatggagggcggcgaggtgccggtaaccgagatgttcggcacgtttgcgctctccatcggcgcggcggtcgggatggagttctgggcgcggtgggcgcaccgggcgctgtggcacgcctccctgtggcacatgcacgagtcgcaccaccggccgcgggaggggcccttcgagctcaacgacgtgttcgccatcatcaacgccgngccggccatctccctcctcgcctacggcttcttccaccgcggcttcgtgcccggcctctgcttcggcgcgggcctcgggattacgctgttcggcatggcctacatgttcgtccacgacggcctggtccaccggcgcttccccgtcggccccatcgccaacgtgccctacttccggcgagtcgctgccgctcacaagatccaccacanggacaagttcgagggcgtcccgtatgggctcttcctgggacccaaggagctggaggaggttggtggcctggacgagctggagaaggagctcgcgcgaatccgcagccggggcatgtgacttcgaccggcgccgcggcggcgtggacggagcgcgcggcaggctccgctccaggatttttgtttttggtcgctttttcgttgattcgatcgtgggggagtcgaggacaacgagaaattggtttggttgtttggggcgtggatgctgtagagaacatttgtaaggtctggggtcggagggcaccgttcgtacatggaagagtccggtgccatggaattgtttttttttcctttcccctgccattttcaggtcggcgtctccgtggagacgtcgcacgttctggtccccctgtattgttcttatggctaggattctgtgcataacacatgtagggaaatgttatgaancacatcaangaaagcaaaattcagtggttgcaaacg

SEQ ID NO: 5132 - DNA, 1596 bp, Oryza sativa
cggggtctctcgattacactcccccgtcacactctcccgctccatccctgtccacgaaagcgcgcgcgggtaagatacgaggccgggagggaagaacgaccacggcatggccaccggtctctccggcggcgctatgaccagcttcgccgtcaagaagccgctcctcgcggccgccgtgcgccgccggtcgtggcccccgccgtcgggccgcgcgctgccgttctcgccgctcacgcggaccccgcgcagccgcgggctcgggaccgtcacgtgcttcgtgccgcagggcacggagagccagcaggccccggctccgtccccgccgccgacggtgcccgtgcccgtgccctcgctggaggaagaggcggctgccgcggcggcgcggcgcatcgcggagaggaaggcgcggaagctgtcggagaggcggacgtacctggttgcggccgtcatgtccagcctcggcttcacgtccatggccgtcgccgccgtgtactaccgcttccattggcaactggagggcggggatgtgccgatgaccgagatgtttggcacgtttgcgctctccgtcggcgcagcggttgggatggagttctgggcgcagtgggcgcaccgctcgctgtggcacgcctccctgtggcacatgcacgagtcgcaccaccgtgcgcgcgagggcccgttcgagctcaacgacgtgttcgccatcaccaacgccgtgccggccatctccctcctcgcctacggcttcttccaccggggcatcgtccccggcctctgcttcggcgcgggcctcgggattacgctgttcggcatggcctacatgttcgtccacgacggcctggtccaccgccgcttccccgtcggccccatcgcgaatgtgccctacttccggcgagtggccgcggcccacaagatacaccacacggacaagttcgagggcgtaccgtatgggctgtttcttggacccaaggagctggaggaggttggtggtctggaagagctggagaaggagcttgcgagaatcaaccggagcttgtgattttgacggcggcaattgcagctagcaagactgcgcctgtcgagctagcagaattgcctttgccttgcaagattttttgtatttctggccgcttcgtcgactccattaattgtcggtaccggagagaaggggactccagaagcggaagcgcttcgagtatacgacgatgtggcagcggtgaagagcacagtatatttgtttgattgtggcctgtggcatgcatgcgtctctgcggctgaacattgtaaggaggatgttctgtgggatggttattctttgaatttcactgcgccaacgtttttggtggagacgttgtgcgtccagtcccctgtcttgtaagaagcaccacattactgtgtataacacatgttagagattgttaaccacttcaatgaaactaaaataggtggttggcaacaatgctgaaatttcaggactttcacatctgtcttgttcagtggtgcgccgcatatgcgaatgattgtccacattgctcccggtcattctacgcgactccatctttattcgtagagggtatgtagtgcatgccatacggccca

SEQ ID NO: 5133 - DNA, 1478 bp, Oryza sativa
gtctctcgattacactcccccgtcacactctcccgctccatccctgtccacgaaagcgcgcgcgggtaagatacgaggccgggagggaagaacgaccacggcatggccaccggtctctccggcggcgctatgaccagcttcgccgtcaagaagccgctcctcgcggccgccgtgcgccgccggtcgtggcccccgccgtcgggccgcgcgctgccgttctcgccgctcacgcggaccccgcgcagccgcgggctcgggaccgtcacgtgcttcgtgccgcagggcacggagagccagcaggccccggctccgtccccgccgccgacggtgcccgtgcccgtgccctcgctggaggaagaggcggctgccgcggcggcgcggcgcatcgcggagaggaaggcgcggaagctgtcggagaggcggacgtacctggttgcggccgtcatgtccagcctcggcttcacgtccatggccgtcgccgccgtgtactaccgcttccattggcaactggagggcggggatgtgccgatgaccgagatgtttggcacgtttgcgctctccgtcggcgcagcggttgggatggagttctgggcgcagtgggcgcaccgctcgctgtggcacgcctccctgtggcacatgcacgagtcgcaccaccgtgcgcgcgagggcccgttcgagctcaacgacgtgttcgccatcaccaacgccgtgccggccatctccctcctcgcctacggcttcttccaccggggcatcgtccccggcctctgcttcggcgcgggcctcgggattacgctgttcggcatggcctacatgttcgtccacgacggcctggtccaccgccgcttccccgtcggccccatcgcgaatgtgccctacttccggcgagtggccgcggcccacaagatacaccacacggacaagttcgagggcgtaccgtatgggctgtttcttggacccaaggagctggaggaggttggtggtctggaagagctggagaaggagcttgcgagaatcaaccggagcttgtgattttgacggcggcaattgcagctagcaagactgcgcctgtcgagctagcagaattgcctttgccttgcaagattttttgtatttctggccgcttcgtcgactccattaattgtcggtaccggagagaaggggactccagaagcggaagcgcttcgagtatacgacgatgtggcagcggtgaagagcacagtatatttgtttgattgtggcctgtggcatgcatgcgtctctgcggctgaacattgtaaggaggatgttctgtgggatggttattctttgaatttcactgcgccaacgtttttggtggagacgttgtgcgtccagtcccctgtcttgtaagaagcaccacattactgtgtataacacatgttagagattgttaaccacttcaatgaaactaaaataggtggttggcaacaatgctgaaatttcaggactttcacatc

SEQ ID NO: 5134 - DNA, 1605 bp, Hordeum vulgare
tccccacttcttcctccaggtttgcacacgcgtacgagaccaaacctctcggcggcttgacgtctttgccttgcttccacagtgcacagtccagtcacccatctcttcttccttcccctttcgagctcccgagctccgtcagtgtccatttatagcctgctcgaaagtgcagtgagagtccccctccatggccgctggtctctcgggctccaccatggccagcttcgcagtcaagaaccctctcctcgccgccgcgcggtaccggacgctgccttcccgtgccggccggcctctcccgttctccccgttcacgcggacggcgcgcaggagggggcaagagaccgtcacgtgcttcgttccgcaggagccggcgacggtgccggtgccttcgctggaggaagaggcggcgtccgcggcggcgcggcgcgtggcggagaggaaggcgcggaagcagtccgagaggcggacgtacctggtggccgccgtcatgtccagcctaggggtcacctccatggccatcgcctccgtgtactaccgcttcgcctggcaaatggagggcggcgaggtgccgatgaccgagatgctgggcacgttcgcgctctccgtcggcgcggcggtcgggatggagttctgggcgcagtgggcgcacaaggcgctgtggcacgcgtccctgtggcacatgcacgagtcgcaccaccggccgcgcgacgggcccttcgagctcaacgacgtcttcgccatcatcaacgccgtgccggccatcgccctcctcgcctacggcttcttccaccgcggcctcgtccccggcctctgcttcggcgcgggccttgggattacgcttttcgggatggcatacatgttcgtccacgacggcctggtccaccgccgcttccccgtcggccccatcgccgacgtgccctacttccggcgagtggctgccgctcacaagatacaccacatggacaagttcgagggcgtaccgtatgggctcttcctgggacccaaggagctggaggacgttggtggcctcgacgagctggagcaggagctcgccagaatcaaccggactcggagcatctgagctctggacatggcgtggcggcatatgcagctagaagaaccttgtgatctcatctagcagatgaactccatttcaagaattttttttcttatctttggtggttgctatatattgatttaattgatggtgctggacatggggagccagaccaagaagcaatctgatggtcaggtggtggcggtgtactccctgttactcggctccagagggcgtggatgtgtctaaacagctataggaagaagcacagatggttcatgaggttgtgacttgattttttttcctgccttcgtagtctcaccacgtccacatttttgtttagtggagacccaactctccatgtcttgttcttatatatggctagaaactactcttctgtgtataacatgtagagaaggctgtgaaccacttcggtgaaagtaaagttggcggtcggcaagaataccggagattcagagcttttccatgtttcctgctttctccgccaaacagaatctcacactatcgttgttgctactcatagtatc

SEQ ID NO: 5135 - DNA, 1526 bp, Hordeum vulgare
acctctcggcggcttgacgtctttgccttgcttccacagtgcacagtccagtcacccatctcttcttccttcccctttcgagctcccgagctccgtcagtgtccatttatagcctgctcgaaagtgcagtgagagtccccctccatggccgctggtctctcgggctccaccatggccagcttcgcagtcaagaaccctctcctcgccgccgcgcggtaccggacgctgccttcccgtgccggccggcctctcccgttctccccgttcacgcggacggcgcgcaggagggggcaagagaccgtcacgtgcttcgttccgcaggaggggcaggcgccgggcccggctcccgtgccggagccggcgacggtgccggtgccttcgctggaggaagaggcggcgtccgcggcggcgcggcgcgtggcggagaggaaggcgcggaagcagtccgagaggcggacgtacctggtggccgccgtcatgtccagcctaggggtcacctccatggccatcgcctccgtgtactaccgcttcgcctggcaaatggagggcggcgaggtgccgatgaccgagatgctgggcacgttcgcgctctccgtcggcgcggcggtcgggatggagttctgggcgcagtgggcgcacaaggcgctgtggcacgcgtccctgtggcacatgcacgagtcgcaccaccggccgcgcgacgggcccttcgagctcaacgacgtcttcgccatcatcaacgccgtgccggccatcgccctcctcgcctacggcttcttccaccgcggcctcgtccccggcctctgcttcggcgcgggccttgggattacgcttttcgggatggcatacatgttcgtccacgacggcctggtccaccgccgcttccccgtcggccccatcgccgacgtgccctacttccggcgagtggctgccgctcacaagatacaccacatggacaagttcgagggcgtaccgtatgggctcttcctgggacccaaggagctggaggacgttggtggcctcgacgagctggagcaggagctcgccagaatcaaccggactcggagcatctgagctctggacatggcgtggcggcatatgcagctagaagaaccttgtgatctcatctagcagatgaactccatttcaagaattttttttcttatctttggtggttgctatatattgatttaattgatggtgctggacatggggagccagaccaagaagcaatctgatggtcaggtggtggcggtgtactccctgttactcggctccagagggcgtggatgtgtctaaacagctataggaagaagcacagatggttcatgaggttgtgacttgattttttttcctgccttcgtagtctcaccacgtccacatttttgtttagtggagacccaactctccatgtcttgttcttatatatggctagaaactactcttctgtgtataacatgtagagaaggctgtgaaccacttcggtgaaagtaaagttggcggtcggcaagaataccggagattcagag

SEQ ID NO: 5136 - DNA, 1427 bp, Brachypodium distachyon
gccatggccgccggtctctcccgcgccaccatggccagcttcgccgtcaagaacccgctcctcgcggccgcggccgcgcgttgccgggcgctgccttccttcgccgccgcccggcgcctgccgttctccccgttgacgcggacgccgccccgccggcgcgggctcgagaccgtgacgtgcttcgtcccacaggagacgcaggcgtcgggcgcggctgcttcttctccggctccggcgccggcgccggtgccttcgctggaggaagaggccgcgtccgcggcgtcgcggcgcgtcgcggagaggaaggcgcggaagcattccgagcggcggacgtacctggtggccgccgtcctgtccagcctcggcgtcacctccatggccatcgcctccgtgtactaccgcttcgcctggcaaatggagggcggcgaggtgccgatgaccgagatgttgggcacgttcgcgctctccgtcggcgcagcggtcgggatggagttctgggcgcagtgggcgcaccgggcgctgtggcacgcctccctgtggcacatgcacgagtcgcaccaccggccccgcgacgggccgttcgagctcaacgacgtgttcgccatcatcaacgccgtgccggccatctgcctcctcgcctacggcttcttccaccgcggcctcatccccggtctctgtttcggcgcgggccttgggattacgctgttcggcatggcctacatgttcgtccacgacggcctggtccaccgccgcttccccgtcggccccatcgcgaatgtaccctacttccggcgagtggctgcggctcacaagatacaccacatggacaagttcgagggcgtaccgtatgggcttttcctgggacccaaggagctggaggatgttggtggcctggacgagctggacaaggagctcgccagaatcaaccggaatcggagcatttgatggattctcgaaatggcagcacgcagctaagctagcacacggtgatttatttctattttttttgggaagggatgtctgtccgatgatctaggtgggattcgaggattacaagaattttttgttcttggcgggtctttgttgattctatggcggtactggaggagggtaaaatcggaacctgaagcagagtgatgatgatctagtgacgatcgagtagcgcttcctccctcattttattgcacaggacgtcgtcgttgttaatcgtttgtacgaagatgcacagatcctgcgtgaggaagtttccgagccgtgattaaatcttcaccagtccataattttctttttatacggagatctagttccctgccttgttccgatcgctagaaactacgctgctgtgtataacctgtagagaaagactgtgaaccgtacttcaacggaaccatgagaactaaagttacctgttggcaagttgttgtgct

SEQ ID NO: 5137 - DNA, 1810 bp, Brachypodium distachyon
ccccacttcttctcttcacccttgatttttcctgatttttcttttggaagggatccccctgatttgtacacgcgttgcaaagcaagcctctcggcggcttctgcatcctcttgcttgtctgccggtcttcccctttcgcgcttccccgctccgtccctgtccatttatagcctcctcgaaagtgcactccaaagggagtagtcctgctcagaacgtcagaggccatggccgccggtctctcccgcgccaccatggccagcttcgccgtcaagaacccgctcctcgcggccgcggccgcgcgttgccgggcgctgccttccttcgccgccgcccggcgcctgccgttctccccgttgacgcggacgccgccccgccggcgcgggctcgagaccgtgacgtgcttcgtcccacaggagacgcaggcgtcgggcgcggctgcttcttctccggctccggcgccggcgccggtgccttcgctggaggaagaggccgcgtccgcggcgtcgcggcgcgtcgcggagaggaaggcgcggaagcattccgagcggcggacgtacctggtggccgccgtcctgtccagcctcggcgtcacctccatggccatcgcctccgtgtactaccgcttcgcctggcaaatggagggcggcgaggtgccgatgaccgagatgttgggcacgttcgcgctctccgtcggcgcagcggtcgggatggagttctgggcgcagtgggcgcaccgggcgctgtggcacgcctccctgtggcacatgcacgagtcgcaccaccggccccgcgacgggccgttcgagctcaacgacgtgttcgccatcatcaacgccgtgccggccatctgcctcctcgcctacggcttcttccaccgcggcctcatccccggtctctgtttcggcgcgggccttgggattacgctgttcggcatggcctacatgttcgtccacgacggcctggtccaccgccgcttccccgtcggccccatcgcgaatgtaccctacttccggcgagtggctgcggctcacaagatacaccacatggacaagttcgagggcgtaccgtatgggcttttcctgggacccaaggagctggaggatgttggtggcctggacgagctggacaaggagctcgccagaatcaaccggaatcggagcatttgatggattctcgaaatggcagcacgcagctaagctagcacacggtgatttatttctattttttttgggaagggatgtctgtccgatgatctaggtgggattcgaggattacaagaattttttgttcttggcgggtctttgttgattctatggcggtactggaggagggtaaaatcggaacctgaagcagagtgatgatgatctagtgacgatcgagtagcgcttcctccctcattttattgcacaggacgtcgtcgttgttaatcgtttgtacgaagatgcacagatcctgcgtgaggaagtttccgagccgtgattaaatcttcaccagtccataattttctttttatacggagatctagttccctgccttgttccgatcgctagaaactacgctgctgtgtataacctgtagagaaagactgtgaaccgtacttcaacggaaccatgagaactaaagttacctgttggcaagttgttgtgcttgaaattcagaacttcccctgcatgaataggaacggagccagaaattcggcacgaggggggcgagaaaaataaagccgaaagatgggcttcattgaagacatatagtcttgatatcatatcaaataaagtcaggtcgaagtagttaaaataaaaatgcaaat

SEQ ID NO: 5138 - DNA, 1421 bp, Triticum aestivum
ttcgagctccctcgctccgtccctgtccatttatagcttccgagaaagtgcagtgcgcccaagggagtgtaccgagagactccctccatggccgctggtctctcgggctccaccatggccagcttcgccgtcaagaaccctctgctcgccgctgccgcgcgcttccggacgctgccttcccgtgccggccggcctctcccgttctccccgttcacgcggacggcgcgcaggcgcgggcaagagaccgtcacgtgcttcgtcccgcaggagggccaggcgcccggcccggctcccgagcccgtgccttcgctggaggaagaggcggcgtccgcggcggagcgccgcgtggcggagaggaaggcgcggaagcagtccgagaggcggacgtacctggtggccgccgtcatgtccagcctcggggtcacctccatggccatcgcctccgtgtactaccgcttcgcctggcaaatggagggcggcgaggtgccgatgaccgagatgctgggcacgttcgcgctctccgtcggcgcagcggtcgggatggagttctgggcgcagtgggcgcacaaggcgctgtggcacgcctccctgtggcacatgcacgagtcgcaccaccggccgcgcgacgggcccttcgagctcaacgacgtgttcgccatcatcaacgccgggccggccatcgcactcctcgcctacggcttcttccaccgcggcctcattcccggcctctgcttcggcgcgggccttgggattacgcttttcggcatggcatacatgttcgtccacgacggcctggtccaccgccggttccccgtcggccccatcgcggacgtgccctacttccggcgagtggctgccgctcacaagatacaccacatggacaagttcgagggcgtaccgtatgggcttttcctgggacccaaggagctggaggacgttggtggcctcgacgagctggagcaggagctcgccaggatcaaccggactcggagcatctgaaggactctggacatggtggcatatgcagctagaagagccttgtgatctcatctagcagatgaactacaattcaagattttttttaactttttggtggttgctattgatttaattgatggtactggagctggggagtccagagctaatgatcaggcagtggtggtggtgtactccccgttactcggctgcaaggggcgtggatgtgtccaaacagttctaggaagaagcacagatggttcaagaggttgtgccatgattttttttttcctgccttcgaggtctcaccgcgtccacatttttgttttgtggagacccaactccatgtcttgttcttatatatggctagaaactacgcttctgtgtataacaagtagagaaggttgtgaaccacttcaatgaaagtaaaagttggcggttggcaa

SEQ ID NO: 5139 - DNA, 1607 bp, Triticum aestivum
tccctacttctgcctccagctttgcacacgcgtacgaaaccaaacctctcggcggcttgacgtctttgccttgcttccagagtccagtcacccatctcttcttcccctttcgagctccctcgctccgtctctgcccatttatagcctccgagaaagtgcagtgcacccaagggagtgtaccgagagactccctccatggccgctggtctctcgggctccaccatggccagcttcgccgtcaagaaccctctgctcgccgctgccgcgcgcttccggacgctgccttcccgtgccggccggcctctcccgttctccccgttcacgcggacggcgcgcaggcgcgggcaagagaccgtcacgtgcttcgtcccgcaggagggccaggcgcccggcccggctcccgagcccgtgccttcgctggaggaagaggcggcgtccgcggcggagcgccgcgtggcggagaggaaggcgcggaagcagtccgagaggcggacgtacctggtggccgccgtcatgtccagcctcggggtcacctccatggccatcgcctccgtgtactaccgcttcgcctggcaaatggagggcggcgaggtgccgatgaccgagatgctgggcacgttcgcgctctccgtcggcgcagcggtcgggatggagttctgggcgcagtgggcgcacaaggcgctgtggcacgcctccctgtggcacatgcacgagtcgcaccaccggccgcgcgacgggcccttcgagctcaacgacgtcttcgccatcatcaacgccgggccggccatcgccctcctcgcctacggcttcttccaccgcggcctcatccccggcctctgcttcggcgcgggccttgggattacgcttttcggcatggcatacatgttcgtccacgacggcctggtccaccgccggttccccgtcggccccatcgcggacgtgccctacttccggcgagtggctgccgctcacaagatacaccacatggacaagttcgagggcgtaccgtatgggcttttcctgggacccaaggagctggaggacgttggtggcctcgacgagctggagcaggagctcgccaggatcaaccggactcggagcatctgaaggactctggacatggtggcatacgcagctagaagagccttgtgatctcatctagcagatgaactacaattcaagattttttttaactttttggtggttgctattgatttaattgatggtactggagatggggagtccagggccagaagcaaagctaatgatcaggcagtggtggtggtgtactccccgttactcggctgcagggggcgtggatgtgtccaaacagttctaggaagaagcacagatggttcaagaggttgtgccatgattttttttttcctgccttcgaggtctcaccgcgtccacatttttgttttgtggagacccaactccatgtcttgttcttatatatggctagaaactacgcttctgtgtataacaagtagagaaggttgtgaaccacttcaatgaaagtaaaagttggcggttggcaagaatgctggagattcagtacttttccatgtttcctcctttctccaccagacagaatgtcacactat

SEQ ID NO: 5140 - DNA, 1512 bp, Avena sativa
gctgtgtacacgcgtatgaaaccgaacctctcggcagctccggtcttccccagttccgctttcgcgctcccccgctccgtccctgtccatttatagcctcctcgaaagcgcgcgccaggagctagtgagtgtgtaccaagcaacgtcacttccatccatggccgctggtctctccggcgccaccatgaccggcttcgcggtgaagaaccccctcctcgccgccgccgccgcgcggtgccggacgctgccttcgcgtcatctcccgttctcgccgtttacgcggacgccgcgcaggcgcgggctcgagaccgtcacctgcttcgtgccgcaggtggggcaggcgcccgcgggccctgccccggagccggccacggtgcccgtgcccgtgccgatgccgatgccttcgctggaggaggaggcggcgtccgcggccgcgcgccgtatcgcggagaagaaggcgcggaagcagtccgagcggcggacgtacctggtggcggccgtcatgtccagcctcggcgtcacctccatggccatcgcctccgtctactaccgcttcgcctggcaaatggagggcggcgaggtgccgatgaccgagatgctgggcacgttcgcgctctccgtcggcgccgcggtcgggatggagttctgggcgcagtgggcgcacaaggcgctgtggcactcctcgctgtggcacatgcacgagtcgcaccaccggccgcgcgacgggcccttcgagctcaacgacgtcttcgccatcatcaacgccggcccggcaatcgccctcctcgccttcggcttcttccacagcggcctcatccccggcctctgcttcggcgcgggcctcgggattacgcttttcggcatggcctacatgttcgtccacgacggcctggtccaccgccggttccccgtcggccccatcgcgaatgtaccctacttccggcgagtggctgcggctcacaagatacaccacatggacaagttcgagggcgtaccgtatgggctgttcctgggacccaaggagctggaggaggttggtggcctggacgagctggagcaggagctcgccaaaatcaaccggactaggagcatttgagttctagacatctaacgaacgagctccattccaagattcttgttttttttgggtacttattgatttaattgatggtactggagatggggtgtccagaaccagcagcaatctgatgatcaggtggtggtggtggcggcggcggcggcggcggcgacggtggtggtggtatactcccccattgcttggctaaacgggggcgtgacgtgtctacactattctaggaagaagcacggttacatgaggttctttgtgccattttctctctgccttcgcggcttcaccacgtccacatttttgttttgtggagaccaaactccatgctctgttcttgtggctagaaactacactgctgtgtataacatgtagagaaggttgtgtgttgtgaaccacttcaatgaaagtaaagttggcggttg

SEQ ID NO: 5141 - DNA, 2093 bp, Sorghum bicolor
ctacttcccggcaccgcaccgcctctcccggtcccagcaccgcaccgcgctcctcggaccaaccactgggctcgccagtcgccgacgctccaggcaggggcccgtcgagggcgagagaaatccgcgcctcggcccccctcctgccgcgggatttcagttaccgcccgctgccgcttcatccgcgaaggcaggcaggcaggcaggcaggcaggcaggcaggcggcggcaatgccgctgggctcgcccgtgaagcgcctgctgcggcgtgcggccaaggggaggctagacaaggccgagctggcggtggcggggctggccgcggcggccgccgcgctgctgctgctcctcctctgcgcctcctcgctccgctgctcggccgccgcgctggtgtccgcgcacgggaggctctgggccggcggggtctccatcgctgctgcttcggacgcggatgcggcggcggatgtcgacaagcggcccgtctccgcaccggctactgcggcggcggggagtggtggcgacgacgaggaggagtgcgacctgttcgacggggagtgggtctcggctggtggcggcgggtacccgctctacgactccagggactgcccgttcctcgacgtcggcttccgctgcgccgagaacggccgccccgacacgtcctacaccaagtggcgctggcagccgtcgcgatgccatctccccagatttgatgccaaaagcatgctggagaagctacgaaacaaaagagtagtttttgttggtgattcaattggaaggaaccaatgggagtctctactttgtatgctctctagtgctgttcataacaagagctctatctatgaagttaatgggaatcccatcacaaagcacatgggtttcttgattttcaactttacagactacaattgcactgtggaatactacagatccccctttatagtccttcaaggtcgtccaccagcaggagcccctgagattgttaggtacagtattcgagtggatgcaatggattggatgtctgaccggggtaagtggaaggatgctgatgtattgatcttcaacactgggcattggtggaacaatgagaaaacaatcagggggggtgcctactttcaagtaggagatgaggtcaaaatgggcatgactgttgcagatgcttacagaaggtcgatacagacattgtctgattggcttcacaaagaagttaacacaagcaagacccatgtcatctaccgtacatatgctcctgtgcatttcagaggtggtgactggaagactggtgggagctgtcacttagaaactcttccagatgtgatgccagtgaagtccctggatgaatgggctgacttgcttcagcccgtgaatgattttctagggagcaacctcagatccaagttggttggattagacctgcttaatgtgacgagaatgacagctcagagaaaagacggccacctctcagtatacctgagcccttcaggacctgtccctcgctacaaacaggattgcagccactggtgccttcctggagttcctgatacctggaatgagcttctctacgcccttgtcatgagaaagcatgagaagatgggtcagaatgcttcccttgctagcactaggacactgcacactgaagatggaaatgtcttcagctgatcatcatgacaaaacaagtttcatagtcatcctgcgcgatgagtcgataatagctgctgtttcacataccaattaggataggatgccagagtggcgaaacacatttttggatcatgggcgtttgcaggaagctgcgtaccgccctgctgtgctgtgtttgcatatggtgatgttagtgaatagctgagctagaggtcagttgtagtatagctttgtgtggtgaaggcaacttgtatggctcatggagaggttattggaattggcattggcagtgtatctagggttgctacagcgaatgatgtaaatatgtagctgtgaaagtgggggtggttttaactgaagctcactgcagttacgaggtgcatgtgcatgtgaatcaagaatttctaagctgtacaattgttgctcaacggctcgagttccatgctcgtgatctcatt

SEQ ID NO: 5142 - DNA, 2225 bp, Sorghum bicolor
gattcgctcgccccacttccaatcgccgtctcataaatccggtcggcgcccacatccacctccgcctccgcccgccgccaccttctcctctacttcccggcaccgcaccgcctctcccggtcccagcaccgcaccgcgctcctcggaccaaccactgggctcgccagtcgccgacgctccaggcaggggcccgtcgagggcgagagaaatccgcgcctcggcccccctcctgccgcgggatttcagttaccgcccgctgccgcttcatccgcgaaggcaggcaggcaggcaggcaggcaggcaggcaggcggcggcaatgccgctgggctcgcccgtgaagcgcctgctgcggcgtgcggccaaggggaggctagacaaggccgagctggcggtggcggggctggccgcggcggccgccgcgctgctgctgctcctcctctgcgcctcctcgctccgctgctcggccgccgcgctggtgtccgcgcacgggaggctctgggccggcggggtctccatcgctgctgcttcggacgcggatgcggcggcggatgtcgacaagcggcccgtctccgcaccggctactgcggcggcggggagtggtggcgacgacgaggaggagtgcgacctgttcgacggggagtgggtctcggctggtggcggcgggtacccgctctacgactccagggactgcccgttcctcgacgtcggcttccgctgcgccgagaacggccgccccgacacgtcctacaccaagtggcgctggcagccgtcgcgatgccatctccccagatttgatgccaaaagcatgctggagaagctacgaaacaaaagagtagtttttgttggtgattcaattggaaggaaccaatgggagtctctactttgtatgctctctagtgctgttcataacaagagctctatctatgaagttaatgggaatcccatcacaaagcacatgggtttcttgattttcaactttacagactacaattgcactgtggaatactacagatccccctttatagtccttcaaggtcgtccaccagcaggagcccctgagattgttaggtacagtattcgagtggatgcaatggattggatgtctgaccggggtaagtggaaggatgctgatgtattgatcttcaacactgggcattggtggaacaatgagaaaacaatcagggggggtgcctactttcaagtaggagatgaggtcaaaatgggcatgactgttgcagatgcttacagaaggtcgatacagacattgtctgattggcttcacaaagaagttaacacaagcaagacccatgtcatctaccgtacatatgctcctgtgcatttcagaggtggtgactggaagactggtgggagctgtcacttagaaactcttccagatgtgatgccagtgaagtccctggatgaatgggctgacttgcttcagcccgtgaatgattttctagggagcaacctcagatccaagttggttggattagacctgcttaatgtgacgagaatgacagctcagagaaaagacggccacctctcagtatacctgagcccttcaggacctgtccctcgctacaaacaggattgcagccactggtgccttcctggagttcctgatacctggaatgagcttctctacgcccttgtcatgagaaagcatgagaagatgggtcagaatgcttcccttgctagcactaggacactgcacactgaagatggaaatgtcttcagctgatcatcatgacaaaacaagtttcatagtcatcctgcgcgatgagtcgataatagctgctgtttcacataccaattaggataggatgccagagtggcgaaacacatttttggatcatgggcgtttgcaggaagctgcgtaccgccctgctgtgctgtgtttgcatatggtgatgttagtgaatagctgagctagaggtcagttgtagtatagctttgtgtggtgaaggcaacttgtatggctcatggagaggttattggaattggcattggcagtgtatctagggttgctacagcgaatgatgtaaatatgtagctgtgaaagtgggggtggttttaactgaagctcactgcagttacgaggtgcatgtgcatgtgaatcaagaatttctaagctgtacaattgttgctcaacggctcgagttccatgctcgtgatctcattttgtgtgtgccttatgacttacatctcagtccgttcagtaaac

SEQ ID NO: 5143 - DNA, 1977 bp, Zea mays
aaggggaaaaataacgaaggaagcgaagcggcaacttccgccttctcttcgccagttactccacttccaatcgccgtctcataaatccgggctgccacttccgcctccatcgccgccagccgccgccttctcttcgccagttactccacttgcccgcaggccgcaccgcaccgccaccgctttcatcggacgatccactgagcaagccacgccaggcaggggctcgtacagggcgagagaaacccgcgcgctcgcccctgtcctgccgcgggatcgcagttgccgtccgcttcatccccggacccggaggtaggcaccaggcaggcggcggcaatgctaccgggctcgccggtgaagcgcctgctgcggcgggcggccaaggggcggcgggagaaggccgagctggcggggctggccgcggcggccgccgcgctgctgctgctctgcgccgcctcgctccgctgctcggccaccgcgcgcgggaggctctgggccggtggggtctccatcgcggcggcggggagtggcggcgaggaggagtgcgacctgttcgacggggactgggtctgggctggcggcggcggcgggtacccgctctacgactcccgggactgcccgttcctcgacgtcggcttccgatgcgccgagaacggccgccccgaggcgtcctacaccaagtggcgctggcagccgtcgcgctgccatcttcccagatttgatgccaaaagcatgctggagaagctacgaaacaaaagagtggtttttgttggtgattcaattggaaggaaccaatgggagtctctactttgtatgctctctagcgctgttcataacaagagctctatctacgaagttaatgggagtcccatcacaaagcacatgggtttcttgattttcaattttagagactacaattgcacggtggaatactacagatccccttttatagtccttcaaggccgtgcaccagcaggagcacctgagattgtccggtacagtattcgagtggatgcaatggattggatgtccgaccggggtaaatggaaggatgctgatgtactgatcttcaacactgggcactggtggaacaatgagaaaacaatcagggggggtgcctactttcaagtaggcgatgaggtcaaaatgggcatgagtgttgctgaggcttacagaagatcgatagagacattgtccgattggcttcgcaaagaagtcaacacgagcaagacccatgtcatctaccgcacatatgctcctgtgcatttcagagatggtgactggaagactggtgggagctgccacttggaaactcttccagacgcgatgccagtgaagtccctggacgaatgggccgacttgctccaacccgtggacgaatttctagggagcgatcttggatccgagctggctggtgtagacctgcttcgcgtgacgggaatgacggcccagagaaaagacggccacctctcggtctacctgagcccctcaggacccgtgccccgctacagacaggactgcagccactggtgtcttcctggagtccccgatgcctggaacgagcttctctacgccctcgtcatgaggaggcataagaagatggccggcactaggacaccggacgctgaagagggagatgtcttcagcagtggatcatcatcgtgacaaaacgagcttcgtagccatccatccatcctggctaggcgatgacagctgctgtttcacataggatgccggaatggcgagacacgtttttggaccatgggtgctgtttgcaagaagctgagctagacgtcagtggtagtatagctttgtgtgtggtgatggcaacttgtatggctaatggggaggtatttggaattggcagtgtaactagctagggtcgctacagcgaatgatgtacatatgtattcttttagcactcgttcgatgattcatattccatgtaggttttgatgggattaaaaagaaaattataaa

SEQ ID NO: 5144 - DNA, 2248 bp, Zea mays
aattccattttttattcgctcctcacacgtcgccgtcgcttctcgttattaatatcgccgtcgcctcgcacctccctttgttccgtcgccccgcattgctcgccaagagttcttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatggtggtgtccactcccgccttgaccaactgcagttacttctgaaaggtgtcagtgagagaggagcaaaaaaaattcgtgtgcacatccttaccgatgggcgtgacgttttggatggcagcagtgttggtttcgtggagaccctagagaatgatcttttggagcttcgaggcaagggtattgatgcacagattgcttctggtggtggaaggatgtatgttaccatggaccgttatgagaatgactgggatgtggttaaacgtggctgggatgctcaggtgctcggagaagcaccctacaaattcaaaagtgcacttgaggctgtgaaaacactgagagcacagcccaatgctaatgaccaatacttgcccccatttgtgatagttgatgacagcggcaaagctgttgggcctgtattagatggtgatgcagttgtcactatcaacttccgggctgatcgcatggttatgcttgctaaagcactagagtatgcagattttaacaactttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaatggtaaccgctcgggatactttgatgaaactaaggaagagtatgtagaagttcctagtgacagtggtattacattcaatgttgcacccaagatgaaggcgcttcaaattgctgagaaagctagggacgctctcctaagtggaaagtttgaccaggtacgtgtcaacctgccaaatggtgacatggttggtcacactggggatattgaggctaccgttgttgcttgcaaggcagctgatgaagctgttaagatcattctggatgctgtcgagcaagttggtggtatttaccttgttactgccgatcatggcaatgctgaggatatggtgaaaaggaacaaatctggcaagccgttgctcgacaagaatggtggtatccagattctaacctcgcatacccttcagccggtgccggttgccattggaggccctggtcttcaccccggagtgaaattccggaacgacattcaaatccctgggctcgccaatgtagccgcaactgtgatgaacctccatggatttgaggcccctgctgactacgagcaaaccctaattgaagtggctgacaactaaatactggccagctatgtccaattttggttctatagttttgagaagggatatggccatgccattcaataatttctgtttgcaagcacggtgctcaaactcaccaaaacattgagaaacgccttttgacttgcatttagatgctctatttataccgttgacaatcgtctcttctggcttttagcagtttgatggctatctttacttagctatataatgtatctgagactgcaaactttgtgtcagtcaaactgctcgaggttatatgctgtttgtgtgggtcatcacgtgtgattaccttcgcacgcattgacgcatgaattgtgttcaccattctaattgcaaggcattttgatgggctacaatgtttgggagcaagataatttcagccccttcattcgcctagctctcccaaataa

SEQ ID NO: 5145 - DNA, 2148 bp, Saccharum officinarum
ttcttgttaggcaaggcaaaagcagaagcaaaaaggtctcgttggctatggcgagctctgggttctcgtggacgctgccggaccacccgaagctccccaaggggaagcaggtggctgtcgtcgtgctggacggatggggcgaggccaaccccgaccagtacaactgcatccatgtcgctcagactcctgtcatggactcgctaaagaatggtgctcctgagaaatggagactagtgaaggctcatggaacagctgtgggtctcccatctgatgatgacatgggcaacagtgaagttggccacaatgcacttggtgctggtcggattttcgcccaaggtgctaagcttgtcgatagtgctcttgcctccggaaagatttataatggagatgggttcaactacatcaaagaatcttttgaaagtggtactcttcaccttattgggttgttgagtgatggtggtgtccactctcgtcttgaccaactgcagttacttctgaaaggtgccagtgagaggggagcaaaaaaaatccgtgtgcacatccttaccgatgggcgtgatgttttggatggcagcagtgttggtttcgtggagaccctagagaatgatctttcggagcttcgagggaagggtattgatgcacaaattgcatctggtggtggaaggatgtatgttaccatggaccgttatgagaatgactgggatgtggttaaacgtggctgggatgcccaggtgcttggagaagcaccctacaaattcaaaagtgcacttgaggctgtgaaaacactgagagcacagcccaatgctaatgatcagtacttgcccccatttgtgatagttgatgacagtggcaatgctgttgggcctgtattagatggtgatgcagttgtcactctcaacttccgagctgatcgcatggttatgcttgccaaagcactagagtacgcagattttgacaaatttgaccgtgttcgtgtccccaaaatccgatatgctgggatgcttcagtatgatggtgagttgaagcttccaagccgttaccttgtttccccaccagagatagatagaacatctggggagtacttggtgaagaatggcatccgcacctttgcttgcagtgagacggtgaaatttggccatgtcacatttttctggaacggcaaccgttcaggatactttgatgaaaccaaggaagagtatgtagaagttcctagtgacagtggtattacattcaatgttgcacccaagatgaaggcacttgaaattgccgagaaagccagggacgctctcctaagtggaaagtttgaccaggtacgtgtcaacctgccaaatggtgacatggttggtcacactggtgatattgaggccaccgttgttgcttgcaaggcagctgatgaagctgttaagattattttggatgctgtcgagcaagttggtggtatttaccttgttactgccgatcatggcaatgcagaggatatggtgaaaaggaacaaagctggcaagccgttgctcgacaagaatggcggtatccagattctaacctcgcatacccttcagccggtcccggttgccattggaggcccaggtcttcaccctggagtgaaattccggaacgacattgaaacccccgggctggccaacgtagccgcaactgtgatgaacctccatggatttcaggcccctgcagactacgagcaaaccctgattgaagtggctgacaactaaatactggccagctatgtccaattttggttctatagttgagaatggatatggccatgtcagtgaataatttctgtttgcaagcacgttgctcaaactcaccaaaacattgagagacgccttttgacttgcatttagatgctctatttataccgttgacaattgtatgctgtgctggcttttggcagtttgatagctatctttacttagctatatatactgtatctgaggccgcaaactttgtgtcagtctaaaattgctcgaggttgattgcccaaccccaaaaaaacacccctcacaacacaatccggacaatcctcactctcggggggggcggccccaaagaatcaaaaattacctacccgtggttgcgagaaaagagatccccttttgtgttgcccaaatacaatccccggccggtgcg

SEQ ID NO: 5146 - DNA, 2264 bp, Sorghum bicolor
aattataatttttttattcgcatctcacgtcgccgtcgcgtgtccttattaataccgccgcggcgtcgcacctccctttgttccatcgcccccattgctcgccaagagttcttcttgttaggcaaggcaaaagcagaagcaaaaaggtctcgttggcgatggcgagctcgggagtttcgtggacgctgccagaccacccgaagctccccaaggggaagccggtggccgtcgtcgtgctggacggatggggtgaggccagccccgaccagtacaactgcatccatgtcgctcagactcctgtcatggactcgctaaagaatggtgctcctgagaaatggacactagtgaaggctcatggaacagctgtgggtctcccatctgatgatgacatgggcaacagtgaagttggccacaatgcacttggtgctggtcggatttttgcccaaggtgctaagcttgtcgatagtgctcttgcctctggaaagatttatagtggagatgggttcaactacatcaaagaatcttttgaaagtggtactcttcaccttattgggttgttgagtgatggtggtgtccactctcgtcttgaccaactgcagttacttctgaaaggtgccagtgagaggggagcaaaaaaaatccgtgtgcacatccttaccgatgggcgtgatgttttggatggcagcagtgttggtttcgtggagaccctagagaatgatctttcggagcttcgagggaagggtattgatgcacaaattgcatctggtggtggaaggatgtatgttaccatggaccgttatgagaatgactgggatgtggttaaacgtggctgggatgcccaggtgcttggagaagcaccctacaaattcaaaagtgcacttgaggctgtgaaaacactgagagcacagcccaatgctaatgatcagtacttgcccccatttgtgattgttgacgacagtggcaaagctgttgggcctgtattagatggtgatgcagttgtcactctcaacttccgagctgatcgcatggttatgcttgccaaagcactagaatacgcagattttgacaaatttgaccgtgttcgtgtccccaaaatccgatatgctgggatgcttcagtatgatggtgagttgaagcttccaagccgttaccttgtttccccaccagagatagatagaacatctggggagtacttggtgaagaatggcgtccgcacctttgcttgcagtgagacagtgaaattcggccatgtcacatttttctggaacggcaaccgttcaggatactttgatgaaactaaggaagagtatgtagaagttcctagtgacagtggtattacattcaatgttgcacccaagatgaaggcgcttgaaattgctgagaaagccagggatgctctcctaagtggaaagtttgaccaggtacgtgtcaacctgccaaatggtgacatggttggtcacactggtgatattgaggccaccgttgttgcttgcaaggcagctgatgaagctgttaagattattttggatgctgtcgagcaagttggtggtatttaccttgttactgccgatcatggcaatgcagaggatatggtgaaaaggaacaaagctggcaagccattgctcgacaagaatggtggtatccagattctaacctcgcatacccttcagccagtcccggttgccattggaggccctggtcttcactccggagtgaaattccggaaggacattgaaacccctgggctcgccaacgtcgcggcgactgtgatgaacctccatggatttgtggcccctgctgactacgagcaaaccctgattgaagtggctgacaactaaagactggccagctatgcccaattttggttctatagtttgagaatggatatggccatgtcatttaataatttatgtttgcaagcacgttgctcaaactcagcaaaacattgagagatgccttttgacttgcatttagatgctctatttataccgatgacagttgtatgctgtgctggcttttggcagtttgatagctatctttatttagctatgtatactgtatctgaggccgcaaactttgtctcagtctaaaattgctcgaggttatatactgtttgtgtgagtcatcactagtgattaccttttgcctcacgccttgacgaacgagttcgttaacctgctgagaatggactcatggtactacggtaatagcttttgtgggaaggtgcagtaatactgagatggcgagctgtcagcttcagataa

SEQ ID NO: 5147 - DNA, 3194 bp, Sorghum bicolor
ctttcggcccaactttttacttgctgtgaccgttttcagggctgaaaagttagagctgaacaattttcaatgttgtctaaaaccagaaaatgacacaataggaggcattctgacaaaccccacaatttaatggcattcgacgaaacccacttgcggcaaaattttaatttctcgtggctggatctgacgctttcacgcatggccccttccaaaagtccaaatttctctcggctggttctgacgctttcacgcgcggccccttcgaaaagtccaatttcccgtggctggttctgacgctttcgcgcacgcgccccgtcgaaaagtccaaagctcacgttaaactctatgatatgatccgcagtggggccgccgtgaggtggactatgcttgttccgttgcacggcgctgatcaccagtgggcctcacctgggccgggcgatagccgcccaccatcattaccgtccgataccaggggcagaataaaactggcggatctccgccgtctggatccacaaacccggcggagccattcctcattcgaaccaaagcccatcttttccttctccctatataaataaataaaaaacttattaaaatataaaataagatatctcaccttctctacgcacctcggccgtccgatgactccatttgttcccccggagcaccgatcctgccgtccacttgttaaatcgcctgagtttaagtcgaagcaccatccttaaatatagcaattataatttttttattcgcatctcacgtcgccgtcgcgtgtccttattaataccgccgcggcgtcgcacctccctttgttccatcgcccccattgctcgccaagagttcttcttgttaggcaaggcaaaagcagaagcaaaaaggtctcgttggcgatggcgagctcgggagtttcgtggacgctgccagaccacccgaagctccccaaggggaagccggtggccgtcgtcgtgctggacggatggggtgaggccagccccgaccagtacaactgcatccatgtcgctcagactcctgtcatggactcgctaaagaatggtgctcctgagaaatggacactagtgaaggctcatggaacagctgtgggtctcccatctgatgatgacatgggcaacagtgaagttggccacaatgcacttggtgctggtcggatttttgcccaaggtgctaagcttgtcgatagtgctcttgcctctggaaagatttatagtggagatgggttcaactacatcaaagaatcttttgaaagtggtactcttcaccttattgggttgttgagtgatggtggtgtccactctcgtcttgaccaactgcagttacttctgaaaggtgccagtgagaggggagcaaaaaaaatccgtgtgcacatccttaccgatgggcgtgatgttttggatggcagcagtgttggtttcgtggagaccctagagaatgatctttcggagcttcgagggaagggtattgatgcacaaattgcatctggtggtggaaggatgtatgttaccatggaccgttatgagaatgactgggatgtggttaaacgtggctgggatgcccaggtgcttggagaagcaccctacaaattcaaaagtgcacttgaggctgtgaaaacactgagagcacagcccaatgctaatgatcagtacttgcccccatttgtgattgttgacgacagtggcaaagctgttgggcctgtattagatggtgatgcagttgtcactctcaacttccgagctgatcgcatggttatgcttgccaaagcactagaatacgcagattttgacaaatttgaccgtgttcgtgtccccaaaatccgatatgctgggatgcttcagtatgatggtgagttgaagcttccaagccgttaccttgtttccccaccagagatagatagaacatctggggagtacttggtgaagaatggcgtccgcacctttgcttgcagtgagacagtgaaattcggccatgtcacatttttctggaacggcaaccgttcaggatactttgatgaaactaaggaagagtatgtagaagttcctagtgacagtggtattacattcaatgttgcacccaagatgaaggcgcttgaaattgctgagaaagccagggatgctctcctaagtggaaagtttgaccaggtacgtgtcaacctgccaaatggtgacatggttggtcacactggtgatattgaggccaccgttgttgcttgcaaggcagctgatgaagctgttaagattattttggatgctgtcgagcaagttggtggtatttaccttgttactgccgatcatggcaatgcagaggatatggtgaaaaggaacaaagctggcaagccattgctcgacaagaatggtggtatccagattctaacctcgcatacccttcagccagtcccggttgccattggaggccctggtcttcactccggagtgaaattccggaaggacattgaaacccctgggctcgccaacgtcgcggcgactgtgatgaacctccatggatttgtggcccctgctgactacgagcaaaccctgattgaagtggctgacaactaaagactggccagctatgcccaattttggttctatagtttgagaatggatatggccatgtcatttaataatttatgtttgcaagcacgttgctcaaactcagcaaaacattgagagatgccttttgacttgcatttagatgctctatttataccgatgacagttgtatgctgtgctggcttttggcagtttgatagctatctttatttagctatgtatactgtatctgaggccgcaaactttgtctcagtctaaaattgctcgaggttatatactgtttgtgtgagtcatcactagtgattaccttttgcctcacgccttgacgaacgagttcgttaacctgctgagaatggactcatggtactacggtaatagcttttgtgggaaggtgcagtaatactgagatggcgagctgtcagcttcagataacatctcactatcgagcgagctaactagggcattttgatgatatacatggttcaagacctgttctgaggccttgtttagatacgaaaaggttttggattttactactgtagcactttcgtttgtttgtggcaaatattgtctaatcatggactaactaggattaaaagattcgtctcgtgatttacaggtaaacttgca

SEQ ID NO: 5148 - DNA, 2035 bp, Cenchrus ciliaris
  misc_feature (180)..(180): n is a, c, g, or t
  misc_feature (195)..(195): n is a, c, g, or t
  misc_feature (234)..(234): n is a, c, g, or t
  misc_feature (387)..(387): n is a, c, g, or t
  misc_feature (450)..(450): n is a, c, g, or t
  misc_feature (525)..(525): n is a, c, g, or t
cgcgagtcgcgaagagttcttcttgtcaggcaaggcaaaagcaggagcaaaaaggtttcgttggtgatggcgacctcaggattctcgtggacgctgcctgaccaccctaagctccccaaggggaagccggtggccgtcgtcgtgctggatggatggggcgaggccgacgccgaccagtanaattgcatccatgtngctcagactcctgtcatggattcgctcaagaatggtgcnccagagaagtggaggctagtgaaggctcatggaactgctgtgggtctcccatctgatgatgacatgggcaacagtgaagttggccacaatgctcttggagctggtcgcattttcgcccaaggcgctaagcttgtagaccaagctcttgcctcnggaaaaatttatgacggagatggtttcaactacatcaaagaatcttttgaaaatggtaccctncaccttattgggctgttgagtgatggtggtgtccactcccgtcttgaccaactgcagctacttctaaaaggtgcnagtgagaggggagcaaaaagaattcgtgttcacattcttaccgatgggcgtgatgttttggatggcagcagtgttggttttgtagagaccctagagaatgatctttcagagcttcgagggaagggtatcgatgcacagattgcatctggtggtggacggatgtatgttactatggaccgctatgagaatgactgggatgtggtcaaacgtgggtgggatgcccaggtgctgggagaagcaccctacaaattcaaaagtgcacttgaagcagtgaaaacactgagggctgagcctaaagctaatgatcagtatttgcccccatttgtgatagttgatgaaagcggcaaagctgttgggcctgtattggatggggatgcagttgtcactatcaacttccgtgctgatcgcatggttatgcttgcgaaagcacttgagtatgcagattttgacaaatttgatcgtgtccgggtcccaaaaatccggtatgctgggatgcttcagtacgatggtgagttgaagcttccaagccgttaccttgtttctccaccagagatagagaggacatctggtgagtacttggtgaagaatggaatccgcacctttgcttgcagtgagacagtgaagttcggtcatgtcacatttttctggaatggcaaccgttcaggatactttgatgaaactaaggaagagtatgtagaaattcctagtgacagtggtattacattcaatgttgcaccgaagatgaaggcacttgaaattgcagagaaagctagggatgctctccttagtggaaagtttgaccaggtacgtgtcaacctgccaaatggtgacatggtgggtcacactggtgatattgaggccaccgttgttgcttgcaaggcagctgatgaagctgttaagatgattttggatgccgtggagcaagttggtggtatttaccttgtcaccgctgatcatggaaatgcagaggacatggtgaaaaggaacaaagctggcaagccgctgctcgacaagagtggtggtatccaaattctcacctcgcacacccttcagccggtccctgtcgctattggaggtcctggtctgcaccctggagtgaagttccggactgacatccagacccctgggctcgctaacgttgctgccactgtgatgaaccttcatggcttcgaggcccctgctgactacgagccaaccctcattgaagttgctgacaactaaattactggccaattgatgtccaattttgttgctatagttttgagaacgttttggtgatggccatgtcactgaataatttctgtctgcaagcatgctgctcaaactcgtgaaacaaggagaaacgcattttgacttgcacctaggtgttaactctcctgagctggttttttggcagtttgatagccatttttactcagctatgtatcatatatgtgaggcagcaaactgttcccgtctgtttcagtcagcgttttacttgctttccttgattcatggcacaaaaaaaaaa

SEQ ID NO: 5149 - DNA, 1985 bp, Panicum virgatum
gcccagagttcttcttgttaggcaaggcaaggcgaaagcagaagcaaaaggtttggttggtgatggcgagctcggggttctcgtggacgctgccggaccatccgaagctccccaaggggaagcaggtggccgtcgtcgtgctggacggatggggcgaggccaacgccgacgagtacaattgcatccacgtcgctcagacgcccgtcatggactcgctcaagaatggtgctccagagaaatggagactagtgaaggctcatggaaccgctgtgggtctcccatctgatgatgacatgggcaacagtgaagttggccacaatgctcttggagctggccgcatttttgcccaaggcgctaagctcgtggaccaagctcttgcctccggaaaaatttatgaaggtgatgggttcaactacatcaaagaatcttttgaaaatggtactcttcaccttattgggttgttgagtgatggtggtgtccactcccgtcttgaccaactgcagctacttctgaaaggtgctagtgagaggggagcaaaaaaaatccgtgttcacatccttaccgatgggcgtgatgttttggatggcagcagtgtcggttttgtagagacactagagaatgatctttcacagcttcgagagaagggtattgacgcacagattgcatcaggtggtggaaggatgtatgttaccatggaccgttatgagaatgactgggatgtggttaaacgtgggtgggatgcccaggtgcttggagaagcaccccacaaattcaaaagtgcacttgaagccgtgaaaacactgagagcagagccgaatgctaatgatcagtatttgcccccatttgtgatagttgatgacagtggcaaagctgttgggcctgtactagatggtgatgcagttgtcactatcaacttccgggctgatcgtatggttatgctcgcaaaggcacttgagtatgcagacttcgacaaatttgaccgtgtccgtgtcccaaaaatccggtatgctgggatgcttcaatatgatggtgagttgaagcttcctagccgttatcttgtttctccaccagagatagagagaacatctggtgaatacttggtgaagaatggcatccgcacctttgcttgcagtgagacggtgaagttcggtcatgtcacatttttctggaacggtaaccgttcaggatacttcgatgaaactaaggaagagtatgtagaaattcctagtgacagtggtattacattcaatgttgcacccaagatgaaggcgcttgaaatcgcggagaaagccagggacgctatccttagtggaaagtttgaccaggtacgtgtcaacctgccaaatggtgacatggtgggtcacactggtgatattgaggccacagttgttgcttgcaaggcagctgatgaagctgttaagattattttggatgctgtggagcaagttggtggtatttaccttgtcactgctgaccatggaaatgcagaggacatggtgaaaaggaacaaagctggcaagccactgctcgacaagagtggtggtatccaaattctcacctcgcatacccttcagcccgtcccagtcgccattggaggccctggtctgcaccctggagtgaaattccggaatgacattcagacccctgggcttgccaacgttgctgccactgtgatgaacctccatggcttcgaggcccctgctgactacgagccaaccctcattgaagttgctgacaactaaatactggccaaccttgatgtccaattttgttgttataattttgagaatgcatcggtgatggacatgtctttgaataattcttgtttgcaagcaggctgctcaaactcgcgaaacattgagaggaacacagttcggattgcactcatatgctctattgataacttgaaatcatctcctgagctggccttttttttggcagtttgatagccatttttactctactatacatcatatatgtgaggc

SEQ ID NO: 5150 - DNA, 2063 bp, Panicum virgatum
tgctcgcccagagttgttcttgttaggcaaggcaaaagcaggagcaaaaggtttcgttggtgatggcgagctcagggttctcgtggacgctgccggaccacccgaagctccccaaggggaagccggtggccgtcgtcgtgctggacggatggggcgaggccaacgccgaccagtacaattgcatccatgtcgctcagacgcccgtcatggattccctcaagaatggtgctccagagaggtggagactcgtgaaggctcatggaactgctgtgggtctcccatctgatgatgatatgggcaacagtgaagttggccacaatgctcttggagctggtcgcattttcgcccaaggcgctaagctcgtggaccaagctcttgcctccggaaaaatttatgagggtgatgggttcaactacatcaaagaatcttttgaaaatggtacacttcaccttattgggttgttgagtgatggtggcgtccactcccgtcttgaccaactgcagctacttctgaaaggtgccagtgagaggggagcaaaaagaatccgtgtacacatccttaccgatgggcgtgatgttttggatggcagcagtgttggttttgtagagacactagagaatgatctttcacagcttcgagagaagggtattgatgcacagattgcatctggtggtggaaggatgtatgttaccatggaccgttatgagaatgactgggatgtggttaaacgtgggtgggatgcccaggtgcttggagaagcaccccacaaattcaaaagtgcacttgaagcagtgaaaacactgagagcagagccgaatgctaatgatcagtatttgcctccatttgtgatagttgatgacagtggcaaagctgttggtcctgtattagatggtgatgcggttgtcactatcaacttccgggctgatcgcatggttatgcttgcaaaggcacttgagtacgcagactttgacaaatttgaccgtgtccgtgtcccaaaaatccgctatgctgggatgcttcagtatgatggcgagttgaagcttcctagccgttaccttgtttctccaccagagatagagagaacatctggtgaatacttggtgaagaatggcatctgcacctttgcttgcagtgagacggtgaagttcggtcatgtcacatttttctggaacggtaaccgttcaggatacttcgatgaaaccaaggaagagtatgtagaaattcctagtgacagtggtattacattcaatgttgcacccaagatgaaggcgcttgaaatcgcggagaaagccagggatgctctccttagtggaaagtttgaccaggtacgtgtcaacctgccaaatggtgacatggtgggtcacactggtgatattgaggccacagttgttgcttgcaaggcagctgatgaagccgttaagattattttggatgctgtggagcaagttggcggtatttacgttgtcactgctgatcatggaaatgcagaggacatggtgaaaaggaacaaagctggcaagccggcgcttgacaagagtggtggtatccaaattctcacctcacatacccttcagcctgtcccggttgcaattggaggccctggtctgcaccctggagtgaaattccggaatgacattcagacccctgggctcgccaacgttgctgccactgtgatgaacctccatggctttgaggcccctgctgactacgagacaactctcattgaagttgctgacaactaaatactggccaatcttaatgtccaattttgctgctatagttttgagaatgcatcggtggccatgtcattgaataatttctgtttgcaagcaggctgctcaaactcacggaacattgagaggaacacattttcgcctgcacttagatgctctatgtataacttgagataatgctctatgtataacttgaaattatctcctgtgctggcttttttggcagtttgatagccattttttcgcaactatacatcatatatgtgaggcagcaaaaacgtgcctggctaaaaattgcttgatggtatattctgtttgtgagtcgtgact

SEQ ID NO: 5151 - DNA, 2217 bp, Setaria italica
aattatcattttttattcgcccccccccccccccctccctttcgccgtcgtctctccttattaatatcgccgcggcatcgcatcctcagttccatcgtcccattgctcgccaagggttcttcttgtcaggcaaggcaaaagcaggagcgaaaaggtttcgttggtgatggcgagctcaggaatttcgtggacgctgccggaccacccgaagctccccaaggggaagcctgtagccgtcgtcgtgctggatggatggggcgaggccgacgccgaccagtacaattgcatccatgtcgctcagacgcccgtcatggattcgctcaagaatggtgctccagagaagtggaggctagtgaaggctcatggaaccgctgtgggtctcccatctgatgatgacatgggcaacagtgaagttggccacaatgctcttggagctggtcgcattttcgcccaaggcgctaagcttgtagacaaagctcttgcctctggaaaaatttatgaaggagatggtttcaactacatcaaagaatcttttgaaaatggtacccttcaccttattgggctgttgagtgatggtggtgtccactcccgtcttgaccaactgcagttacttctaaaaggtgccagtgagaggggagcaaaaagaattcgtgttcacattcttaccgatgggcgtgatgttttggatggcagcagtgttggttttgtagagaccctagagaatgatctttcacagcttcgagggaagggtatcgatgcccagattgcatctggtggtggacggatgtatgttaccatggaccgctatgagaatgactggactgtggttaaacgtgggtgggatgcccaggtgcttggagaagcaccctacaaattcaaaagtgcacttgaagcagtgaaaacactgagggcagagcctaaagctaatgatcagtatttgcccccatttgtgatagttgatgacagcggcaaagctgttgggcctgtattggatggtgatgcagttgtcactatcaacttccgtgctgatcgcatggttatgcttgcaaaagcacttgagtatgcagattttgacaaatttgatcgtgtccgtgtcccaaaaatccggtatgctgggatgcttcagtatgatggtgagttgaagcttccaaaccgttaccttgtttctccaccagagatagagaggacatctggtgaatacttggtgaagaatggcatccgcacctttgcttgcagtgagacagtgaagttcggtcatgtcacatttttctggaacggtaaccgttcaggatactttgatgaaactaaggaagagtatgtagaaattcctagtgacagcggtattacattcaatgttgcacccaagatgaaggcgcttgaaatcgcagagaaagccagggatgctctccttagtggaaagtttgaccaggtacgtgtcaacctgccaaatggtgacatggtgggtcacactggtgatattgaggccactgttgttgcttgcaaggcagctgatgaagctgttaagatgattttggatgctgtggagcaagttggtggtatttaccttgtcactgctgatcatggaaatgcagaggacatggtgaaaaggaacaaagctggcaagccgctgctcgacaagagtggtggtatccaaattctcacctcacacacccttcagccggtccctgtcgccattggaggtcctggtctgcaccctggagtgaagttccggactgacatccagacccctgggcttgctaacgttgccgccactgtgatgaacctccatggctttgaggcccctgctgactacgagacaaccctcattgaagttgctgacaactaaatattggtcaatcgtaatgtccaattttgttgctatagttttgagaatggatcggtgatggccatgtcattgaataatttatgtttgcaagcacgctgctcaaactcgagaaacattgagagaaacgcattttgacttgcacctagttgttatctcctaagctggcttttttggcagtttgataaccatttttattctactatgtatcatatatgtgaggcagcaaactgtgccccgctgtctgtgagacgtgactcgttttacttaactttcctttcggcctcatgcaatgatgccctggagcctggaatgtactacagctcacctgttctacaccagcagatttcagttttcaattctaagattcatgg

SEQ ID NO: 5152 - DNA, 2119 bp, Pennisetum glaucum
ccatcacccgcccccattgctcagttcttcttgccaggcaaggcaaaagcaggagcaaaaaaggtttctttggtgatggcgacctcaggattctcgtggacgctgcctgaccaccccaagctccccaaggggaagccggtggccgtcgtcgtgctggatggatggggtgaggccgatgccgaccagtacaattgcatccatgtcgctgagacgcctgtcatggattcgctcaagaatggtgctccagagaagtggaggctggtgaaggctcatggaaccgctgtgggtctcccatctgatgatgacatgggcaacagtgaagttggccacaatgctcttggtgctggtcgtatttttgcccaaggcgctaagcttgtagacaatgctcttgcctctggaaaaatttatgaaggagatggtttcaactacatcaaagaatcttttgaaaatggtacccttcaccttattgggctgttgagtgatggtggtgtccactcccgtcttgaccaactgcagctacttctaaaaggtgccagtgagaggggagcaaaaagaattcgtgttcacattcttactgatgggcgtgatgttttggatggcagtagtgttggttttgtagagaccctagagaatgatctttcacagcttcgagggaagggtatcgatgcgcagattgcatctggtggtggacggatgtatgttaccatggaccgctatgagaatgactgggatgtggtcaaacgtgggtgggatgcccaggtgctgggagaagcaccctacaaattcaaaagtgcacttgaagcagtgaaaacactgagggcagagcctaaagctaatgatcagtatttgcccccatttgtgatagttgatgacagtggcaaagctgttgggcctgtagtggatggtgatgcagttgtcactatcaacttccgtgctgatcgcatggttatgcttgcaaaagcacttgagtacgcagattttgacaaatttgatcgtgttcgtgtcccgaaaatccggtatgctggtatgcttcagtacgatggtgagttgaagcttccgagccgttaccttgtttctccaccagagatagagaggacatctggtgaatacttggtgaagaatggaatccgcacctttgcttgcagtgagacagtgaagttcggccatgtcacatttttctggaacggtaaccgttcaggatactttgatgaaactaaggaagagtatgtagaaattcctagtgacagcggtattacattcaatgttgcacccaaaatgaaggctcttgaaatcgcagagaaagctagggatgctcttcttagtggaaagtttgaccaggtacgtgtcaacctgccaaatggtgacatggtgggtcacactggtgatatcgaggccacagttgttgcttgcaaggcagctgatgaagctgttaagatgattttggatgctgtggagcaagttggcggaatatatcttgtcactgctgatcatggaaatgcagaggacatggtgaaaaggaacaaagctggcaagccgcagctcgacaagagtggtggtatccaaattctcacctcgcacacccttcagccggtccctgtcgccattggaggtcctggtctgcaccctggagtgaagttccggactgacatccagacccctgggcttgctaacgttgccgccaccgtgatgaacctgcatggctttgaggcccctgctgactacgagacaaccctcattgaagttgaggacaagtaattactggccaatcatgatgtccaattttgttgctatagttttgagaacggattggtgatggccatgtcattgaataatttctgtctgcaagcatgctgctcaaactcgtgaaacattgtgagaaaggcatttgacttgcacctaggtgttaactctccagagctgggtttttttttggcagtttgataccgtgtttactcagctatatatcattatatgggaggcagcatactgtgcccgtctgtttgtcagtcgtgagagggttttacttttcctttcattgatgccctatgatgtaactacagctcacctgtttagcagattcagttttcaattctagatccatgagacaggctataaatac

SEQ ID NO: 5153 - DNA, 2134 bp, Cynodon dactylon
cgctcgccgattgttccttcttcttgtttggcaaggcaaaaagctccagaggcaacgaggtttcatcggcgatggcgaccgcgtggacgctccccgaacaccccaagcttcccaaggggaagaccgtggctgtcgtcgtgctggacgggtggggcgaggctaaccccgaccagtacaactgcatccatgtcgcccagacgcccgtcatggactcgctcaagaatggtgctccagagaaatggaggctggtaaaggctcatggaacagctgtgggtctcccatctgatgatgacatgggaaacagtgaagttggccacaatgctcttggtgctggtcgcattttcgctcaaggtgctaagcttgtggatagtgctcttgcctctggaaaaatatacgatggagaggggttcaactacatcaaagaatctttcgaaaatggtactctgcaccttattgggttgctgagtgatggtggtgtccactcccggcttgatcaagtgcagttacttctgaaaggtgccagtgagaggggtgcaaaaagaattcgcgtgcacattcttaccgatgggcgtgatgttttggatggcagcagcgttggttttgtagagacactagagaatgatctttcacagcttagagagaagggtattgatgctcagattgcttccggcggtggaaggatgtatgttaccatggaccgttatgagaatgactggagtgtggttaaacgtgggtgggatgcccaggttcttggagaagctccccacaagttcaaaagtgcagttgaagctgtgaaaactttgagagcagtgcctgatgctaatgatcagtatttacccccttttgtgatagtagatgagagtggcactgcagttggtcctatagttgatggtgatgcagttgtcactttcaatttccgggctgatcgcatggttatgctcgcgaaagcactagagtatgcagattttgacaaatttgaccgtgtccgtgttccgaaaatccgttatgctggaatgcttcaatatgatggcgagttgttgcttcctaaacgctaccttgtttctccaccagagattgagaggacatctggtgaatacttggtgaagaatggcgtcagcacctttgcttgcagtgaaacagtgaagttcggtcatgtcacgtttttctggaacggtaaccgttcaggatactttgatgaaagtaaggaggagtatgttgaagttcctagtgacagtggtatcactttcaatgttaaaccaaaaatgaaggcagttgaaattgcagagaaggccagagatgctatccttagcggaaagtttgaccaggtacgtgtcaacctgccaaatggtgacatggtgggtcacactggtgacattgaggccactgttgttgcttgcaaagctgctgatgaagccgttaagattattttggatgctgtggaacaagttggtggcatttatcttgttactgctgatcatggaaatgcggaggatatggtgaaaaggaacaaagctggcaaaccacttctggacaagagtggcgctatccaaattctcacctcgcatactcttcagccggtaccggttgccattggaggccctggtcttcatcctggagtgaaattccggtctgacattcagatccctgggcttgccaacgttgctgccaccgtgatgaacctccatggcttcgaggccccagctgactacgagccaaccctcatcgaagtggctgacaactaagtagagtcaagtcataattgcgatatccaattttgttgctatagttttgagaacggattgatgattggctgtcgtttaataatctgttaccaagcaagctgctcaaactcacgaaacattgagaggagtgcacttacgctatggtttttttaatagatcgatgatcgtctggattgcatgtgatatatgagttgtgacagtcagtaggggttctttctcatataaatctatatgtgagatgccgaaattgtgcaccgtggtttgtaggtatgagaatcaggctcagggttttcactcagccgtggggcatgaaattggcgttacgctgcagttgacaagctagccttgtgcatccaaaaattaatgaggtggaaatgaagaaatcattgcca

SEQ ID NO: 5154 - DNA, 3040 bp, Oryza sativa
gccgcccacttcgtcatcctcctcgcgtactccgctctcgaaaaagaaaagaaaggctttcgtctcggtgggcaaaagcgcgagggcaaagcgaaggtatagcatctagtaggcgatggcgagctccggtttctcatggacgctgcccgaccaccccaagctccccaaggggaagacggtagccctcgtcgtgcttgacggatggggcgaggccaacgccgacaagtacaactgcatccatgtcgcccagacgcccgtcatggattcgctcaagaatggtgctcccgagaggtggagattagtgaaggctcatggaacagctgttggtcttcctagcgaagatgacatgggcaacagcgaagtgggtcacaatgctcttggtgctggtcgcatttttgctcagggtgctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacggattgcatctggtggtggaaggatgtatgttaccatggaccgctatgagaatgactgggatgtggtcaaacgtgggtgggatgcccaggtgcttggcgaagcaccctacaaattccaaaatgcagtcgaagcagtgaaaactctaagagcagagaccaaggctagtgatcagtatttgcctccatttgtgatcgtggatgagagtggcaaatctgttgggcctgttgtagatggtgatgcagttgtgactttcaatttccgagcggatcgtatggttatgcttgccaaagcactagagtatgcagactttgacaaatttgatcgtgttcgtgtaccaaaaatccggtacgctgggatgcttcagtatgatggtgagttgaagcttccgagccattaccttgtctccccaccagagatagagagaacatctggtgaatacttggtaaagaatggcgtccgcaccttcgcttgcagtgagacagtgaagtttggccatgtcacatttttctggaacggaaaccgatctggatactttgatgaaactaaggaagagtacgttgaaattcctagtgatattggaatcacattcaatgttaaacccaacatgaaggcacttgaaattgcagagaaagccagggatgccattcttagtggaaagtttgatcaggtacgtgtcaacctgccgaatggtgacatggttggtcacactggtgatattgaagccacggtagttgcttgcaaggcagctgacgaagccgttaagattattttggacgcgattgaacaagtcggtggtatttatcttgtcaccgctgatcatggaaatgctgaggatatggtgaaaagaaacaaatctggccagccacttctcgacaagaacggtggtatccagattcttacctcacatactcttcagccggtcccggttgctattggaggtcccggtcttcaccctggtgtgaaattccggtctgacattcagacccctgggctcgccaatgttgctgcaaccgtaatgaacttccatggtttcgaggctcctgctgactacgaaccaaccctcattgaagttgtggacaactaaaatagtaaaatcgcggtagcgaagttttgttcctatagtgttgagatgatcaagagtgatcatatcatttaataattgaataatttatgtttgcccgctcgctgctcaaactctactatggagagaaaagagtgtatttgacttgcagttctgctcttatctgtaactagacgttgtcgcgcaggctggcctgacgttttttcatccgctatatgcgataatgcgaggcgtcaaacatgctcttgtccagtatttaaagtttggatcgtgttaaaatcgcgtaatgttatgtgcaatgtgcttggttgcctcgctttgctccaagaaagcagcaaaaccggagctgcatcatttgatgacctttcgcttgtttatgcatcattttgacgcatcgcccatctgtacgcttcgccatcagaattcagaacacaaaacgacatctctgatcccgaagttgtacgcttcgccatcagaattcagaacagacaatgaatctcagattggaatcagatatatatagctcggggggtaagatggcacgctaacagtgacaaaccttccaaaacgatacatatggtaaacagtaaacacccttggagctacaccgatcaggcacgctagtatctccccgatgatgaactacggttgtagctagtatctccccgattatgccacgctaggtgaggattgctgttgcccgaaggaaagcttgactgcctgagcaactatcaatttgaccacacatggacaaggcctagtcggttgccggtgtatatctcctcacgctcttcatcgtagtacagagctgtgatgtcccccagtgcctcggaaggtgtactttggaacttagacaccctttgcttgttaaggttccctgcctttattttggccaagcattttccggttaagatctcactgatatttatggagcaagctgcaaaagaaccaaagtgaagatcatgttatgtggggacaatagatgcatcagcctcaattacctactgcagtaggtctgaaaaggacaaatttcttatcaactgcagcaagtctgaaaagcatacattttacgagcataaaaaataattaaaacgatacagtatataataagtgcatcagtatgtcaaccttttgaggcctcttatattttattgatattcaaagctgatatactcactccgtactcataaaggaagtcgtttaggacaaatttttaagtcaaaccttgggaatataaatcataaataa

SEQ ID NO: 5155 - DNA, 2069 bp, Oryza sativa
gcgccgcccacttcgtcatcctcctcgcgtactccgctctcgaaaaagaaaagaaaggctttcgtctcggtgggcaaaagcgcgagggcaaagcgaaggtatagcatctagtaggcgatggcgagctccggtttctcatggacgctgcccgaccaccccaagctccccaaggggaagacggtagccctcgtcgtgcttgacggatggggcgaggccaacgccgacaagtacaactgcatccatgtcgcccagacgcccgtcatggattcgctcaagaatggtgctcccgagaggtggagattagtgaaggctcatggaacagctgttggtcttcctagcgaagatgacatgggcaacagcgaagtgggtcacaatgctcttggtgctggtcgcatttttgctcagggtgctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacggattgcatctggtggtggaaggatgtatgttaccatggaccgctatgagaatgactgggatgtggtcaaacgtgggtgggatgcccaggtgcttggcgaagcaccctacaaattccaaaatgcagtcgaagcagtgaaaactctaagagcagagaccaaggctagtgatcagtatttgcctccatttgtgatcgtggatgagagtggcaaatctgttgggcctgttgtagatggtgatgcagttgtgactttcaatttccgagcggatcgtatggttatgcttgccaaagcactagagtatgcagactttgacaaatttgatcgtgttcgtgtaccaaaaatccggtacgctgggatgcttcagtatgatggtgagttgaagcttccgagccattaccttgtctccccaccagagatagagagaacatctggtgaatacttggtaaagaatggcgtccgcaccttcgcttgcagtgagacagtgaagtttggccatgtcacatttttctggaacggaaaccgatctggatactttgatgaaactaaggaagagtacgttgaaattcctagtgatattggaatcacattcaatgttaaacccaacatgaaggcacttgaaattgcagagaaagccagggatgccattcttagtggaaagtttgatcaggtacgtgtcaacctgccgaatggtgacatggttggtcacactggtgatattgaagccacggtagttgcttgcaaggcagctgacgaagccgttaagattattttggacgcgattgaacaagtcggtggtatttatcttgtcaccgctgatcatggaaatgctgaggatatggtgaaaagaaacaaatctggccagccacttctcgacaagaacggtggtatccagattcttacctcacatactcttcagccggtcccggttgctattggaggtcccggtcttcaccctggtgtgaaattccggtctgacattcagacccctgggctcgccaatgttgctgcaaccgtaatgaacttccatggtttcgaggctcctgctgactacgaaccaaccctcattgaagttgtggacaactaaaatagtaaaatcgcggtagcgaagttttgttcctatagtgttgagatgatcaagagtgatcatatcatttaataattgaataatttatgtttgcccgctcgctgctcaaactctactatggagagaaaagagtgtatttgacttgcagttctgctcttatctgtaactagacgttgtcgcgcaggctggcctgacgttttttcatccgctatatgcgataatgcgaggcgtcaaacatgctcttgtccagtatttaaagtttggatcgtgtt

SEQ ID NO: 5156 - DNA, 2183 bp, Oryza sativa
gttcaaagctgttttctcattctctagtcaatttcgtacggagcagcagttaaacatggtaattaagggctttttttttctcggaagggcgtatttgccatcgagctaatcttgtgggctaatctgcaaaaataccagaagagaatcgcactcgctctatttatatcgaccttcctcctctccaagccaagcggcttcatatcatccggcatccagagaaaaatatagcaacgaaaaaaaaggagaaaaaaaaaacagtctctcttccggtttagttggtgatgggaagctcagatttctcgtggacattgcctgatcacccaaagctccctaaggggaagccggtggccgtggttgtactggatggatggggtgaggctgatgcggaccagtataactgcatccatgttgctgagacaccaacaatggattcgctcaagaagggtgctccagagaagtggaagcttgtaaaggctcatggaacagctgttggtctcccttctgatgatgacatgggtaacagtgaggttgggcataacgcacttggtgctggtcggatttttgctcaaggggctaaacttgtggatactgctttggcctctggaaaaatttttgaaggagaagggtttaagtacattaaggagagttttgaccaaggcactcttcatcttattgggttgttgagcgacggaggtgtccactcacggcttgaccagttgcagttgctcctgaatggtgcaagtgcgaatggagcgaaaaaaatccgtgttcacattcttactgatggacgtgatgttttggatggcacaagcgttggttttgttgaaacgctagagaatgatctttctcaactgcgtgccaagggcattgatgcgtgcattgcatcaggtggtggaaggatgtatgttaccatggaccgatatgagaatgactgggatgttgttaaacgtggatgggatgctcaggtgcttggagaagcacctcacaagttccaaaacgctgttgaagctgtgaaaacactccggtcagagaccaaggctaatgatcagtatcttcccccatttgtgattgttgacgatagtgacaaggctgttgggcctatagtagatggtgatgcagttgtgaccttcaatttccgtgctgatcgcatggttatgattgctaaggctttagagtatgaagattttgataaatttgatcgtgttcgtgtcccaaagatccgatatgctggtatgcttcagtatgatggtgagctgaagcttccaagccactaccttgtttcaccaccagagattgagaggacatccggtgaatacttggtgaaaaatggcatccgcacctttgcttgcagtgaaactgtgaagttcggccatgtcacatttttctggaatggaaaccgctctggatacttcgatgaaacaaaggaagagtatgtggaaatccctagtgacagtggtatcacattcaatgttaaacccaagatgaaggcccttgagattgctgagaaagctagagatgctatccttagtggcaagtttgaccaggtccgcgttaacctcccaaatggtgatatggtgggtcacactggtgacattgaggccacagtggttgcttgcaaagctgctgatgaggctgtcaagatgattctggatgccattgagcaagtgggtggcatctatttggtcaccgccgatcatggcaacgccgaggatatggtgaagaggaacaaatccggccagccacagcttgacaagaaaggcgaaatccagattcttacctcacacactcttcagccagtgccagttgccattggaggccctggcctacattctggggtgagattccgcaacgacgtgcagacccctggcctcgccaacgtcgccgccaccgtgatgaacctccacgggtttgaggcccctgctgactacgagccaaccctaattgaagtagttgacaaataaattaaatgtaaacagcggattttgtcgctgtgattttgctatgggtcagagaaatggtctctgcgatgttgaatactccgtttttatgagcagtctgctggaacctacgagggtttttataaaaacgaaactgatttatgatttgcatcgtgatgttgtgaattatcgcttagctgtgactctagttatgcggtcgttttaagctgtctttttctttcttta

SEQ ID NO: 5157 - DNA, 1919 bp, Oryza sativa
aagcggcttcatatcatccggcatccagagaaaaatatagcaacgaaaaaaaaggagaaaaaaaaaacagtctctcttccggtttagttggtgatgggaagctcagatttctcgtggacattgcctgatcacccaaagctccctaaggggaagccggtggccgtggttgtactggatggatggggtgaggctgatgcggaccagtataactgcatccatgttgctgagacaccaacaatggattcgctcaagaagggtgctccagagaagtggaagcttgtaaaggctcatggaacagctgttggtctcccttctgatgatgacatgggtaacagtgaggttgggcataacgcacttggtgctggtcggatttttgctcaaggggctaaacttgtggatactgctttggcctctggaaaaatttttgaaggagaagggtttaagtacattaaggagagttttgaccaaggcactcttcatcttattgggttgttgagcgacggaggtgtccactcacggcttgaccagttgcagttgctcctgaatggtgcaagtgcgaatggagcgaaaaaaatccgtgttcacattcttactgatggacgtgatgttttggatggcacaagcgttggttttgttgaaacgctagagaatgatctttctcaactgcgtgccaagggcattgatgcgtgcattgcatcaggtggtggaaggatgtatgttaccatggaccgatatgagaatgactgggatgttgttaaacgtggatgggatgctcaggtgcttggagaagcacctcacaagttccaaaacgctgttgaagctgtgaaaacactccggtcagagaccaaggctaatgatcagtatcttcccccatttgtgattgttgacgatagtgacaaggctgttgggcctatagtagatggtgatgcagttgtgaccttcaatttccgtgctgatcgcatggttatgattgctaaggctttagagtatgaagattttgataaatttgatcgtgttcgtgtcccaaagatccgatatgctggtatgcttcagtatgatggtgagctgaagcttccaagccactaccttgtttcaccaccagagattgagaggacatccggtgaatacttggtgaaaaatggcatccgcacctttgcttgcagtgaaactgtgaagttcggccatgtcacatttttctggaatggaaaccgctctggatacttcgatgaaacaaaggaagagtatgtggaaatccctagtgacagtggtatcacattcaatgttaaacccaagatgaaggcccttgagattgctgagaaagctagagatgctatccttagtggcaagtttgaccaggtccgcgttaacctcccaaatggtgatatggtgggtcacactggtgacattgaggccacagtggttgcttgcaaagctgctgatgaggctgtcaagatgattctggatgccattgagcaagtgggtggcatctatttggtcaccgccgatcatggcaacgccgaggatatggtgaagaggaacaaatccggccagccacagcttgacaagaaaggcgaaatccagattcttacctcacacactcttcagccagtgccagttgccattggaggccctggcctacattctggggtgagattccgcaacgacgtgcagacccctggcctcgccaacgtcgccgccaccgtgatgaacctccacgggtttgaggcccctgctgactacgagccaaccctaattgaagtagttgacaaataaattaaatgtaaacagcggattttgtcgctgtgattttgctatgggtcagagaaatggtctctgcgatgttgaatactccgtttttatgagcagtctgctggaacctacgagggtttttataaaaacgaaactgatttatgatttgc

SEQ ID NO: 5158 - DNA, 1905 bp, Brachypodium distachyon
atattatcctccgccctcgaaaaagttcttcttgctccgcaaaccacaggaagaaaagcgaaagcaaaggcgatggcgagctcaggttcctcttggacgctgcctgaccaccccaagctcccaaagggaaagacggtggctgtcatcgtgctggacggatggggcgaggccagccctgacaagtacaactgcatccatgtcgcccagacgcccgtcatggattcgctcaagaatggtgctccagagaagtggacactagtgaaggctcatggaacagctgttggtctacctagtgatgacgacatgggtaacagtgaagttggccacaatgctcttggtgctggtcggatttttgcccaaggcgcaaagcttgttgatgctgctcttgcttctggcaaaatttatgaaggagcggggttcaattacataaaagaatcttttgataaaggtaccctgcaccttattggcttgttgagtgatggtggcgtccactcccggctagatcaagtgcagttacttctaaaaggtgctagtgagaggggagcaaaaagaattcgccttcacattcttactgatgggcgtgatgttttggatggcagtagtgttggttttgtagagacaatagagaatgatctttctcagcttcgtgagaagggtgttgatgcaaggattgcatccggtggaggaaggatgaacgttaccatggaccgttatgagaatgactggggtgtggtcaaacgtgggtgggatgcccaggtgcttggagaagcgccatacaaattccagagtgcacttgaagctgtgaaaacactaagagcagagcccaaggccaatgatcagtatttgcccccgtttgtgatagttgatgagagtggcaaatcagtaggccctatagtagatggtgatgcagttgtgactttcaattttagagctgatcgcatggttatgcttgctaaagcactggagtttgctgattttgataaatttgatcgtgttcgtgtaccaaaaattaagtatgctgggatgcttcaatatgatggcgagttgaagcttccaagcaagtaccttgttgaccctcctttgatagagaggacatctggtgaatacttggtaaagaatggtgtccgcacctttgcttgcagtgagacggtgaagtttggccatgtcacatttttctggaatggaaaccgttcaggatacttcgatgaaaccaaggaagagtatgtagagattccaagtgatagtggtatcacattcaatgagcaacccaaaatgaaggcactcgaaattgccgagaaaacccgggatgctatcctcagtggaaagtttgaccaggtacgtattaacctaccaaatggtgatatggtgggtcacactggtgatattgaggccacagtggttgcttgcaaggctgctgatgaagccgtgaagatagttttagatgcggtggagcaagttggtggtatttatcttgtcactgctgatcatggtaacgctgaggatatggtgaaaagaaacaaagctggtcagccgatgctcgacaagagtggcagcatccaaattcttacctcacatacgcttcagccagtcccggttgctattggaggccctggtctccacccaggagtgaagttccggtccgatatccagacacctgggctcgccaatgttgccgccacggtaatgaacctacatggttttgaggctcctgctgattttgagacgacactcattgaagttgttgacaagtaaaataccagagtctgaactcaaaattgcggtagccaattttgtgttgtagttttgcgatggatcatgggtgattgcatcgttgaataatttgagatatgcccgcacctttctcaaactcatgaacatcaagaaaaggggattttacttgcagtt

SEQ ID NO: 5159 - DNA, 2782 bp, Brachypodium distachyon
atcctcagccgtcggatggctcgaatcggtacccccacagcgttgatcgaaccgtccaatgattaggccagcagcaccctaaattattcgcacccttcgtcgccgttgctccccccttattaataccccgcccgcccgcctgccctctcatattatcctccgccctcgaaaaagttcttcttgctccgcaaaccacaggaagaaaagcgaaagcaaaggcgatggcgagctcaggttcctcttggacgctgcctgaccaccccaagctcccaaagggaaagacggtggctgtcatcgtgctggacggatggggcgaggccagccctgacaagtacaactgcatccatgtcgcccagacgcccgtcatggattcgctcaagaatggtgctccagagaagtggacactagtgaaggctcatggaacagctgttggtctacctagtgatgacgacatgggtaacagtgaagttggccacaatgctcttggtgctggtcggatttttgcccaaggcgcaaagcttgttgatgctgctcttgcttctggcaaaatttatgaaggagcggggttcaattacataaaagaatcttttgataaaggtaccctgcaccttattggcttgttgagtgatggtggcgtccactcccggctagatcaagtgcagttacttctaaaaggtgctagtgagaggggagcaaaaagaattcgccttcacattcttactgatgggcgtgatgttttggatggcagtagtgttggttttgtagagacaatagagaatgatctttctcagcttcgtgagaagggtgttgatgcaaggattgcatccggtggaggaaggatgaacgttaccatggaccgttatgagaatgactggggtgtggtcaaacgtgggtgggatgcccaggtgcttggagaagcgccatacaaattccagagtgcacttgaagctgtgaaaacactaagagcagagcccaaggccaatgatcagtatttgcccccgtttgtgatagttgatgagagtggcaaatcagtaggccctatagtagatggtgatgcagttgtgactttcaattttagagctgatcgcatggttatgcttgctaaagcactggagtttgctgattttgataaatttgatcgtgttcgtgtaccaaaaattaagtatgctgggatgcttcaatatgatggcgagttgaagcttccaagcaagtaccttgttgaccctcctttgatagagaggacatctggtgaatacttggtaaagaatggtgtccgcacctttgcttgcagtgagacggtgaagtttggccatgtcacatttttctggaatggaaaccgttcaggatacttcgatgaaaccaaggaagagtatgtagagattccaagtgatagtggtatcacattcaatgagcaacccaaaatgaaggcactcgaaattgccgagaaaacccgggatgctatcctcagtggaaagtttgaccaggtacgtattaacctaccaaatggtgatatggtgggtcacactggtgatattgaggccacagtggttgcttgcaaggctgctgatgaagccgtgaagatagttttagatgcggtggagcaagttggtggtatttatcttgtcactgctgatcatggtaacgctgaggatatggtgaaaagaaacaaagctggtcagccgatgctcgacaagagtggcagcatccaaattcttacctcacatacgcttcagccagtcccggttgctattggaggccctggtctccacccaggagtgaagttccggtccgatatccagacacctgggctcgccaatgttgccgccacggtaatgaacctacatggttttgaggctcctgctgattttgagacgacactcattgaagttgttgacaagtaaaataccagagtctgaactcaaaattgcggtagccaattttgtgttgtagttttgcgatggatcatgggtgattgcatcgttgaataatttgagatatgcccgcacctttctcaaactcatgaacatcaagaaaaggggattttacttgcagttagctctatttgtaacttggtcttgccgcatgggctgccttaacatgacagatagccatttttgctcggctatatgtgaagggtcgaacttttttttagtgaggcgtgaaactgcatgccacacggcaggcagctgttgcgaagttggaagttgcttggcgtagtatgcatttttcattttctaactttctgcaaggctcgttttgttcacgtgttctaagctggtcttgtgaggactggagttccggtgcccgaacgaattatttcccaggggatccacaacgttcgaaagccaaaattatcaaatcaccgacattgtcatttttgctccaacgcacccgatgtcagttgtctgcttacatagcatcgtccagtgttaagagtagggataaaaatccttgcatgaacgacttccacattcccaccacgaaggcaaggatgaaagttgcttacatagtaatggtgctaaatgttgatgacaatatctgttggtgcctgatgtaacctgcttacctgagcagctgttaatttgaccacacatgcacaaggccatgttggttgccagcgtgtagatctcttcgtgctcttcatcatagtacaaagatgtgatgtcccttagggcctccgcaggagtatttaggaacttcaatgacttcgtttgtttactgaggtttcttgcctttattttgacatttatagaacaagctgcatacaaatcaaagtggaaat

SEQ ID NO: 5160 - DNA, 2053 bp, Hordeum vulgare
gcctcgccttcgcctattatcctccgccactccgctctgccaaaagttcttcttgttccgcaaaccacacgaaggaaaaaaaagcaaaggcgatggcgacctccgactggacgctccccgaccaccccacgctccccaaggggaagacggtggccgtcgtcgtgctcgacggatggggcgaggccagccctgaccagtacaactgcatccatgtcgcacagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatctttcgataagggtactctgcaccttattggtttgttgagtgatggaggcgtccactcacggctagaccaagtgcagttgattgtgaaaggtgccagtgagaggggagcaaaaagaatccgccttcatattcttactgatggacgtgatgttttggatggcagcagtgttggtttcgtagagacaattgagaaagatcttgctcagcttcgtgagcagggtgttgatgcacggattgcatctggtggtggaaggatgtatgttaccatggaccgctatgagaatgactggagtgtggtcaagcgtggttgggatgcccagatacttggagaagcaccatacaaattccaaaatgcacttgaagctgtgaagactctaagagcagagcccaaggccaatgatcagtatttgcccccctttgtgattgttgatgagagtggcaaatcggttggtcctatagtggacggtgatgcagttgtgactttcaatttcagagctgatcgaatggttatgcttgcgaaagcacttgagtttcctgatttcgataaatttgaccgtgttcgtgtaccaaaaattaagtacgctgggatgcttcaatatgatggtgagttgaagcttccaagcaagtaccttgtttccccacctttgattgagaggacatccggtgaatacttggtgaagaatggtgtccgcaccttcgcttgcagtgagacagttaagtttggccatgtcacatttttctggaatggaaaccgttcgggatactttgacgagaccaaggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaatggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcacacacttcagcctgtccctgttgctatcggaggccctggtctccacccaggagtgagattccgctctgacatccagacacccgggctcgccaacgttgccgccacggtgatgaacctccatggcttccaggctcctgccgattacgagacgaccctcatcgaagtcgtcgacaagtaaaaaaaccactgcgctctctgaagccaaaattgcggtagccaattttgtcgctatagttttggggtgggtcaaggaatgatcgcatcattgaataatttgagatttgccagcacgcttgctcaaaactcatgtgtaacattgagaaaggtggattttacttgcagttagctctattttgtaacttgggttgccacgcgggttggcttaacagacagatagcgttttttgctaatctatatgcatgggatttcatcttgagttaaatgcccgagaatcgcgttcttatc

SEQ ID NO: 5161 - DNA, 2177 bp, Elaeis guineensis
ttttttttcacgataaatacatcgaaggctctgtcggagatcccctcatttcgatctaccctgttctcgttaacatctgatagatactcttcgagaagtctagcaagtatttggagagatggggagctctgagttttcgtggaaattggcggatcacccgaagcttccaaagaggaagacggtggctgttgtagttttggatggatggggcgaagccaatcccgataagtacaactgcattcacgtcgcccagactcctaccatggattcactcaagcagggtgctccagaaagatggaggctggtacgggctcatggcacagcggtgggacttcctactgaggatgacatgggtaacagtgaagtaggtcacaatgccctaggtgcaggacgcatttatgctcaaggtgctaagctggtggatcttgcacttgcctctggaaagatatatgaaggagaaggttttaagtacatcaaagaatgttttgatcagggcactttgcatctcatcgggttattgagtgatggaggtgtccactctcggcttgatcagttacagttgctactgaaaggtgctagcgagaatggtgcaaaaagaatccgtgtgcattttcttactgatggccgtgatgttttggatgggtcaagtattggttttgtagaaacacttgagaatgatcttttgaagctacgagaaaaaggtgttgatgcacagattgcatctggtgggggtcggatgtatgttaccatggatcgctacgagaatgattggggcgttgttaaacgtggctgggatgctcaggtccttggtgaagcaccacacaagtttcgaagtgccgttgaagctgtgaagaagctcagggaagatcccaaagccaatgaccagtacctgcccccttttgttatagttgatgagagtggcaaggcagttgggccaatagtggatagtgatgcagttgtaacattcaacttccgagcagatcgtatggttatgcttgctaaagcactagaatatgaagattttgacaaatttgaccgtgttcgctttccaaagattcgatatgctggaatgcttcaatatgatggtgaattgaagcttccaagccattatcttgtttctcctccagagatagagaggacatcaggagagtacttagtgcacaatggtattcgtacttttgcttgcagtgagacagtcaagtttggtcatgtcacctttttctggaatggcaatcgatctggatattttgactcatcaatggaagaatatgttgaaattccaagtgatgcaggaattacatttaatgtccaaccaaagatgaaggccttggaaattgctgaaaaggcaagggatgctatcctcagtggcaagtttgaccaggttcgtgtcaaccttcctaatggagatatggtgggacatactggtgatatagaggccactattgtggcatgcaaggctgctgatgatgctgtcaagatcattctggacgcaatagagcaagtgggcggaatatatgttgtcacggcagatcatggaaatgctgaggacatggtaaagaggaacaaatccggccaacccctcctcgataaaaagggggacattcaaattcttacttcccatactcttcaaccagttcccattgccattggaggccctggccttgcacctggtgtcagattccggaatgatgtacctgatggtggccttgctaatgttgctgccactgttatgaatctccatggttttgaggctcctaatgactacgagccaaccctcattgaagtagttgacaattgaatgcaatctactgataacttagcattatattggtccatttggagtctgactcaaatcttgctgccagtgcttgtaggtgtagtagggaggtcaaaataaattctttttgtgaaactttaatttttgcgagcagcagaaaaggttctgatacacctattgtgtggttgttctcccatgatatgaccctctttaggcatatcttgaatgtttttttgccttagaaaattatttgacttgaaataggcaatccattttctgttatcatatgattgtcttttcatgctattctatatctgcatgcttaatcctgtccaatcttgaatcttaatgtggtgttctcaaacagcagttgttttatgtataatccatgagaattcat

SEQ ID NO: 5162 - DNA, 2363 bp, Hordeum vulgare
cgccactccgctctgccaaaagttcttcttgttccgcaaaccacacgaaggaaaaaaaagcaaaggcgatggcgacctccgactggacgctccccgaccaccccacgctccccaaggggaagacggtggccgtcgtcgtgctcgacggatggggcgaggccagccctgaccagtacaactgcatccatgtcgcacagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatctttcgataagggtactctgcaccttattggtttgttgagtgatggaggcgtccactcacggctagaccaagtgcagttgattgtgaaaggtgccagtgagaggggagcaaaaagaatccgccttcatattcttactgatggacgtgatgttttggatggcagcagtgttggtttcgtagagacaattgagaaagatcttgctcagcttcgtgagcagggtgttgatgcacggattgcatctggtggtggaaggatgtatgttaccatggaccgctatgagaatgactggagtgtggtcaagcgtggttgggatgcccagatacttggagaagcaccatacaaattccaaaatgcacttgaagctgtgaagactctaagagcagagcccaaggccaatgatcagtatttgcccccctttgtgattgttgatgagagtggcaaatcggttggtcctatagtggacggtgatgcagttgtgactttcaatttcagagctgatcgaatggttatgcttgcgaaagcacttgagtttcctgatttcgataaatttgaccgtgttcgtgtaccaaaaattaagtacgctgggatgcttcaatatgatggtgagttgaagcttccaagcaagtaccttgtttccccacctttgattgagaggacatccggtgaatacttggtgaagaatggtgtccgcaccttcgcttgcagtgagacagttaagtttggccatgtcacatttttctggaatggaaaccgttcgggatactttgacgagaccaaggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaatggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcacacacttcagcctgtccctgttgctatcggaggccctggtctccacccaggagtgagattccgctctgacatccagacacccgggctcgccaacgttgccgccacggtgatgaacctccatggcttccaggctcctgccgattacgagacgaccctcatcgaagtcgtcgacaagtaaaaaaaccactgcgctctctgaagccaaaattgcggtagccaattttgtcgctatagttttggggtgggtcaaggaatgatcgcatcattgaataatttgagatttgccagcacgcttgctcaaaactcatgtgtaacattgagaaaggtggattttacttgcagttagctctattttgtaacttgggttgccacgcgggttggcttaacagacagatagcgttttttgctaatctatatgcatgggatttcatcttggagtttacgcgtccgcgaccctgtgttctccgcttggttctctcagctgcagctctgtgggtgggggcccgggtcccctattcgtccttatgggggctcggtcaccacttcacgtggcggcgggtgtcagcgcgcggggggggtaaaaccctgggttgagcccaatttaacccccttgcaacacttgcagcgtgagaagtcagggtcttgcgcaagggccccgcctgatcccctttctgcgcgctcttcatcgcatagagcagttggaccttctgatgtgtctacttgtccacgacgtggcggacgctgtggccttgatccgccgcgtccgtttagagcgcagagggggagagtgggtataacg

SEQ ID NO: 5163 - DNA, 2050 bp, Secale cereale
tcctccgccactccgctctccgaaaagttcttcttgttccgcaaaccacacgaagaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggcgcgaagcttgttgatgctgctcttgcttctgggaagatttggggaagacgaggggttcaattacatcaaagaatcttttgacaagggtactctgcaccttattggtttgttgagtgatggaggcgtccactccaggctagaccaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgggttcgtgtaccaaaaattaagtacgctggaatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgatcaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactcttgtaacattgagaaaagtggatttgacttgcagctagctctattttgtaactttttttttgaaacggactattttgtaacttttagtgttgcaacacgggttgtcaacagaccgatatgcacatctggataatttgctcaatcagtggtatcagagttcacagagttcggttcgtag

SEQ ID NO: 5164 - DNA, 1891 bp, Secale cereale
caaaccacacgaagaaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggtgcgaagcttgttgatgccgctcttgcttccgggaagatttgggaagacgaggggttcaattacatcaaagaatcttttgacaagggtactctgcaccttattggtctgttgagtgatggaggcgtccactcccggctagatcaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgggttcgtgtaccaaaaattaagtacgctggaatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgatcaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactgttgtaacattgagaaaagtggatttgacttgcagctagctctattttgtaacttttttt

SEQ ID NO: 5165 - DNA, 2255 bp, Secale cereale
gccactccgctctccgaaaagttcttcttgttccgcaaaccacacgaagaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggcgcgaagcttgttgatgctgctcttgcttctgggaagatttgggaagacgaggggttcaattacatcaaagaatcttttgacaagggtactctgcaccttattggtttgttgagtgatggaggcgtccactccaggctagaccaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgggttcgtgtaccaaaaattaagtacgctggaatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgatcaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactcttgtaacattgagaaaagtggatttgacttgcagctagcttctattttgttaacttttttttttggaaacggactattttgtaacttttagtgttgcaacacgggttgtcaacagaccgatatgcacatctggataatttgctcaatcagtaggtaaaaaaaaaaaaaaaaaaaaaaagaaaaaaaaaaaaaaaaaaaaaaaaaaaaaaaagaaaaaaaaaaaagaaaaaaaaataaaaaaaaaaaaaagaaaaaaagaaaaagaaaagaaacaagaataacaagataactataacatactatacacgtactatactactagtactacgtgtactctacgactacataccgagtacgatacgagacgtagatcggaggagcttacgggcc

SEQ ID NO: 5166 - DNA, 2066 bp, Secale cereale
tccctcccccttattaataccgcggccgccccgccttcgcctattatcctccgccactccgctctccgaaaaagttcttcttgttccgcaaaccacacgaagaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgttgagacaattgagaaagatcttgctcagcttcgcgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgggttcgtgtaccaaaaattaagtacgctggaatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgatgagaccagggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacacttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactcttgtaacattgagaaaagtggatttgacttgcagctagctctattttgtatttttttttgaaacggactatgttgtaactttagtgttgccacacgggttgtcaacagaccgatatgcacatctggataatttgctcaatcagtgtta

SEQ ID NO: 5167 - DNA, 2042 bp, Triticum aestivum
agaaccgatcctccgccactccgctctcccaaaagttcttcttgttccgcaaaccacacgaagaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttaccatggaccgctacgagaatgactggagtgtggtcaagcgtgggtgggatgcccaggtgcttggagaagcaccacacaaattccaaaatgcacttgaagctgtgaagactctaagagcagagcccaaggccaatgatcagtatttgcccccatttgtgatagttgatgagagtggcaaatcggttggtcctatagtagacggtgatgcagtcgtgactttcaatttcagagctgatcgcatggttatgcttgcgaaagcactcgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgagacagtgaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagctacagttgttgcttgcaaggctgccgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccacccaggagtgagattccgctccgacatccagacacctgggctcgccaacgttgccgccaccgtgatgaacctccacggcttccaggctcctgctgattatgagacgaccctcatcgaagtcgtcgacaagtaaaaaaaacaatgcgctctttgaagccaaaattgctgtagccaattttgtcgctatagttttggggttggtcaaggaatgatcgcatcattgaataatttgagatttgacagcacgcttgctcgaactcatcatgtgtaacattgagaaaggtggattttacttgcagttagctctattttgtaatttggggttttgccatgcgggtttgcttaacagaccgatagcgatttttgctcagctatatgtatgagatttcatcttcaggtaaacgcccgataatagcgttct

SEQ ID NO: 5168 - DNA, 1869 bp, Triticum aestivum
aaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttaccatggaccgctacgagaatgactggagtgtggtcaagcgtgggtgggatgcccaggtgcttggagaagcaccacacaaattccaaaatgcacttgaagctgtgaagactctaagagcagagcccaaggccaatgatcagtatttgcccccatttgtgatagttgatgagagtggcaaatcggttggtcctatagtagacggtgatgcagtcgtgactttcaatttcagagctgatcgcatggttatgcttgcgaaagcactcgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgagacagtgaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagctacagttgttgcttgcaaggctgccgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccacccaggagtgagattccgctccgacatccagacacctgggctcgccaacgttgccgccaccgtgatgaacctccacggcttccaggctcctgctgattatgagacgaccctcatcgaagtcgtcgacaagtaaaaaacaatgcgctctttgaagccaaaattgctgtagccaattttgtcgctatagttttggggttggtcaaggaatgatcgcatcattgaataatttgagatttgacagcacgcttgctcgaactcatcatgtgtaacattgagaaaggtggattttacttgcagttagctctattttgtaatttgggg

SEQ ID NO: 5169 - DNA, 2011 bp, Avena sativa
gaatcctcggccactccgctctccgttcttcttctgaatccgcaaaccacaaggagaaaaggcaaaagaaaagaacaggcgatggcgacctcatggacgctccccgaccaccctacgctccccaagaacaagctggtggccgtcgttgtgctggacggatggggcgaggccagcgccgaccagtacaactgcatccatcgcgcagagacgcccgtcatggattcgctcaagaatggtgctcctgagaagtggacactagtgaaggctcatggaactgccgttggtctccctagtgatgatgacatgggcaacagtgaagtcggccacaatgctcttggtgctggtcgtatttttgctcaaggggcgaagcttgttgatgcggctcttgcatctgggaagatttgggaagatgaggggttcaattacatcaaagaatcttttgccgaaggtacgctgcaccttattggtctgttgagtgatggaggtgtccactcccggctagaccaagtgcagttgcttgtgaaaggtgccagtgagaggggagcaaaaagaattcgccttcacattcttactgatgggcgtgatgtcttggatggcagcagtgttggtttcgtagagacaatagagaatgatcttgctcagcttcgtgggcagggtgttgatgcacgggttgcatctggtggtggaaggatgtacgttacaatggaccgctatgagaatgattgggatgtggtcaagcgtgggtgggatgcccaggtgcttggagaagcaccacacaagttcaaaagtgcacttgaagctgtgaaaacactaagagcagagcccaaggctaacgatcagtacctgcccccgtttgtgattgttgatgagagtggcaaatcggttggtcctatagtagatggtgatgcagttgtgactttcaatttcagagctgatcgcatggttatgcttgcaaaagcgcttgagtttgctgattttgataaatttgaccgtgttcgtgtaccaaaaattaaatatgctgggatgcttcaatatgatggtgagttgaagcttccaaacaaattccttgtttccccaccattgatcgagaggacatctggcgaatacttggtaaagaatggtgtgcgcacatttgcttgcagcgagacagtgaagtttggccatgtcacatttttctggaatggaaaccgttctggatactttgatgaaactaaggaagagtatattgaagttcctagtgatagtggtatcacattcaatgagcaacccaaaatgaaggcacttgaaattgctgagaaaacccgggatgctatcctcagtggaaagtttgaccaggtacgtattaacctgccaaatggtgatatggtgggtcacactggtgatattgaagccacagttgttgcttgcaaggctgctgatgaagccgtcaagattgttttggatgcggtggagcaagtcggtggtatttaccttgtcaccgctgatcatggaaacgcggaggatatggtgaaaaggaacaaatctggccagccagctcttgacaagaatggcagcatccagattcttacctcccacacgcttcagccagtccctgttgcgattggaggccctggtctccacccaggagcgaaattcaggtccgacatcaagacacctggactcgccaatgttgccgccaccgtaatgaacctccacggcttcctggctcctgatgattacgagacgacgctcattgaggttgctgccaagtaaaaatatcactgcctgaagtcaaaattgcggtagccagttttgtcgctatagttttgggatggatagaaggatgatttcccatcatttgaataatttgagatttggcagctcaaaactcgtgaacattgaggaaagtggattagctctatttgtaacttggtattgccacgtgggctggcggaacaggctgatagccatttttggtcagctatatgtgtgaggcggcaaacttaccaagcagcagttatagttgtttagt

SEQ ID NO: 5170 - DNA, 2393 bp, Triticum aestivum
ttcttgttccgcaaaccacacgaagaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttaccatggaccgctacgagaatgactggagtgtggtcaagcgtgggtgggatgcccaggtgcttggagaagcaccacacaaattccaaaatgcacttgaagctgtgaagactctaagagcagagcccaaggccaatgatcagtatttgcccccatttgtgatagttgatgagagtggcaaatcggttggtcctatagtagacggtgatgcagtcgtgactttcaatttcagagctgatcgcatggttatgcttgcgaaagcactcgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgagacagtgaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagctacagttgttgcttgcaaggctgccgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccacccaggagtgagattccgctccgacatccagacacctgggctcgccaacgttgccgccaccgtgatgaacctccacggcttccaggctcctgctgattatgagacgaccctcatcgaagtcgtcgacaagtaaaaaaaacaatgcgctctttgaagccaaaattgctgtagccaattttgtcgctatagttttggggttggtcaaggaatgatcgcatcattgaataatttgagatttgacagcacgcttgctcgaactcatcatgtgtaacattgagaaaggtggattttacttgcagttagctctattttgtaatttggggttttgccatgcgggtttgcttaacagaccgatagcgatttttgctcagctatatgtatgagatttcatcttcaggtaaacgcccgataatagcgttctgagaaaagagacagacacgcgcaggacgaagagagagggctggaagttaaagatggggccctcctcggccgcgaccgccctatcccgcggccttggcggcggggagctgacaacaagcggcccatcaccccgaatagggcgtggataccattgggtgggccggcggtttaggctgagggcctgggaaaacgcctgggagcccgcgaattagaaccgttgcggagccccccgtttccccgctggctgtctgcgcaaaagcaccggcctatatccctccccacgttgcgccactcgtgaagggcgaaggaccctcccctgcggcgggcgcttatcgctgaggcacggggggatctgcgcgaagatgccgtagatcattcccgcgccctccc

SEQ ID NO: 5171 - DNA, 2027 bp, Triticum aestivum
tccctcccccttattaataccgcggccgccccgccttggcccattatcctccgccactccctctccgaaaagttcttcttgttccgcaaaccacacgaagaaaaaaagcaaagagatggcgaccacgaattggacgctccccgaccaccccacgctccccaaggggaagacggtggccgtcgtcgtgctcgacggatggggcgaggccagccccgaccagtacaactgcatacatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccatacaaattcccaaatgcacttgaagctgtgaagactctaagggcagagcccaaggccaatgatcagtatttgcccccctttgtgatagttgatgagagtggcaaatcggttggtcctatagtagacggtgatgcagtcgtgactttcaatttcagagctgatcgcatggttatgcttgcgaaagcacttgagtttcctgatttcgataaatttgaccgtgttcgtgtaccaaaaattaagtacgctgggatgcttcagtatgatggtgagttgaagcttccaagcaagtaccttgtttccccacctttgattgagaggacatctggtgaatacttggtgaagaatggtgtccgcaccttcgcttgcagtgagacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagaaaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggcgagcctatgcttgacaagagtggtagcatccagattcttacctcgcatacgcttcagccagtccctgttgctatcggaggccctggtctccacccaggagtgagattccgctccgacatccagacacccgggctcgccaacgtcgctgccaccgtgatgaacctccacggcttccaggcccctgctgattacgagacgaccctcatcgaagtcgttgacaagtaaaaaaaaaaactgtgctctctgaagccaaaattgctgtagccaattttgtcgctatagttttggggtgggtcaaggaatgatcgcatcattgaataatttgagatttgacagcacgcttgctcgaacttatcatgtgtaacattgagaaaggtggattttacttgcagttagctctattttgtaatttggggtattgccacgcgggtttgcttaacagaccgatagcgatttttgctca

SEQ ID NO: 5172 - DNA, 2438 bp, Musa acuminata
cttcctgcgggcgcatcaggtatcatccgcccaccggaggcgaggaaatcaacgggcatgaagttgggaactgcttaactcaagcaccaccgcgggagcaccataaacatcaagttcgatggccgtcggatgagacgcccatcagctatcgctacccccaattcttttccccaacactcccctctttcccaagaaaaatccagcgagcgacgcatttcacgtcaaacgcagcgtacgaatagcgacttaagggtttttgctcccattctataagtagaagccaaagctcgcttttttgtccatctgccgaaagactctcctccaacaatcctctgccgttagacttgcgaattccaagtgtttggcgtcatgggcagctcggatttctcgtggaagctggcggatcacccgacgcttcccaaaggcaagaccgtggccgttgttgtcttggatggatggggtgaagccaatccggacaagtataactgcattcatgtcgcccagactccgaccatggattcgcttaagcagggtgctccggaaagatggaggctggtcagagctcatggaacagctgtgggtcttcctactgaggatgacatgggtaacagtgaagttggtcacaatgcacttggagcaggcaggatttatgctcaaggtgctaagctagtggatcttgcacttgcatctggaaaaatatatgaaggagaaggctttaagtatattaaagaatcctttgatcaaggaactttacatctcattgggttattgagcgatggaggtgttcactctcggcttgatcagttgcagttgcttctgaaagggtctagtgagaatggtgccaaaagaatacgtgtacatatcctcactgatggccgtgatgttttggatggctcaagtgttggatttgtggaaactctagagagtgaccttgctaagctacgagagaaaggtattgatgcacaaattgcatccggtggtggtcgaatgtatgtaaccatggaccgctatgagaatgactgggatgttgttaaacggggatgggatgctcaggttcttggcgaagcaccatacaagtttcgaagtgctgttgaagctgtgaaaaaattgagggaggatacaaaggccaatgatcagtacttgcctccgtttgtcatagttgatgagagcggcaaagcagttggtccaatagtggatggtgatgctgttgtgaccttcaacttccgagcagatcgtatggttatgatagctaaatcactagaatatgaagattttgacaaatttgatcgtgttcgtttcccaaagatccgatatgctggaatgcttcagtatgatggtgaattgaagcttccgagcaaataccttgtttctcctcctgagatagagaggacatctggcgaatatttggtccacaatggtgtccgtacttttgcttgcagtgagaccgtaaaatttggtcatgtcaccttcttctggaatggaaatcgatcgggatattttgacgcaaccatggaagaatatgttgaaattcctagtgattcaggaattacgtttaatgttcgacccaagatgaaggctctggaaattgccgagaaggctagggatgctattctcagtcgcaagtttgatcaggttcgtgtgaacctacctaatggagacatggtaggacatacgggtgacatagaggctactgttgtggcttgcaaggctgccgatgaagctgttaagatcattttggatgccatagagcaagtgggtggcatttatgttgtcactgcagaccatggtaatgctgaagacatggtaaagaggaacaaaactggacagccacaactcgacaaagctgggaacattcagattctcacttctcatactcttcaacctgttcctattgccattggtggccctgggcttgcacctggtgtcagattccgaaacaacgtgcctgacggtggcctcgccaatgtggctgccacggtcatgaatctgcatggttttgaagcaccaagtgactacgaacctactctcatcgaagtagacaactgatgtgttgttacagattgaagcattgctctgcagttgctgatagacatgaagtgatcaaataatcttattttggatacgtcgaaatagcaattttgttgcaatatttttgttgttgttggagaatatccccctatgaactcccccagcagtgctgaaatgccatggtattttgatcatttcatgctatttgtagctaaaaacatggttgtggaagcacttgggacatgtcgtgcttgtcttggttactttagactctatgatatctgcttttttggcgtctcttttattggttctaatcatatccagagtgacttcatgttggatcaaatagaatcttagatttcttgttgagattctcaaggtaaatacatatgaaacgaatgtagttgact

SEQ ID NO: 5173 - DNA, 2136 bp, Triticum aestivum
tggacgctccccgaccaccccacgctccccaaggggaagacggtggccgtcgtcgtgctcgacggatggggcgaggccagccccgaccagtacaactgcatccatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccatacaaattcccaaatgcacttgaagctgtgaagactctaagggcagagcccaaggccaatgatcagtatttgcccccctttgtgatagttgatgagagtggcaaatcggttggtcctatagtagacggtgatgcagtcgtgactttcaatttcagagctgatcgcatggttatgcttgcgaaagcacttgagtttcctgatttcgataaatttgaccgtgttcgtgtaccaaaaattaagtacgctgggatgcttcagtatgatggtgagttgaagcttccaagcaagtaccttgtttccccacctttgattgagaggacatctggtgaatacttggtgaagaatggtgtccgcaccttcgcttgcagtgagacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagaaaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggcgagccgatgcttgacaagagtggtagcatccagattcttacctcgcatacgcttcagccagtccctgttgctatcggaggccctggtctccacccaggagtgagattccgctccgacatccagacacccgggctcgccaacgtcgctgccaccgtgatgaacctccacggcttccaggcccctgctgattacgagacgaccctcatcgaagtcgttgacaagtaaaaaaaaaacactgtgctctctgaagccaaaattgctgtagccaattttgtcgctatagttttggggtgggtcaaggaatgatcgcatcattgaataatttgagatttgacagcacgcttgctcgaacttatcatgtgtaacattgagaaaggtggattttacttgcagttagctctattttgtaatttggggttttgccatgctggtttgcttaacataccgatagcgatttttgctcagctatatgtatgagatttcatcttcaggtaaacgcccgataatagcgttcttatcctcgctctcccttgagcctaaatagtccccttccccaagcaatgaaggaaacggggaaaatttcaaagccagactgctttgtaagccgtgactcacagaactggtgaggggcttggacgcaccttgcatgccaaactccaactccctttggaagagctccgtgcactaaccccaggttgtgcc

SEQ ID NO: 5174 - DNA, 1968 bp, Triticum aestivum
ttccgctctcccaaaagttcttgtttcgcaaaccacacgaagaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggttttgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccacacaaattccaaaatgcacttgaagctgtgaagactctaagagcagagcccaaggccaatgatcagtatttgcctccctttgtgattgttgatgagagtggcaaatcggttggtcctatagtagacggtgatgctgtcgtgactttcaatttcagagctgatcgcatggttatgcttgcgaaagcacttgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgaaacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaaacactgcgccctctgaagccaaaattgctgcagccgattttgtcgctatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgcttaacataccgatagcgatttttgctca

SEQ ID NO: 5175 - DNA, 1949 bp, Triticum aestivum
ttcttgttccgcaaaccacacgaagaaaaaaagcaaagagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgtgggtggaatgcccaggtacttggagaagcaccatacaaattcccaaatgcacttgaagctgtgaagactctaagggcagagcccaaggccaatgatcagtatttgcccccctttgtgatagttgatgagagtggcaaatcggttggtcctatagtagacggtgatgcagtcgtgactttcaatttcagagctgatcgcatggttatgcttgcgaaagcacttgagtttcctgatttcgataaatttgaccgtgttcgtgtaccaaaaattaagtacgctgggatgcttcagtatgatggtgagttgaagcttccaagcaagtaccttgtttccccacctttgattgagaggacatctggtgaatacttagtgaagaatggtgtccgcaccttcgcttgcagtgagacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagaaaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggcgagccgatgcttgacaagagtggtagcatccagattcttacctcgcatacgcttcagccagtccctgttgctatcggaggccctggtctccacccaggagtgagattccgctccgacatccagacacccgggctcgccaacgtcgctgccaccgtgatgaacctccacggcttccaggcccctgctgattacgagacgaccctcatcgaagtcgttgacaagtaaaaaaaaaaactgtgctctctgaagccaaaattgctgtagccaattttgtcgctatagttttggggtgggtcaaggaatgatcgcatcattgaataatttgagatttgacagcacgcttgctcgaacttatcatgtgtaacattgagaaaggtggattttacttgcagttagctctattttgtaatttggggtattgccacgcgggtttgcttaacagaccgatagcgatttttgc

SEQ ID NO: 5176 - DNA, 2001 bp, Triticum aestivum
ttcttgtttcgcaaaccacacgaagaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggttttgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccacacaaattccaaaatgcacttgaagctgtgaagactctaagagcagagcccaaggccaatgatcagtatttgcctccctttgtgattgttgatgagagtggcaaatcggttggtcctatagtagacggtgatgctgtcgtgactttcaatttcagagctgatcgcatggttatgcttgcgaaagcacttgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgaaacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaaacactgcgccctctgaagccaaaattgctgcagccgattttgtcgctatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgcttaacataccgatagcgatttttgctcagctatatgtatgagatttcatcttcagctaaacgcccgagaatagcgttc

SEQ ID NO: 5177 - DNA, 2046 bp, Triticum aestivum
cgctctccgaaaagttcttcttgttccgcaaaccacacgaagaaaaaagcaaagagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttaccatggaccgctacgagaatgactggagtgtggtcaagcgtgggtgggatgcccaggtgcttggagaagcaccacacaaattccaaaatgcacttgaagctgtgaagactctaagagcagagcccaaggccaatgatcagtatttgcccccatttgtgatagttgatgagagtggcaaatcggttggtcctatagtagacggtgatgcagtcgtgactttcaatttcagagctgatcgcatggttatgcttgcgaaagcactcgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgagacagtgaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaaacactgcgccctctgaagccaaaattgctgcagccgattttgtcgctatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgcttaacataccgatagcgatttttgctcagctatatgtatgagatttcatcttcagctaaacgcccgagaatagcgttcgtatcctcgctctcccttgagcctaaata

SEQ ID NO: 5178 - DNA, 1976 bp, Musa acuminata
gcggaagaccctctccttcacggatcttacaccgagatttgcgaaatcgaagtgcttggcggcatgggtagctcggatttctcgtggaaattggcggatcacccaaagcttcccaaagggaagacggtggccgttgtggttttggatggatggggtgaggcggaccctgaccagtataactgcattcatgtcgcccagactcccaccatggattcgcttaaaaagggtgccccagagaggtggagacttgttagggctcacggaacagctgtgggccttcctactgaggatgacatgggcaatagtgaagtaggtcacaacgcacttggagcaggaaggatttttgctcaaggtgccaagctggtggaccttgcacttgcatctggaaaaatattcgaaggagaaggctttaagtatattaaagaatgctttgataaaagtaccttacatctcattgggcttttaagtgatggaggtgtacactctcggcttgatcagttgcagttgcttctgaaagggtgtagcgagaatggtgccaaaagaattcgtgttcatatcctcactgatggccgtgatgttttagatggctcaagtgttggatttgtggaaatacttgagaatgatcttgctaagctacgagagaaaggcattgatgcacaaattgcatctggtggtggtcgaatgtatgttaccatggaccgctatgagaatgactggggggtcgttaaacgtgggtgggatgcacaagttcttggtgaagcaccacacaagtttcgaagtgctgtcgaagctgtgaaaaaactgagggaggctcccaaggccaatgatcagtacttgcctccatttgttatagttgatgagagtggcaaggcggttggtccaatagtggatggtgatgctgttgtaaccttcaacttccgagcggatcgtatggttatgattgctaaagcactagaatatgcagactttgacaaatttgatcgtgttcgcgtcccaaagattcgatatgctggaatgcttcagtatgatggtgaactgaagcttcctagccgctaccttgtttctcctcctgagatagacagaacatcaggcgaatatttggtgcacaatggtatccgtacttttgcatgcagtgagaccgtcaaatttggtcatgtcaccttcttctggaatggaaatcgttccggatattttaactcatccatggaagaatatgttgaaattcctagtgactcaggaattacatttaatgttcaacccaagatgaaggctctggaaattgctgagaaagttagggatgctattctcagtcgcaagtttgaccaggttcgtgtgaacctacctaatggagacatggtaggacatacaggcgacatagaggctactgttgtgggttgcaaggctgctgatgaagctgttaagatcattttggatgccatagagcaagttggcggcatttatgttgtcaccgcagaccatggaaatgctgaagacatggtaaagagaaacaaaaccggccagccactgctcgacaaagctgggaagattcagattctcacttctcatactcttcagcctgttcccattgccataggaggccctgggcttgcatctggtgtcagattccgcaaggatgtgcctgatggtggcctggccaacgtcgctgccaccgtcatgaatcttcatgggttcgaggcgccgacagactacgaaccgaccctcattgaagttgttgacaactaattaataattgctgctcatcttttctaggctgaataggcataaaagggttgatcaaataatcttctttcggatacttcaagttgctcgtcctcacgagcaacatgacaaaattttgtttcaatcatttatcgttatccgtgatcgtggaaaaataatttccttaatgctatgtatctttgttatttttgttaccttatggagacaactcgcattttggctgagtaaaccaaaaa

SEQ ID NO: 5179 - DNA, 2131 bp, Avena sativa
ggccttattatcgtcgacaactccgccccacaaaatttcttgttctgcaaaccaaggagaaaaaaaaggcgatggcgacctcatggacgctccccgaccaccctaagctccccaagggcaagctggttacgatcatcgtgctggacggatggggcgaggccaccgctgaccagtacaactgcatccatcgcgcggagacgcccgtcatggattcgctcaagaatggtgctcctgagaagtggacacttgtgaaggctcatggaactgccgttggtctccctagtgatgatgacatgggcaacagtgaagttggccacaatgctcttggcgctggtcggattttcgctcaaggcgcaaagcttgttgatgctgctcttgcatctgggaagatttgggaagatgaggggttcaattacatcaaagaatcttttgctgaaggtactctgcaccttattggtctgttgagtgatggaggcgtgcactcccggctagaccaagtgcagttgcttgtgaaaggtgccagtgagaggggagcaaaaagaattcgccttcacattcttaccgatgggcgtgatgtcttggatggcagcagtgttggtttcgtagagacaatagagaatgatcttgctcagcttcgtgagaagggtgttgatgcacgggttgcatctggtggtggaaggatgtacgttacaatggaccgttatgagaatgactggggtgtggtcaagcgtgggtgggatgcccaggtgcttggagaagcgccatacaagttcaaaagtgcacttgaagctgtgaaaacactaagagcagagcccaaggccaatgatcagtacttgcccccgtttgtgatagttgatgagagtggcaaatcggttggtcctatcgtagatggtgatgcagttgtgactttcaatttcagagctgatcgcatggttatgcttgcgaaagcgcttgagtttgctgattttgataaatttgaccgtgttcgtgtaccaaaaattaagtatgctgggatgcttcagtatgatggtgagttgaagcttccaaacaaattccttgtttccccgcccttgatagagaggacatctggtgaatacttggtaaagaatggtgtgcgcacatttgcttgcagtgagacagtgaagtttggtcatgtcacatttttctggaatggaaaccgttctggatactttgatgaaaccaaggaagagtatattgaaattcctagtgatagcggtatcacattcaatgagcaacccaaaatgaaggcacttgaaattgctgagaaaacccgggatgctatcctcagtggaaagtttgaccaggtacgtattaacctgccaaatggtgacatggtgggtcacaccggtgatattgaagccacagttgttgcttgcaaggctgctgatgaagccgtcaagattgttttggatgcggtggagaaagttggtggtatttaccttgtcactgctgatcatggaaacgcagaggatatggtgaaaagaaacaaatctggccagccggctcttgacaagagtggcagcatccagattcttacctcgcacacgcttcagccagtacctgttgcgatcggaggccctggtctccacccaggagtgaaattcaggaccgatatcaacacccctggactcgccaatgttgcagccaccgtgatgaacctccacggtttcctggctcctgatgatttcgagacgacgctcattgaggttgctgacaagtgaaattatgactgtctgaagtcaaaatcgcggtagccagttttgttgctaatagttttgacatggatcaaaggatgattccatcattgaataataatttgagatttggctgctcaagctcatgaacactgagaaaagtggattagctctatttgtaacttggtattgccacgtgcgctggcgtaacagactgatagccatttttgctcagctatatgtgtgaggcgtcaaaatttataccaagttgttgggtaaattatcgctttgctcagctatatgtgtgttgctctagcgggtgtgcaccaggtgacttgtttaggatccgctccagatctgatgacatcaactgaataaaaggcaaaagaaatcagacatagctgttatgttccaaa

SEQ ID NO: 5180 - DNA, 2029 bp, Triticum aestivum
gccactccgctctcccaaaagttcttgttccgcaaaccacacgaagaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgccgttggtctcccaagtgacgacgacatgggcaacagtgaagttggccacaatgctcttggagctggccgaatctttgctcaaggtgcgaagcttgttgatgctgctcttgcttccgggaagatttgggaagacgaggggttcaattacatcaaggaatcttttgataagggtactctgctaccttatttggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggttttgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccacacaaattccaaaatgcacttgaagctgtgaagactctaagagcagagcccaaggccaatgatcagtatttgcctccctttgtgattgttgatgagagtggcaaatcggttggtcctatagtagacggtgatgctgtcgtgactttcaatttcagagctgatcgcatggttatgcttgcgaaagcacttgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgaaacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggcgagcctatgcttgacaagagtggtagcatccagattcttacctcgcatacgcttcagccagtccctgttgctatcggaggccctggtctccacccaggagtgagattccgctccgacatccagacacccgggctcgccaacgtcgctgccaccgtgatgaacctccacggcttccaggcccctgctgattacgagacgaccctcatcgaagtcgttgacaagtaaaaaaaaaaaactgtgctctctgaagccaaaattgctgtagccaattttgtcgctatagttttggggtgggtcaaggaatgatcgcatcattgaataatttgagatttgacagcacgcttgctcggacttatcatgtgtaacattgagaaaggtggattttacttgcagttagctctattttgtaatttggggtattgccacgcgggtttgcttaacagaccgatagcgatttttgctcagctatatgtgcaccaaaaaaaaaaaaagcccacctgcccgggcggccgctcga

SEQ ID NO: 5181 - DNA, 1915 bp, Secale cereale
cccccccacgtactctgttccgcaaaccacacgaagaaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggtgcgaagcttgttgatgccgctcttgcttccgggaagatttgggaagacgaggggttcaattacatcaaagaatcttttgacaagggtactctgcaccttattggtctgttgagtgatggaggcgtccactcccggctagatcaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgacttttaatttcagagctgaccgcatggttatgcttgcgaaagcacttgagtttcctgatttcgataaatttgaccgtgttcgtgtaccaaaattaagtacgctgggatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcactattttctggaatggaaaccgctcggatactttgatgagaccagggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacacttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactcttgtaacattgagaaaagtggatttgacttgcagctagctctattttgtattttttttgttaa

SEQ ID NO: 5182 - DNA, 1953 bp, Triticum aestivum
atcctccgccactccgctctccgaaaagttcttcttgttccgcaaaccacacgaagaaaaaagcaaagagatggcgaccacgaattggacgctccccgaccaccccacgctccccaaggggaagacggtggccgtcgtcgtgctcgacggatggggcgaggccagccccgaccagtacaactgcatacatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacgaggggttcaattacatcaaggaatcttttgataagggtactctgcaccttattggtttgttgagtgatggaggcgttcactcccggctagaccaagtgcagttgattgtgaaaggtgccagtgagaggggagcaaaaagattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccacacaaattccaaaatgcacttgaagctgtgaagactctaagagcagagcccaaggccaatgatcagtatttgcctccctttgtgattgttgatgagagtggcaaatcggttggtcctatagtagacggtgatgctgtcgtgactttcaatttcagagctgatcgcatggttatgcttgcgaaagcacttgagtttcctgattttgataaatttgaccgtgttcgtgtaccaaaaattaagtacgctgggatgcttcaatatgatggtgagttgaagcttccaagcaagtaccttgtttccccacctttgattgagaggacatctggtgaatacttggtgaagaatggtgtccgcaccttcgcttgcagtgaaacagttaagtttggccatgtcacatttttctggaatggaaaccgttcgggatactttgacgagaccagggaagagtatgtagaaattcccagtgacagtggtatcacattcaatgagcagcccaaaatgaaggcacttgaaattgctgagagaactcgggatgctatcctcagtgggaagtttgaccaggtgcgtattaaccctgccaaacggtgacatggttggtcacactggtgatattgaagccacagttgttgcttgcaaggctgctgatgaagctgtcaagatggtcttggatgctgtggagcaagttggtgtatctatcttgtcacagctgatcatggaaacgcagaggatatggttaagaggaacaaagctggccagccgatgctcgacaagagcggcagcatccagattcttacatcgcacacgcttcagccagtccctgttgctatcggaggccctggtctccacccaggagtgagattccgctccgacatccagacacccgggctcgccaacgtcgccgccaccgtgatgaacctccatggcttccaggctcctgctgattacgagacgaccctcatcgaagtcattgacaagtaaaaaaaaaacactgcgccctctgaagccaaaattgctgcagccgattttgtcgcaatagttttggggtgggtcaaggaatgatcgcatcattgaataatttgagatttgccagcacgcttgctcgaactcatatgtaacattgagaaaggtggattttacttgcagttagctctattttgtaatttggggtattgccatgctggtttgctt

SEQ ID NO: 5183 - DNA, 2092 bp, Elaeis guineensis
tctccgactcagtctttctatataaacgtatcaaagacccgttcgaagatcttattattcgatcttccctcgttcgcgtccgagaaaaccctcctcgagaaatctcgcaagcatttggagagagatggggagctctgagttttcgtggaaattggctgatcacccgaagcttccaaaagggaagacggtggccgttgtggttttggatggatggggcgaagccaatcccgataaatacaattgcattcacgtcgccgagactcctgccatggattcactcaagaagggtgctccggacagatggaggctggtaagggctcacggcacagcggtgggacttcctactgaggatgacatgggcaacagtgaagtaggtcacaatgcactaggtgcaggacgcatctatgcccaaggtgctaagttggtggatcttgcacttgcctctggaaagatatatgaaggggaaggtttcaagtacatcaaagaatgttttgatcaaggtactttgcatctcattgggttattgagtgatggaggtgttcactctcggctagatcagttgcagttgctactgaaaggtgctagtgagaatggtgcaaaaagaatccgtgtgcatgttcttaccgatggccgagatgttttggatgggtcaagtgttggttttgttgaaacacttgagaatgatcttttgaagctacgagagaagggtgttgatgcacaaattgcttctggtggtggtcgtatgtatgttaccatggatcgctatgagaatgattggggtgttgttaagcgtggttgggatgctcaggttcttggtgaagcaccacacaagtttcaaagtgccgttgaagctgtcaaaaagctccgggaagttcccaaagccaatgatcagtacttggccccttttgttatagttgatgagagcggcaaggcagttgggccaatagtggatggtgatgcggttgtaacattcaacttcagagcagatcgtatggtcatgcttgctaaagcactagaatatgaagattttgacaaatttgaccgtgttcgctttccaaagattcgatatgctggaatgcttcagtatgatggtgaattgaagcttccaagccattatcttgtttctcctccagagatagagagaacatcaggagagtacctagtgcacaatggcatccgttacttttgcttgcagtgagactgtcaagtttggtcatgtcacctttttctggaatgggaatcgatctgggtattttgacccgtctatggaagaatatgttgaaattccaagtgatgcaggaattacatttaatgttaaacccaagatgaaggccgtggaaattgctgaaaaggcaagagatgctatccttagtcgcaagtttgaccaggttcgtgtcaaccttcctaatggagatatggtgggtcatactggtgacatagaggccactgttgtggcatgcaaggctgctgatgatgctgtcaagatgattctggatgctatagagcaagtgggtggaatatatgtggtcactgcagatcatggaaatgctgaggacatggtaaagaggaacaaatccggccaaccacaacttgacaaaaatggggacattcaaattctcacttcccatactcttcaaccagttcccgttgccattggtggccctggtcttgcacctggtgtcggattccggaaggatgtacccaatggtggccttgccaatattgctgctaccgttatgaatcttcatggttttgaggctcctagtgactatgagccaaccctcattgaagtagttgacaattgaatgcatcatctagtcgtaacttaacgcaggagttatattgctccattctagagtctgactcaaattctaccaccaatacttgtttgattggaagagatgtctgaataaattcctttttgtgaaacttcaatgttttgtgagccgcagtagaagctgttaagagtgttataattttaccccttttttctggaggaagttaattgtgtgggggttctcccgccatgattctccatgagcatgttttaagtgccttgtacttggtgggaagctatttaaacttgaaatgg

SEQ ID NO: 5184 - DNA, 2085 bp, Coffea canephora
aacagtttttttctctctatatttctttgtttttatattttcaattttttcgataacccaagtggtttttatatttatttgttttgaaatttatatagatctggttctggttgtgatctattgttgctgcagcagtagcggatttattaacttctgggatttttatttggttttttctttcttttgggtagtgttgagtgattggatcgatagaaaagaggaagaaaagaaatgggtagctcaggattttcatggaaattgaacgatcacccgaagcttcccaaagggaaggttattgcaatggtggttttggatggatggggtgaagccaatcccaatcaatacaattgtatccatgttgccgaaactcctgtcatggattccctcaagaatggtgctcctgagaagtggagattggtgaaggctcacgggaaagctgtggggctgcccacggatgatgatatggggaatagcgaggttggtcataacgcccttggtgctggcaggatctatgctcaaggagcaaaacttgttgatttagctcttgagtctggaaagatatatgatgatgaaggtttcaaatatatcaaggaatcttttgaaactggaacattacacctcatagggctgttgagtgatggcggtgtccactctaggcttgatcagttacagcttctgcttaaaggtgccagtgagcgtggtgccaaaagaattcgggtccatgctcttactgatggacgtgatgtattggatggtacaagtgtaggctttatggaaactcttgagaatgatcttgctaaattgcgagagaaaggtattgatgcacagattgcatctggtggcggacgaatgtatgtcacaatggatcgttatgagaatgattgggatgttgttaaacgaggttgggatgcccaagttcttggtgaagctccacataagtttacaaatgctgttgaggctgtcaagaagctaagggaggaacccaaggccaacgaccagtacttacctccatttgttattgttgatgagaatggaaagtctgttggtccaattttggatggtgatgctgttgtcactttcaacttccgcgcagatcgcatggttatgttagccaaggccctcgagtatgaagactttgataaatttgacagagttcgattccctaaaattcgttatgctggaatgcttcagtatgatggtgaactgaagcttcccagtcactacctggtttctcctcctgagattgagaggacatctggtgaatatttagtgcataatggcgttagtacttttgcttgcagcgaaactgttaaatttggacatgtcacctttttctggaatgggaatcggtctggttattttgacccatcaaaggaggaatatgttgaaattcctagtgatagtggaatcaccttcaatgtcaagccaaagatgaaggctttggagatcgcagagaaggccagagatgctattctcagcggcaagttccaccaggtacgagtgaacctaccaaatagtgacatggttgggcatacaggtgatattgaagcaacagttgtggcttgcaaggcagcagatgatgctgtaaagatgatccttgatgcaattgagcaagtgggtggaatatatgttgtaactgctgatcatggaaatgctgaggatatggtgaagagaaacaagaaaggggaacctcttctggacaagaatggcaacgttcaaattcttacctctcacacactggagccggtacccattgcaattggtggtcctggattggcaccaggggtgaaattccgtcaaggtctccctggtgctggcctggctaatgttgctgcaactgtcatgaacttgcatggctacgaggcacctagtgactatgagccaaccctaattgaggtagttgacaattaggcgggaggattgatagaaaattttgctcgaggattgaataattgttaagagtagttgctactggataaaatatttagcttttgttgtattgagctgcattcgatacatagtttcttattgatgacctcgtcatataattttacagaggctctcgttgtcatgttttttggttcc

SEQ ID NO: 5185 - DNA, 2137 bp, Aristolochia fimbriata
cttctctccttttttatatatattaaagcggcaaggactccgccttcttctcgtatcttcccttactttttataagtccctcgccgagcttcatttggttctgtaagctgttgcacacaaaccacttcttccgatcgcgaaaaccctcagatatcacaccgaggtcgggaaaacaagaacaacgagatgggtagctctgacttctcgtggaagctcgctgatcacccgaagcttcccaagggtaaaactattgccgttgtagttttggatggatggggtgaggccaatcccgacaagtacaactgtattcatgttgctgaaacgccggttatggattctcttaagaagggtgctccggacagatggaggttggtgagggcccatggtactgcagttggtcttccaacggaagatgacatgggtaacagtgaagttggtcacaatgcattgggggctggccgaatttatgctcaaggggctaaattagtggaccttgctcttgcatctggaaaaatctatgatggagaaggcttcaactatatcaaggaatctttcaatactaacactttgcatctcattggtttattgagtgatggtggggttcactcacgacttgatcagttacagttgctagtgaaaggagcaagtgagcgtggggccaaaaggatccgtctacatattctcaccgatggtcgtgatgtattggatggctccagtgtgggctttgtggagaccattgagaaggaccttgcagacttgagagcaaaaggagttgatgctcaaattgcatctggtggtggccgtatgtatgttacgatggaccgttatgagaacgactgggaagttattaagaggggatgggatgctcaagtccttggtgaagctccttacaagtttcggaatgctgtggaggctgtcaaaaaactgagggaagaccctaaaaataatgaccagtacctgcccccgtttgtcatagttgatgagcaagggaaatcagtagggcctattgtagatggagatgctgtagtaacctttaacttcagggcagatcgtatggttatgctagcaaaagctcttgagtatgctgattttgacaaatttgatcgtgtccgtgtgccaaaaattcgttatgctggaatgttgcagtatgatggggagttgaagcttccaagccgctatcttgtttccccaccagagatagaaaggacatctggtgaatatttagttcataatggggtccgcacatttgcatgcagtgagactgtgaagtttggccatgtcaccttcttttggaatggaaaccgctctggttattttaactcagagatggaagaatatgttgaaataccaagtgattctggaattacattcaatgtcaaaccaaatatgaaagctttggaaatagctgaaaaggcaagggatgccatccttagcggcaaattccatcaggtccgtgtcaacttgcccaacagtgacatggttggacatacaggtgatatagatgccacagttgttgcttgcaaggctgctgatgatgctgttaagatgattcttgatgcagtagagaaagttggtgggatctatgtggtgacagcagatcatggaaacgccgaggacatggtaaagaggaataagaagggtgaaccccaacttgataaagaaggaaaaattcaaattcttacttcccacactcttcagcccgttccaatcgccattggaggacctggtttgggcccgggagtgaagttccggaaagatgttccccaaggcggacttgcaaacgttgctgcaacggtgatgaacctccacggtttggaggccccagctgattacgagccgaccttgatcgaagtcgtggacaactgaatttgatgggagtccagcaggcaaattttgctcatacatggctagtttttttactaggggtagcaaacccgtctttttttaaggcctaaataacttttgtggagtctgccggtcggcagaggaaggatacaaaagattttgatggaaaactagccaacaggacatcatatctgattgtataacttgagccctatattttttgttagggcaaacgtcacttatgcgagtattaggatctccttatatcatcatattaccgctcttttctctt

SEQ ID NO: 5186 - DNA, 1971 bp, Glycine max
acaaggtttagtcttgttaggttacctctgtgacatttgtgctgctagttcatatatttgcggctgacaccgagaaggaaagcaggaaaaaaacaaaaaggagcagatgggtagctcaggtttctcatggaaattggcggatcatccaaagcttccaaagggtaagactgtggctgttgtggtattggatggttggggagaggccacacccaatgagtacaactgcatccacaaggccgaaacaccctgcatggattcacttaaaaagggtgctcctgaacggtggagattggtcagggctcatggtactgctgtaggacttccaacagaagatgacatgggcaatagtgaagttggtcacaatgcccttggggctggtcgcatatttgctcagggtgctaagcttgtcgaccttgctctagcctctggaaaaatttttgaaggagaaggtttcaagtacataaaggaatgttttgaaaatggcacattgcatctcattgggctactgagtgatggtggagttcactccagacttgatcagttgcagttgttgcttaaaggagttagtgagcgaggtgttaaaagagtccgtgtccatattcttacagatggccgtgatgttttggatggctcaagtgtggggtttgtggaaacccttgaaaatgatcttgcaaacttgcgcgcaaaaggtgtcgatgctaggatagcatcaggtggaggtcgtatgaatgtcacaatggatcgttatgagaatgattggagtgttgtgaaacgagggtgggatgctcaagttcttggtgaagccccttataagtttacaaatgctcttgaagctgtcaagaagctgagggcagaaccaaaggccaatgaccaatatttgcctccttttgttattgttgacgagagtgggaaacctgttggtccgatagttgatggtgatgctgttgttacattcaacttccgagctgatcgtatgacaatgattgctaaagctcttgagtatgaaaattttgacaaatttgatagagttcgttacccaaaaatccgctatgctggaatgcttgaatatgatggtgaattgaaacttccaagtcattaccttgtttctccaccagagattgacaggacttctggtgaatatttagtgtataatggtattcggacttttgcttgcagtgagactgttaaatttggccacgtcacattcttctggaatggaaaccgctctgggtattttaatgcagaattggaggaatatgtggaaattcctagtgattctgggattacattcaatgaacaaccattaatgaaagcattgcagattgctgaaaaggctagggatgctattcttagcgggaaatttgatcaggtacgcgtcaaccttccaaatggtgacatggtggggcatacaggtgacattgaagcaacagttgtggcatgcaaggcagctgatgctgctgtgaagatgattcttgatgcaatagagcaagtgggtggaatttatgttgtcacagctgaccacgggaatgctgaggatatggtcaagagggataaatctggaaaaccacttctaggcaaggatggaaaaatccagattcttacttcccatactcttgagcctgtgccaattgctattggaggtcctggattggcccctggtgtcagattccgcaacaatgttccaactggtggacttgccaacgttgctgcaactgtgatgaatcttcatggatttgaggctcccagcgactacgagacaactctgatagaagtagttgataactaggaaccaatagatgatttttttttttttaatttgcaaaaactcagggtaagcattgcagcccacaaaataattgaaagttttcatccttccacatgtgtggtggttttgttcttatgagttaccaaatttcagtctggagttgacagaacagtataaccaattaatggcattttgacactttctcc

SEQ ID NO: 5187 - DNA, 1920 bp, Papaver somniferum
tgtggttggggtttttgtctcttaaatctttttctctccgactcaaaaacacaaacaccaacaaacaaagatgggaagtgctgaagtctcattcaaattggcggatcatccaaagcttcctaaagggaaggtagtagctcagattgtgttggatggatggggagaagctaatcccgaccagtttaactgtatccatgttgctcaaacaccaaccatggattctctaaaacaaggtgcacctgagaagtggagattggtaagagctcatggtaaggcagttggtctcccaactgaagatgacatgggtaacagtgaagttggacataatgcccttggtgctggaagaatttttgctcaaggtgccaagcttgttgacattgcacttgcctcgggaaagatcttcgatggagaaggctttcagtacatcaaggaatcctttaaggatggcaccctccacctaattgggttattgagtgatggaggtgtccactctcgaattgatcaagtgcagttgctattaaaaggagccagcgagaggggtgccaaaagaatccgccttcatattctcacggatggtcgcgatgttttggatggttcaagcgtagggtttgttgaaactattgagaatgaccttgcacaactgcgagcaaatggcgttgatgcacaaattgcatctggtgggggtcgcatgtatgtcacaatggaccgttatgagaacgactggagtgttgtgaaaagaggatgggatgctcaagttcttggtgaagcaccatacaaatttaagagtgctttagaagcagttaagacactgagggcagaaccaaaggccaatgaccaatacttgcctccatttgttatagttgatgatagtggcaaggctgttggcccagttttggatggtgatgctgttgtgactttcaacttccgtgcagatcgtatgactatgcttgctaaggcccttgaatacgatgacttcaaggattttgaccgcgttagattcccaaagatccgttatgctggtatgctccagtatgatggtgagttgaagcttccaaacaaatacctagtttcaccaccagagattgatagaacatctggtgaatacttggtgcacaatggcgtccgtacttttgcctgcagtgagactgttaagtttggacatgttaccttcttctggaacgggaacagatctggatactttaaagaagatatggaggaatacgttgaaattccaagtgatagcggaattacattcaatgcccagccgttaatgaaggccttggaaattggtgagaaggcaagggatgctattcttagtggcaaattcgaccaggtacgtgtcaacattccaaacagtgacatggttggacacactggtgacattgaggcaactgttgtcgcttgcaaggctgctgatcaagctgtgaagatgattattgatgcaatcgagcaagttggtggaatttatcttgttactgctgatcatggtaatgctgaagatatggtgaagaggaacaaaaagggagaacccctgctagataaaaatgggaacattcagatcctcacttcccacactcttcaaccagtcccagttgccatcggtgggcctggtctagctccaggagttagattccgcagtgatgttcctgagggtggtctcgccaatgttgctgcaacaatgatgaacctccatggatttgtggctccagatgactacgagacgactctaattgaggttgtctagagaactgttaatttgaaaaatcactcggatctgcagaggaagagataaattagagtcacaatataagtacttgcttatcggagtgttatagtgtcataatttattttgagagactcctatggagaggagatagtgtcataatttaatctcagaagaatagaattcttataaacgat

SEQ ID NO: 5188 - DNA, 1931 bp, Aquilegia formosa
taatgggtagctcagaattttcatggaaattggcggatcatccaaagttaccaaagggtaaacaattagctttggttgttcttgatggatggggtgaagctaatcctgataagtataattgtatccatgttgctgaaactcctaccatggattcactcaaacagggtgcacccgagaaatggagattggttaaggcacatggtaaagctgttggacttccaactgaagatgacatgggcaacagtgaagttggtcacaatgcacttggtgctggaagaatatatgctcaaggtgccaagcttgtggatattgcacttgcctcaggaagcatctatgatggagaaggttttagttacattaaagagtgctttgcttctggtacgttgcacctaataggactattgagtgatggaggagtccactcacgaattgatcaattgcagttacttttaaagggagctagtgagcgcggtgccaaaagaatccgtgttcatatcctcactgatgggcgagattgtttagatggttcaagcattgggtttgtagagactcttgagaaggaccttacagaattgagggcaaaaggtattgatgcacaaattgcttctggagggggtcgtatgtacgtaaccatggatcgttatgagaatgactggagtgtggtgaaacgtgggtgggatgctcaagttcttggtgaagcaccataccagtttaccagtgctgtagaagctgttaagaagctgagggaagctccaaacactagtgaccagtacttgcccccatttgttatagttgatgacagtgggaagccagtgggtcccatagtggatggggatgctgttgtgacaatgaatttccgagcagatcgtatggttatgcttgcaaaggctctggaatatgaagactttgataaatttgaccgtgtccgagttccaaagatccgctacgctggaatgctacagtacgacggggagttgaagcttcctaatcgttatcttgtttctcctccactgatcgagagaacatctggtgaatatctagtgaagaatggtgttcgtacttttgcctgcagtgaaactgtcaagtttggccatgttacctttttctggaatgggaaccgatcgggatattttgacgaatctatggaagaatacgttgaaattcctagtgatagtggaattacgttcaatgttcagccaaagatgaaggcattggaaattgccgagagagctagagatgctattctcagtggcaagtttgaccagatacgtgtcaacctaccaaacagtgacatggtaggacatactggtgacattgatgcaactgtcgtggcttgcaaggctgctgatgaagctgttaagatgatccttgatgcaatagagcaggttggaggaatttatgttgtaacagcagatcacggaaatgctgaggacatggttaagaggaataaaaagggtgacccacttcttgataaggctggcaaaattcaaattctcacttcacacactcttcaaccagtcccagttgcaattggaggccctgggctggcttcaggtgtcagattccgtaaagatgtccccaatggtggccttgctaacgtagctgcaactgtcatgaatctccatgggtttgtggctccagacgattatgagacaactcttattgaggttgctgacagttagatttaatcaactatgattcagcactgcaggtggagattgagtattatcaaagtctaaataatcatattgtgatttattcctatttttatctgttggaatcacacaatgaccatagaattttgatttaatggaattgtcggaagatgactttgtagaagtattattattatgacggttcagctttttggttttattatataaatatgcacattttgagtcatttcgttctgttatatattgcaaacttat

SEQ ID NO: 5189 - DNA, 1694 bp, Aquilegia formosa
aaatgggtagctcagagttttcatggaaattggcggatcatccaaagttaccaaagggtaagcaaatagcattggttgttcttgatggatggggtgaagctaatcctgataaatataattgtatccatgttgctgaaactcctaccatggattccctcaagcagggtgcaccagagaaatggaggttggttagggcgcatggtaaagctgttggacttccaacggaagatgacatgggcaacagtgaagttggtcataatgcacttggtgctggaagaatatatgcccaaggtgccaagcttgtggatcttgcacttgcctcgggaagcatctatgatggagaaggttttaattacattaaacagtgctttgcttctggtacgttgcacctaataggactattgagtgatggaggagtccattcaagaattgatcaattgcagttacttttaaagggagctagtgagcgcggtgccaaaagaatccgtgttcatatcctcactgatgggcgagattgtttagatggttcaagcattgggtttgtggagactcttgagaaggaccttgcagagttgagggcgaaaggtattgatgcacaaattgcatctggagggggtcgcatgtacgtcaccatggatcgttatgagaatgactggggtgtggtgaaacgtgggtgggatgctcaagttcttggtgaagcaccataccagtttaccagtgccgtagaagctgttaagaagcttagggaggctccaaacactagtgaccagtacttgcccccatttgttatagttgatgacagtgggaaaccagtgggtcccatagtggatggggatgctgttgtgacaattaattttcgagcagatcgtatggttatgcttgcaaaggccctggaatatgaagactttgataaatttgaccgtgtccgagttccaaagatccgctatgctggaatgctacagtatgacggggagttgaagcttcctagccattatctcgtatctcctccactcatcgagagaacatctggtgaatatctagtgaagaacggtgttcatacttttgcctgcagtgaaactgtcaagttcggccatgtcacctttttctggaatgggaaccgatcaggatattttgatgaaactatggaagagtacgttgaaattcctagtgatagtggaattacgttcaatgttcagccaaagatgaaggctttggaaattgccgagagagctagagatgctattctcagtggcaagtttgaccaggtgcgtgtcaacttaccgaatagtgacatggttggacatacaggcgatattgatgcaactgtcgtggcttgcaaggctgctggtgaagctgttaagatgatccttgatgcaatagagcaggtgggaggaatttatgttgtgaccgcagatcacggaaacgctgaggacatggtgaagaggaataaaaagggtgatccacttcttgataaggctggcaacattcaaattctcacttcacacactcttcaaccagtcccagttgcaattggaggccccggactggcttcaggtgtcagattccgtaaagatgttccagatggtggtcttgccaacgttgctgcaacggtgatgaatctccacgggtttgttgctccagaagattatgagacaactcttattgaggttgccgagaattagaatttatcaact

SEQ ID NO: 5190 - DNA, 2032 bp, Mesembryanthemum crystallinum
gcacgagcttattggccttttccccttctcagttaccccctcaaatctcaaactttgttttggaaaacccatttgatttcatcaaggaagaaagagagagagagatgggaagtacagagttctcatggaaattggctgatcacccaaagcttcccaagggaaagactttggcaatggtggtgcttgatggatggggtgaagccagcgctaatcagtacaattgtatccatgttgctgaaactcccaccatggattcacttaagcagggggcccctgaaaaatggaggttgattagggctcatggtaaagctgtagggcttccaactgaggatgacatgggcaacagtgaagttggtcacaatgctcttggcgctgggcgtatatatgctcaaggggcaaagcttgttgatctcgctcttgaatcaggaaaaatctatgatggagaaggctttaattatatcaaggagtcttttgagacaaacacgttacatctcattgggttgttgagtgatggaggtgtacattcacgtcttgatcagttacagttgttgctgaaaggatctgctgagcgcggtgccaagaggatccgagttcatattcttactgacggtcgtgatgttctggatggaagtagtgttggctttgttgagactcttgaaaatgatcttgcgcaattacgtgctaaaggtgttgatgcacagattgcatctggtggtggcagaatgtacgttacaatggatcgttatgagaacgattggagtgttgtgaaacgaggatgggatgcccaggtgcttggtgaagctccatacaagttcaaaaatgcagttgaggctgtcaagacactaaggcaggagcctaaagctaatgaccagtacttaccaccttttgtagttgtcgatgagagtggaaaggctgttggtccaatagttgacggtgatgctgttgttacacttaatttccgggctgatcgtatggttatgcttgccaaagcacttgaatatgaggattttgataagtttgacagagttcgtttccctaaaatccgttacgctggtatgcttcaatatgatggcgagttgaagcttcctaaccgttaccttgtttctcctcccgaaatagagagaacttcaggggaatatttagtccacaatggtgtgcgtacttttgcttgcagtgagactgtcaagtttggtcacgtcaccttcttctggaatgggaaccgctcaggatacttcaaacctgaaatggaggaatatgtggaaattcctagtgatagtggtatcaccttcaatgtccaacctaagatgaaggctttggagattgctgagaaggcaagggatgcgattctcagcggtaaattcgatcaggttcgtgtcaacctacccaatagtgatatggtcggccatactggtgatatagaagctaccgtcgttgcttgcaaggctgcagatgaagctgtcaagatgatcattgatgcaattgagcaagttggtggaatatatgttatcactgctgaccatggaaatgctgaagacatggtgaagagggacaagaaaggacaacctgctatggacaagaatggaaacattcagattcttacatctcacacactagaaccggtgcccattgctatcggaggtcctggcctcactcctggtgtgagattccgcaatgatattcctaccggcggtcttgccaatgtggctgctactgtgatgaatcttcatgggtttgaggctcctagcgattacgagccaaccctcatcgaggtcgtcagcaactagatggagaaacaacagtatttatgagagttagattaattaatttctgaattttgacttggagggaccatgccatgtgaatgtggctcgcctcattcctgatttttgaggtcaaataaggccccttacatcgttttgtagttacaaaagctactataagaagacgatagagctttgatatagatggcaatacttttaccttgtattgatttgagatgcaccaaagcaatgtcattatgtttttttgtatc

SEQ ID NO: 5191 - DNA, 1707 bp, Secale cereale
gagaaaaaaaaagcaaaggagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcatggattcgctcaagaatggtgctcccgagaagtggagactagtgaaggctcatggaactgctgttggtctcccaagtgacgacgacatgggcaacagtgaagttggccacaatgcccttggcgctggtcggatctttgctcagggtgcgaagcttgttgatgctgctcttgcttccgggaagatttgggaagacgaggggttcaattacatcaaagaatcttttgacaagggtactctgcaccttattggtctgttgagtgatggaggcgtccactcccggctagatcaagtgcagttgatttgcaaaggtgccagtgagagaggagcaaaaagaatccgccttcatattcttactgatggacgtgatgttttggatggcagtagtgttggtttcgttgagacaattgagaaagatcttgctcagcttcgcgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgtgttcgtgtaccaaaaattaagtacgctgggatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgatcaggtgcgtattaacctgccaaacggtgacatggttggtcacactggtgatattgaagccacagttgttgcttgcaaggctgctgatgaagtctgtcaaggtggtcttgtatgctgtggagcaagttggtggtatctatcttgtcacagctgatcatggaaacgcagaggatagtgggttaagaggaaacaagctaggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagttgttgacaagtaaaaaaaaca

SEQ ID NO: 5192 - DNA, 1958 bp, Gossypium hirsutum
aatcctttcactattctcgccgtcgtcttctcctctcgtttttccatattttttctttcccttaatatatataaccatcatcaaaccttcattcaaatcttaattaaaatacaaacattcgaagcttaacaacaatggcgagttcaggacaagtatcgtttaaattagaggaccacccaaagcttccaaagggaaaacgtatcgccgtcgtggtcctcgatggttggggcgaatataaacccgatcaatacaattgtatccatgttgctcaaacacccaccatggattccctcaaacagggtgctccggacagatggagattaatccgagctcatggaaatgctgtagggcttccgacagaggatgacatgggaaacagtgaagtgggtcacaatgctctcggtgcaggccgcattttcgctcaaggggctaagcttgttgatcttgctcttgcctcggggaagatctatgatggtgaaggatttaagtatataagtgaatcttttgagaagggtacccttcacttgatcggattacttagcgatggaggtgttcactcccgtctcgatcaattgcagttgttgctgaagggagctagtgagcgtggtgctaaaagaatccgtgttcatgttctcactgatggtcgtgatgttttggatggttcgagtgtaggctttgtggagactctggagaatgaccttgcaaagttacgtgaaaaaggtgtagatgcccgcatcgcatctggtggtggccgaatgtatgtcacaatggaccgttatgagaatgattgggatgttgttaaaagaggatgggacgctcaagttctcggtgaagccccacacaagtttaagaatgccgttgaagctgtaaagaaactgagagaaaatgccaatgaccagtatttacctccctttgtcattgttgatgataacaacaaggctgtgggtccgatagtagatggtgatgctgttgttaccattaatttccgagcagatcgaatggttatgcttgctaaggcacttgaatatcaagatttcaacaaatttgatcgtgtacgggtccctaaaatccgttatgctggaatgcttcagtatgatggcgagttgaagcttccgagccgctaccttgtttctcctccagagattgatagaacatcgggtgaatatttggtgcataatggtgtccgtacttttgcctgcagtgagactgtcaaatttggccatgtcactttcttctggaatgggaatcgctccgggtatttcaatcctcaaatggaagaatatgtggaaatcccgagcgatgttggcattacgttcaatgttcaacctaagatgaaggcattggagatcggtgaaaaggctagggatgctattctgagtgggaaatttgaccaggtacgtgtgaacataccaaatggtgacatggtgggtcataccggagatatcgaggctacggttgtggcatgcaaggctgccgatgaagctgtcaagatgatcctcgatgcgatagagcaagttggcggaatatacattgtgactgcagaccacggtaacgccgaggacatggtgaagagaaataaatccggggaacctcttctcgacaagaatggagatctccagatactcacctcccacacttgtcaacctgtgcctattgcgatcggaggtccaggattggcacccggtgttagattccgcagcgatgttccgaatggtggacttgcaaacgtggctgcaaccgtcatgaatctccatggtttcgtagctccgaatgactacgagacaacactcatcgaagtggctgacaactaggctcgccgatagaacattgcctcgatttttatatatttgctctgttcctatacccaaacatcaatttagaataaggttcaaaatgttatatttttgttcttttttggccaaaaaacgttatatttttgttagacaattgtggttgaa

SEQ ID NO: 5193 - DNA, 2029 bp, Eschscholzia californica
atcctgcttaattttgccctaattattaacgcccacctatcaaactctttctatactactataaatacccaaatctgtggttagcttcttttcaaacaactttctccctctacaaacctcctcaaccagaaaaagatttttagtgagatgggtagctctgatatttcattgaaattggcggatcacccaaaacttccaaagggtaagactattgctttggtggttttggatggatggggtgaagctcatcctgatcagtttaattgcatccatgttgctcaaacacccaccatggattcccttaaaacgggtgcaccagagaaatggaggctagtaagagctcatggtaaggcggttggtctcccaactgaagatgacatgggtaacagtgaagtcggtcataacgcacttggtgctggtcggatttttgctcaaggtgccaagcttgtggattcagcacttgcctcaggaaaaatctatgacggagagggttttaactacatcaaagagagtttcgctaacaatacacttcaccttattgggttattgagtgatggtggtgttcactctcggcttgatcaagtgcagttgttagtaaaaggtgctagtgaaagaggtgccaaaagaatccgtatccatattctcaccgatggacgtgatgttttggatggttcaagtgtaggatttgtagaaactcttgagaatgaccttgcaaacctgcgggctaatggcgttgatgcacaaattgcatctggtgggggtcgcatgtatgtaacaatggatcgatatgagaatgactggggtgtggtaaaacgaggatgggatgctcaagttcttggtgaagcaccatacaagtttcagaatgcagttgaagctgtcaagaagctgaggcaagaacctaaggccaatgaccaatacctacctccatttgttatagttgatgaaagtgggaaggcagtcggtccagtagtggatggtgatgctgtagtgacattcaatttccgagcagaccgaatgactatgcttgctaaggcacttgaatacgaagatttcaataattttgaccgtgttcgattcccaaagatccggtacgctggaatgctccagtatgatggtgagttgaagcttccaaaccattaccttgtctcacctccagagattgacagaacatcgggtgaatacttggtccacaatggcgtccgtaccttcgcctgcagtgagactgtgaagtttggacacgttaccttcttctggaatggaaaccgttccggatatttcaatgaagctctagaagaatatgtagaaattccaagtgacagtggtattacattcaatgtccaaccaaaaatgaaggccttggaaattggtgagaaggcaagagatgccattctcagtggcaagttcgaccaggtacgtgtgaacatacctaatagtgatatggtaggacatacaggtgacattgacgccactgtcgtggcttgtaaagccgctgatgaagctgttaagatgattcttgatgcaatagagcaagtaggtggaatttatgttgttactgctgatcatggtaatgctgaggatatggtgaagaggaacaagaaaggagaacctcttttagataaagagggcaagattcaaatccttacttctcacactcttcagcctgttccagttgcgattggtggacctggtctgactgcaggagttagattccgtaacgatgtcccagaaggtgggctagccaatgtagctgcaactgtcatgaatcttcatggatttgtggctccaagcgattatgagactactctcattgaggttgctgaaaactagaaaaagttaccagactttctcactgatggagtttgtccgctgatgaaagtagagattaactatttaagtacattttgtttcttaatattattttggggcgctcgagtacacgcacaattgtgagagtgcgtgtgaagcggtatttgtagcttgtttggtatcttcttctgttgcagagaggatgaagattatgcaactcaga

SEQ ID NO: 5194 - DNA, 2022 bp, Carpinus betulus
tttgtgaacatggggacctcaggaatctcgtggaaattgccggaacacccaaagcttccaaagggtaagaccgtggccgtggttgttttggacggctggggcgaggccaagcccgatcagtacaactgcatccatgtggcggatacacccaccatggattccctcaaacagggtgctcctgagaagtggaggttggttagagctcatggaaaggccgtaggccttccaacagaggatgacatgggcaacagtgaagttggtcacaatgcacttggggctggtcgcatatttgcccaaggtgcaaagcttgttgaccttgctcttgactctggaaaaatttatgaaggagaaggttttaagtacataaaggaatgtttcaaaaatggcacattgcatctcattggcttattgagtgatggtggagtccactccaggcttgatcagttgcagttattgcttaaaggagctagtgagcgtggtgctaaaagaatccgtgttcatattcttaccgatggtcgtgatgttttggatggttcgagtataggatttcttgaaattcttgagaatgaccttgcaaaactacgtgagaagggtgttgatgcacagattgcatctggtggtggtcgtatgtatgtcacaatggatcgttatgagaatgactgggatgttgtcaaacgaggatgggatgcccaagttcttggtgaagccccttacaaatttagaaatgctattgaagctgtcaagaaactgagggaggagctaaaggttaatgaccagtacttgcctccatttgttattgttgatgagaatgagaagcctgttggtcctatagttgatggtgatgctgtggttacaatcaacttccgagcagatcgtatggttatgattgctaaggcacttgaatatgaagattttgacaagtttgatcgagttcgattccctaaaatccgttatgctggtatgcttcaatatgatggcgagttgaagctcccgagccattacctagtttctcctccagagatagagagaacgtctggtgaatatctagtgcacaatggtgtccgtacttttgcttgcagtgagactgtcaaatttggtcatgtaaccttcttctggaatggtaaccgctctggatatttcaatccagaactggaggaatacgtggaaattccaagtgatagtggaattacattcaacgtccagccaaagatgaaggcattggagattgccgagaaaacgagagatgctatacttggcggaaaatttgaccaggtgcgtgttaacctgccaaatggtgacatggtggggcatacaggtgatattgaggccacggttgtggcttgcaaggtcgctgatgaggctgtcaagattatccttgatgcaatagaacaagtgggtggaatttatgttgttactgcagatcacgggaatgctgaggacatggtcaagaggaacaagtccgggcaacctcttctcgacaagaatggcaaacttcaaatactcacttctcacaccctcgaaccagttccaattgcaattggaggtcctggattggcacctggtgtcaggttccgcaaggatcttcccaatggtgggcttgccaatgttgctgcaactgtgatgaatctccatgggtttgaggctcctagtgactatgagccaaccctcattgaagtcgttgataactaggacagcatagagaatgagctctttaatgccccaattaaatgagccgaccttcaccaaattcagaggccgtggggcacaagcacgcaatcttgataaataagttaaattttcttatttatgtcaccattacggtggctttagtattttgaatcaactttttgattgctgtctgtggaggtcgacagaacaggatagttaaaatggaatttttgtttcaaatttttcaatcatgattgtcgtcatgatgcggctgtttcagacacacctgttttagattggatcgttttcaagtgaaatcttgatagacttgatctattaattagcatatgtatg

SEQ ID NO: 5195 - DNA, 1959 bp, Cucumis sativus
aaatttaatcgtgatggggagttctggattctcatggaaattgcctgatcatcctaagcttcctaaggataagacaattggtcttattgttttggatgggtggggtgaagctaacccagatcgctacaattgtatccatgttgctgacactcccaccatggattcgcttaagaagggagcacctgagcattggaggctgcttaaagcgcatggtaaggcagtaggactgcctactgaagatgacatgggtaacagtgaagttggacataatgcacttggtgctggacgtatttatgctcaaggtgcaaagcttgttgaccttgctcttgaatctggaaaaatatatgatggagaaggtttcaaatacatcaaggaatcctttgagaccggcactttgcatcttataggattactgagtgatggtggagtccactctaggctagaccaggttcagttgttactcaaaggagcaagtgagcgtggtgccaaaagaatccgtgtccatatacttacagacgggcgtgatgttttggatggttcaagtgtaggctttgtagagactcttgaaaatgatcttgccaaattacgtgagaaagggattgatgcacaaatagcatctggtggaggccgtatgtatgtgactatggatcgttatgagaatgattgggaagttgtgaagcgaggatgggatgcacaagtgcttggcgaagcaccacacaagtttaaaagtgctcttgaagctgtcaagacattaagagcggaacccaaagcaaatgatcaatatctacctccatttgtcatagttgatgatagtgggaagtctgtaggtccaattgtggatggtgatgcagtagttaccttcaattttagagcagatcgaatggttatgattgccaaggcccttgagaacgaaaattttgataaatttgaccgagttaggttccctaaaattcgttatgctggaatgctccagtatgatggtgaattgaagcttccaagccattaccttgtttctcctccagagattgagagaacatctggggaatatcttgtgcacaatggtgttcggacctttgcctgcagtgagaccgtcaagtttggtcatgttactttcttctggaatggaaaccgttctggatatttcaacccagaaatggaagaatatgtggagattcctagtgattccgggatcacttttaatgttcagccaaagatgaaggctatagaaatcgctgagaaagcaagagatgctattcttagtcggaaattccaccaggtacgtgttaacctaccaaacggtgacatggtgggtcacactggtgatattgaggccactgttgtagcttgcaaggctgctgatgatgctgtaaaaatgatccttgatgcaattgaacgagtagggggaatttacgtcgtcactgcagatcatggaaatgcagaggacatggtgaagagaagcaagtctggggagcctcttcttgacaaaaacggcaaaattcaaatcctcacttctcacactcttcagccggttcctattgcaattggaggtccaggactggcccctggagttagattccgtaatgatgttcctactggagggttggccaatgttgctgcaactgtgatcaatctccatggctatgaagcaccaagcgactatgagacgactctaattgaagttgtggatagttaagcgagtgagatggaaagttcagttattcgagtaagattatgtttttacaattaatggagcgagagaagactagcaatgggctatgcatgctaggtggtggaataagtaactcttctttttgatccttggattcattttccttgtttatggtctgtctatgttaaactagaccatgaaagggagaggctatagttcaactgagaaattttgttgactcgtgaagattttaatagctaagttgagggttgaacaaccctccaattttc

SEQ ID NO: 5196 - DNA, 1876 bp, Fraxinus spp
ggccgggggggaaagagacatgggtagctctggattttcatggaattgaacgacgccaaactgccaagggaaaatcatagcggttgtggttttggatggatggggtgaggccaacccaatcagtacaactgcattcatgtcgccgagactcctgccatggattcactgaaaaagggtgcgcctgagaaatggagattggtgaaggcgcacggtaaagccgtggggctgcccacagacgacgatatgggcaacagtgaggttggtcacaatgctcttggtgctggccgaattttcgcacaaggcgctaagcttgttgatttggctcttgcctctggaaaaatctacgaaggagaaggtttcaagtacataaaggaatcttttgaaactggaacattgcacctcattggactattaagtgatggaggtgtccactctaggcttgatcagctgcagttgttactaaaaggagctagtgaacatggtgcgaaaagaatccgtgttcatgttctcactgatggacgtgatgttttggatggcacaagtgtaggctttgtagaaactcttgaaaatgatctttcaaagctgcgtgagaaaggtgttgatgcccagattgcttccgggggaggtcgcatgcaggtcacaatggatcggtatgagaatgattgggacgttgtcaaacgaggttgggatgcccaagtgcttggagaggcaccacacaagtttaagagtgctgttgaggctgtcaagaagctgagagaagctcctaatgctaatgatcagtacttgcctccatttgttattgttgatgacaatggaaagctgttgggcctattgtagatggtgatgctgttgttacagtcaactttcgggctgatcgtatggtaatgctagccaaggcacttgagtatgaggatttcgataaatttgatcgagttcgacttccccaaaattcgttatgcaggaatgcttcagtatgatggtgaattgaaacttccaagtcactaccttgtttctcctcccgagattgatagaacatctggggaatattagtacataatggtatccgtacttttgcttgcagtgaaacagtaaaatttggtcatgtcacctttttttggaatggtaaccgctcaggatactttaaccaagaaatggaagagtatgttgaaattcccagtgatagtggtattaccttcaatgtccagcctaagatgaaggccttggaaatagctgagaaggctagggatgccatccttagccgcaaatttgaccaggtacgtgttaacctacctaacagtgatatggttggacatactggtgacattgaagcaacaattgttgcttgcaaagctgctgatgatgctgttaagatgatccttgatgcaatagaccaagtgggtggaatatatgttgttactgctgatcatggaaatgcagaggacatggtgaaaaggaacaagaagggcgagcctcttcttgacaagaacggcaacatccaaatacttacttctcacactcttgaacctgttcctgttgcaattggtggtcctgggctggcacctggtgtgagattccgcaaagatgttcctgaaggtggacttgcaaatgtcgctgcaactgtgatgaacctacacggacttgaggcacctgctgattacgagccaaccctgattgaggttgttgacaactaggcggctagccggtaccaatttaaatgttaactctaggagaaagtaatggtgagaatgcactatttattgtcttaaataagtacttttgcttaaatgctgattttttatctttcagcagcattgcatgtaagacatatcggcgccactaagttgtgattgacaataaaacatttcaaggtttaatc

SEQ ID NO: 5197 - DNA, 2018 bp, Vaccinium corymbosum
atttatatacagatttggaatagatttgagagatgggtacctcaggattttcatggaaactggaagatcacccgaagctcgaaaagggtaaggtcatagccttgattgttttggatggttggggcgaagccaatcccgatcagtacaattgtatccatgttgctgaaactcccgtcatggattccctcaaaacgggtgctcctgataggtggagattggtgagggcacatgggaaggctgtggggcttccgacggaggatgacatgggaaacagtgaagttggtcacaatgcacttggtgccggacggatttatgctcaaggggcaaaacttgttgaccttgctcttgcctctgggaaaatttacgatggagaaggttttaattatatcaaggaatcttttgaaactggcacattgcacctcattggtttattgagtgacggtggtgttcactcccgacttgaccaattgcagttgttgatgaaaggagccagtgagcgtggtgctaaaagaataagagttcatattcttactgatgggcgtgatgttttggatggttcaagtgtgggctttgtggaaacccttgagaatgatctctcaaaattgcgtgagacaggtgttgatgcccagattgcatctggtggaggtcgcatgtatgtcaccatggatcgttacgagaatgactggagtgttgtgaaacgtgggtgggatgcccaagttctgggtgaagccccttataaattcaagagcgctcttgatgctgtcaagacattgaggcaggatccaaaagcaaatgatcaatacttgcctccttttgttattgttggtgaagatgggaaggctgtcggtccaatagtggatggcgacgctgttgtgactgtcaacttccgtgcagatcgcatgactatgcttgctaaggcacttgaatacgaaaactttgataaatttgatagagtgcgattccctaaaatccgatatgcgggaatgcttgagtacgatggggagttgaagcttccaaagcgctatcttgtttctcccccagagatagagaggacatctggtgaatatttgacccataatggcgtgcgtacttttgcttgcagtgagactgtcaaatttggtcacgtcactttcttctggaatggaaatcggtctgggtactttaatgcggagatggaagaatacgtggaaattcctagtgattctggaattacatttaatgagcaacccaagatgaaggccttggagattgctgagaaggctagggatgctattcttagccgcaaatttcaccaggtacgtgtgaacctaccaaatagtgacatggtggggcatacaggtgacattaaagccacagttgtggcttgcaaggctgctgatgaagccgtgaagatgatacttgatgcaatagagcaagtgggtggaatatatgtggttactgctgatcatggaaatgctgaggacatggtgaagaggaacaagaaggggggtcctctacttgacaaggacggcaatattcaaatcctgacttctcacactcttcagccagtgcctattgcaattggaggtccagggctagcacctggtgtgagattccgcaaggatgttcctgaaggagggctggctaatgtggctgcaacggtgatgaatctccatggatttcttgcgcctagcgattacgagacaaccctaatcgaggttgctgataactaggtcgactaagtgagagttagaaacttcctacgaaatttttgactgaagcaaagctagctatgcaacgattaagttgcattagcctattgtatgtgaggaatgagacagctttagagtttttcttaaataatgatctaaagaactagaagatcacataatcatgctactacgaaagtggatagccttacagattatgttatttcaattatggatatgcatcctgtattgttcaacttgggcatttgccaatgggatatattgattttgttggttaagagattttgaactggctgcttccgattcgtt

SEQ ID NO: 5198 - DNA, 2309 bp, Gossypium raimondii
gaggatgattacgttgcgagagagatttttcaaaaaagaaaaaatttatggatgtgtgtaatcacgtggtactgccatgctttgtctctacgccaccagtttagtttaaaaggtcaaaatctttgaatcctttcactattctcgccgccgtcttctcctctcgtttttccattttttttctctcccttattatatataaccatcatcaaaccttcattcaaatcttaattaaaatacaaacattcgaagcttaacaacaatggcgagttcaggacaagtatcgtttaaattagaggaccacccaaagcttccaaagggaaaacgtatcgccgtcgtggtcctcgatggttggggcgaatataaaccagatcaatacaattgtatccatgttgctcaaacacccaccatggattccctcaaacagggtgccccggacagatggagattaatccgagctcatggaaatgctgtagggcttccaacagaggatgacatgggaaacagtgaagttggtcacaatgctctcggtgcaggccgcattttcgctcaaggggctaagcttgttgatcttgctcttgcctcggggaagatctatgatggtgaaggatttaagtatataagtgaatcttttgagaagggtacccttcacttgatcggattacttagcgatggaggtgttcactcccgtctcgatcaattgcagttgttgctgaagggagctagtgagcgtggtgctaaaagaatccgtgttcatgttctcactgacggtcgtgatgttttggatggttcgagtgtaggctttgtggagattctcgagaatgaccttgcaaagttacgtgaaaaaggtgtagatgcccgcatcgcatctggtggtggccgtatgtatgtcacaatggaccgttatgagaatgattgggatgttgttaaaagaggatgggacgctcaagttctcggtgaagccccacacaagtttaagaatgccattgaagctgtaaagaaactgagagaaaatgccaatgaccagtacttacctccctttgtcatcgttgatgataacaacaaggctgtgggtccgatagtagatggtgatgctgttgttaccattaacttccgagcagatcgaatggttatgcttgctaaggcacttgaatatcaagatttcaacaaatttgatcgtgtacgggtccctaaaatccgttatgctggaatgcttcagtatgatggcgagttgaagcttccgagccgctaccttgtttctcctccagagattgatagaacatcgggtgaatatttggtgcataatggtgtccgtacttttgcctgcagtgagactgtcaaatttggccatgtcactttcttctggaatgggaatcgctccgggtatttcaatcctcaaatggaagaatatgtggaaatcccgagcgatgttggcattacgttcaatgttcaacctaagatgaaggcattggagatcggtgaaaaggctagggatgctattctgagtgggaaatttgaccaggtacgtgtgaacataccaaatggtgacatggtgggtcataccggagatatcgaggctacggttgtggcatgcaaggctgccgatgaagctgtcaagatgatcctcgatgcgatagagcaagttggcggaatatacattgtgactgcagaccacggtaacgccgaggacatggtgaagagaaataaatccggggaacctcttctcgacaagaatggagatctccagatactcacctcccacacttgtcaacctgtgcctattgcgatcggaggtccaggattggcacctggtgttagattccgcagcgatgttccgaatggtggacttgcaaacgtggctgcaaccgtcatgaatctccatggtttcgtagctccgaatgactacgagacaacactcatcgaagtggctgacaactaggctcgccgatagaacattgcctcgatttttatatatttgctctgttcctatacccaaacatcaatttagaataaggttcaaaatgttatatttttgttctttttttggccaaaaaacgttatatttttgttagacaattgtggttgaagtgtttttccaggaaaactttgggcttcattgcccctttttctttaaatttgacctcataattttcccttttaatggggccattttctgatgtttgctgagggtcggccttgatcggttcgtagacaatgttattgtaatgtaatgctttgcagacactgtgtgtattgagttttttccccaaatataattttatgaaattaaaagtattttattatctttatta

SEQ ID NO: 5199 - DNA, 2034 bp, Papaver somniferum
tgtggttggggtttttgtctcttaaatctttttctctccgactcaaaaacacaaacaccaacaaacaaagatgggaagtgctgaagtctcattcaaattggcggatcatccaaagcttcctaaagggaaggtagtagctcagattgtgttggatggatggggagaagctaatcccgaccagtttaactgtatccatgttgctcaaacaccaaccatggattctctaaaacaaggtgcacctgagaagtggagattggtaagagctcatggtaaggcagttggtctcccaactgaagatgacatgggtaacagtgaagttggacataatgcccttggtgctggaagaatttttgctcaaggtgccaagcttgttgacattgcacttgcctcgggaaagatcttcgatggagaaggctttcagtacatcaaggaatcctttaaggatggcaccctccacctaattgggttattgagtgatggaggtgtccactctcgaattgatcaagtgcagttgctattaaaaggagccagcgagaggggtgccaaaagaatccgccttcatattctcaccgatggtcgtgatgttttggatggttcaagtgtagggtttgttgaaactattgagaatgaccttgcacaactgcgagcaaatggcgttgatgcacaaattgcatctggtgggggtcgcatgaatgtcacaatggaccgttatgagaacgactggggtgttgtgaaaagaggatgggatgctcaagttcttggtgaagcaccatacaaatttaagagtgctttagaagcagttaagacactgagggcagaaccaaaggccaatgaccaatacttgcctccatttgttatagttgatgatagtggcaaggctgttggcccagttttggacggtgatgctgttgtgactttcaacttccgtgcagatcgtatgactatgcttgctaaggcccttgaatacgatgacttcaaggattttgaccgcgttagattcccgaagatccattatgctggtatgctccagtatgatggtgagttgaagcttccaaacaaatacctagtttcaccaccagagattgatagaacatctggtgaatacttggtgcacaatggtgtccgtacttttgcctgcagtgagactgttaagtttggacatgttaccttcttctggaacgggaacagatctggatactttaaagaagatatggaggaatacgttgaaattccaagtgatagtggaattacattcaatgcccagccgctaatgaaggccttggaaattggtgagaaggcaagggatgctattcttagtggcaaattcgaccaggtacgtgtcaacattccaaacagtgacatggttggacacactggtgacattgaggcaactgttgtcgcttgcaaggctgctgatcaagctgttaagatgattattgatgcgatcgagcaagttggtggaatttatcttgttactgccgatcatggtaatgctgaagatatggtgaagaggaacaaaaaaggtgaacccctgctagataaaaatgggaacattcagatcctcacttcccacactcttcaaccagtcccagttgccattggtgggcctggtctagctccaggagttagattccgcagtgatgttcctgagggtggtctcgccaatgttgctgcaacaatgatgaacctccatggatttgtggctccagatgactatgagacaactctaattgaggtcgtctagaaaactgttaatttgaaaaatcactcacagggtccgcagaggaagagataaattatacttgcttatcggagtgattatgtatttttacttgatattgagcgctcaactagtcacgctgttcttagtgcgtgtgaagcggtgttttacatcataatgtgcaaaacagttttttgtttttgtttcattttgagagactcctatgaagaggggataatgtcataatttaatctcagaatagaattttatgaatgatattctttcttgatagaatcaatgatgaaatcagtttt

SEQ ID NO: 5200 - DNA, 2008 bp, Papaver somniferum
tttttctctctgactcaacgaaaacacaaacaccaacaaacaaagatgggaagtgctgaagtttcattcaaattggcggatcatccaaagcttcctaaagggaaggtaatagctcagattgttttggatggatggggagaagctaatcctgaccagtttaactgtatccatgttgctcaaacaccaaccatggattctctaaaacagggtgcacctgagaagtggagattggtaagagctcatggtaaggcagttggtctcccaactgaagatgacatgggtaacagtgaagttggacataatgcccttggtgctggaagaatttttgctcaaggtgccaagcttgttgacattgcacttgcctcgggaaagatcttcgatggagaaggctttcagtacatcaaggaatcctttaaggatggcaccctccacctaattgggttattgagtgatggaggtgtccactctcgaattgatcaagtgcagttgctattaaaaggagccagcgagaggggtgccaaaagaatccgccttcatattctcactgatggtcgtgatgttttggatggttcaagtgtagggtttgttgaaactattgagaatgaccttgcacaactgcgagcaaatggcgttgatgcacaaattgcatctggtgggggtcgcatgtatgtcacaatggaccgttatgagaacgactggggtgttgtgaaaagaggatgggatgctcaagttcttggtgaagcaccatacaaatttaagagtgctttagaagcagttaagacactgagggcagaaccaaaggccaatgaccaatacttgcctccatttgttatagttgatgatagtggcaaggctgttggcccagttttggacggtgatgctgttgtgactttcaacttccgtgcagatcgtatgactatgcttgctaaggcccttgaatatgatgacttcaaggattttgaccgcgttagattcccaaagatccgttatgctggtatgctccagtatgatggtgagttgaagcttccaaacaaatacctagtttcaccaccagagattgatagaacatctggtgaatacttggtgcacaatggcgtccgtacttttgcctgcagtgagactgttaagtttggacatgttaccttcttctggaacgggaacagatctggatactttaaagaagatatggaggaatacgttgaaattccaagtgatagcggaattacattcaatgcccagccgctaatgaaggccttggaaattggtgagaaggcaagggatgctattcttaatggcaagttcgaccaggtacgtgtcaacattccaaacagtgacatggttggacacactggtgacattgaggcaactgttgtcgcttgcaaagctgctgaccaagctgttaagatgattattgatgcgatcgagcaagttggtggaatttatcttgttactgccgatcatggtaatgctgaagatatggtgaagaggaacaaaaaaggagaacccctgctagataaaaatgggaacattcagatcctcacttcccacactcttcaaccagtcccagttgccattggtgggcctggtctagctccaggagttagattccgcagtgatgttcctgagggtggtctcgccaatgttgctgcaacaatgatgaacctccatggatttgtggctccagatgactacgagacaactctaattgaggttgtctaggagactgttaatttgaaaaatcactcccagggtctgcagaggaagagataaattagagtcagaatacaagaacttgcttatcggagtgtttatgtatttttttactcgatattgagcgctcaactagtcacgctgttcttagtgcgtgtgaagcggtattttacatcataatgtgcaaaacagttttttgtttttgttttattttgagactcctacgaagaggagataatgtcataatttaatctcagaagaatagagttttataaatgatattcgttcttgatagaat

SEQ ID NO: 5201 - DNA, 2074 bp, Sesamum indicum
ctcagagtcttctcaatctgttctttggttttcactccttaaccttttctgcaagaatttgctcttagaacagcacaagaaaatcgagatgggtagctctgaattttcatggaaattgaaggaccacccaaagcttcccaaggggaagaccatagcgatggtggttttggatggatggggtgaggcaaatcccaacaagtacaattgcatccatgtggctgagactcccaccatggattcactcaaaaatggtgcccctgataaatggagattggtgaaggcccatggtaaggcagtggggctgcccacagatgatgacatgggcaatagtgaggttggccacaatgctcttggtgctggcaggatttatgctcaaggtgctcagcttgtcgatattgctcttgaaactggtaaaatctacgacggagaaggtttcaagtacatcaaagagtcttttgaaactggaacactacatctcattggattattaagtgatggtggtgtccactctagactcaatcagttacagttgttgctcaaaggtgctagtgagcgtggtgctaaaagaattcgcgttcatattctcactgatggacgtgatgttttggatgggtcaagtgtaggctttgtggaaactcttgaaaatgatcttgcaaagctacgtgaaaaaggtgttgatgctcaggttgcatccggtggaggtcgtatgtatgttacaatggatcgatatgagaatgattgggatgttgtaaaaagaggatgggatgcccaagtgcttggagaagcaccacacaagtttaagaatcctgttgaagctgtcaagaaacttagagagattcctaatacgaacgaccagtacttacctccctttgttattgttgatgaaaatgggaaagctgttgggcctattgttgatggtgatgcagttgtaactttcaactttcgggctgaccgcatggttatgattgccaaagcacttgagtatgagaactttgataaatttgatcgagttagattccctaaaattcgttatgctggaatgcttcagtacgatggtgaacttaaacttccaagccgctaccttgtttctcctccagaaatcgaaaggacatctggagaatatttggtccataatggtgtccggacttttgcttgtagtgaaactgttaaatttggtcatgttacctttttctggaatgggaatcgctcgggatactttaacccacagatggaagaatatgttgaaattccaagtgatagtggtattacctttaatgtccagccaaagatgaaagcccttgagattgctgagaaggcaagagatgccatacttagccgcaaatttgaccaggttcgtgtcaacctccctaatggcgacatggtgggacacactggtgatattgaagcaacagttgtggcttgcaaggcagctgatgaggctgtcaagatgatcctcgatgcgatagagcaagtgggcggaatatatgtcgttactgctgatcatggaaacgccgaggacatggtgaaaaggaacaagaaaggcgagcctcttcttgacaagaatggcaacattcagatacttacttcccacacactagaacctgttcctattgcaattggtggccctgggctagcaccaggtgtgagattccgcaaagacgtccccaatggtgggctggccaatgtggctgcaaccgtgataaacctacatggttttgaggcacctagtgattacgagacgaccctcattgaggttgttgacaattaggttagctgatttctatttcaaaatttttgcagtggaggaagtgatgagcaagtatgggaatacactatgcccattgttttgaataagcaccgtactgaatcacatgctagtacacttgattattaacttaagcagcatttgatgctgaaattcagatgttaacgtgctgtgatttgacaattcaatgacttgaaatgtaattctcaagtattagactggttttgcaatacttttctgtcttttgcatttgcaatattctcatcgattctgtattgtacttgtgaagtattgaaattttaagctacc

SEQ ID NO: 5202 - DNA, 2271 bp, Citrullus lanatus
ctgatcttcctttatatactgcattcggttggatttagggttgttcttgttctgaaaaaagttgggtcctgccttttacctctcccttttgattgatacgctgctgcttcgtaagttgcttcttcgatttgcctcttggttcatagattcgattcaccttttttttttttttttttttattattattattattggtttgttgcttattaattgcgattcgttattctatattgctgttcttaagtgggatctgatttttcagaggaaatttaagcaaagaagatcgatggggagttctggattctcatggaaattgccggatcatcctaagcttcctaaggataagattgtgggtcttattgttttggatgggtggggtgaagctaacccagatcgttacaattgtatccatgttgccgaaactcccaccatggattcccttaagaagggagctcctgagcattggaggttgctcagggcacatggtaaggctgtaggacttcctactgaagatgatatgggcaacagtgaggttggacataatgcgcttggtgctggacgtatttatgctcaaggtgcaaagcttgttgaccttgctcttgcctctggaaaaatatatgagggggaaggtttcaaatacatcaaggaatcctttgaaaccggcactttgcatctcataggattactgagtgacggtggagtgcactctaggctagaccaggttcagttgttactcaaaggagcaagtgagcgtggtgctaaaagaatccgtgtccacatacttactgatgggcgtgatgttttggatggttcaagtgtaggctttgtagagactcttgaaaatgaccttgccaaattacgtgagaaaggggttgatgcacaaatagcatctggtggaggccgtatgtatgtgactatggatcgttacgagaatgattgggaagttgtgaagcgagggtgggatgcacaagtgctcggtgaagcaccacacaagttcaaaagtgctcttgaagccgtcaagaaattaagagaggaacccaaggcaaatgatcaatatcttcctccattcgtcatagttgatgatagtgggaagtctgtaggcccaattgtggatggtgatgcagtagttaccttcaattttagagcagatcgaatggttatgattgccaaggcccttgagtatgaaaattttgataaatttgaccgagttaggttccccaaaattcgttatgctggaatgctgcagtatgatggtgaactgaagcttccaagccattaccttgtttctcccccagagattgagagaacatctggggaatatcttgtgcacaatggcgttcggacctttgcctgcagtgagaccgtcaagtttggtcatgttactttcttctggaatggaaaccgttctggatatttcaacccagaaatggaggaatatgtggagattcctagtgattctgggatcacttttaatgttcagccaaagatgaaggctatagagatcgctgagaaggcaagagatgctattcttagccggaaattccagcaggtacgtgttaacctgccgaacggtgacatggtgggacacacgggtgatattgaggccacagttgtagcttgcaaggctgctgatgatgctgtaaaaatgatcctcgatgcaattgaacaagtagggggaatttacgttgtcactgcagatcatggaaatgcagaggacatggtgaagagaagcaagtctggggagcctcttcttgacaaaagtggcaaaattcaaatcctcacttctcacactcttcagccggttcctattgcaattggaggtccaggactggcccctggagttagattccgtaacgatgttcctaatggagggctggccaatgttgctgcaactgttatcaatctccatggttacgaagctccaagcgactacgagacgaccctaattgaagtcgttgatagctaagcgagcgacgtgggaagtttcaattattcgagtaagattacgtttttacaattaatcgagcaagaagactagcaatggttatgctaggttgtggaataagtactcttctttttgatcctcggattcatgttccttgtttatggtctgtctgtttaaaccagaccatgaagggagaggattagttcaactgagaaattttgttgactctgaagatttaatagctaagttgagggttgaacaaccttccagttttcaagtttgatgatattttgtctaattttgatgaatttgaatcttttattttc

SEQ ID NO: 5203 - DNA, 1979 bp, Ocimum basilicum
gtctgataataatcttcattaacggcgtaaggagatcgcgatgggtagctctggattctcatggaaattgaatgaccaccccaaactgccgaaggggaaaaccatagccatggtggttttggatggatggggtgaggctaatgccaatcagtacaactgcatccatattgccgaaactcccaccatggattcactcaagaagggtgctcctgaaaaatggagattggtgagggcacacggtaaggctgtggggctgcccacagaagatgacatggggaatagtgaggttggccacaatgctcttggtgctggcagaatttttgctcaaggtgctaaacttgttgatattgctcttgagaccggaaagatcttcgatggggatggttttaagtacatcaaggaatcttttgaaaccggcacactgcacctcattggattattaagtgatggaggtgtccactctcggctcgatcagttgcagttgttgctgaaaggtgttagtgagcgtggtgccaaaagaattcgttgtcatatacttactgatggacgtgatgttttggatggaacaagtgtcggctttgttgaaactctagaaaatgacctcgcaaagctacgcgagaaaggtattgatgcccagattgcctctggtggaggtcgcatgtatgttactatggatcgatacgagaatgactgggaagttgtcaagagaggatgggatgcccaagtacttggagaagcacctcacaagtttaagaatgccgttgaagctgtcaagaagctgagagagatccctaacacaaatgatcaatacttacccccatttgttattgttgacgatagtgggaaggctgtagggcctattgttgatggtgatgccgttgttactgtcaactatcgggctgatcgcatggtcatgattgcttcctcacttgagtatgagaagtttgataagtttgaccgagttcgattcccgaagatccgttatgctggaatgcttcagtatgatggtgaactcaaacttccaagtcactaccttgtttctcccccagaaatcgacagaacatctggggaatatctggtgcacaatggtattcggacattcgcgtgtagtgaaacagttaaattcggccatgtcacctttttctggaatggaaatcggtcaggatgcttcaacccgcagttggaagaatacgttgaaattcctagtgacagcggtatcacctttaacgtgaagcccaagatgaaagccttggaaattgctgagaaggcaagggatgccatccttagcggtaaatttgaccaggtacgtgtcaacctacctaacggcgacatggtgggacacactggcgatattgaagcaacaattgtagcttgtaaggctgctgatgaagccgtcaagatgatcctcgatgcggtagagaaagtaggtggaatatatgtagttactgctgaccatggcaatgctgaggacatggtgaaaagaaacaagaaaggcgaaccccttctcgacaagaatggccagattcaaattcttacttcccacacacttgaaccggttcctgttgcaattggtggccctgggttggcacccggtgtgagattccgcagcgacgtgcctaacggtgggcttgctaatgtggctgcaactgtcatgaacctgcacgggttcgaggcacccagtgactacgagactaccttgatcgaggtcgtcgacaagtaaaccagcaacgttatcgtttcagagttttgtagcggacgatgttagcgaataccattatcaagtgtgttgaataactactgtgctaggatttacctcctaggatagtttgattatgactgagccagcaaagtttttgctgaaatttgcaggctctcaagcctgtctgtgattgaagtactcagtgtttttgagccattatataacaaacaatcacattgttttcttaaaggtatccgccttctatgtgttgcttctcgtc

SEQ ID NO: 5204 - DNA, 2175 bp, Gossypium hirsutum
tttcactattctcgccgtcgtcttctcctctcgtttttccatattttttctttccttaatatatataaccatcatcaaaccttcattcaaatcttaattaaaatacaaacattcgaagcttaacaacaatggcgagttcaggacaagtatcgtttaaattagaggaccacccaaagcttccaaagggaaaacgtatcgccgtcgtggtcctcgatggttggggcgaatataaaccagatcaatacaattgtatccatgttgctcaaacacccaccatggattccctcaaacagggtgccccggacagatggagattaatccgagctcatggaaattctgtagggcttccaacagaggatgacatgggaaacagtgaagtgggtcacaatgctctcggtgcaggccgcattttcgctcaaggggctaagcttgttgatcttgctcttgcctcggggaagatctatgatggtgaaggatttaagtatataagtgaatcttttgagaagggtacccttcacttgatcggattacttagcgatggaggtgttcactcccgtctcgatcaattgcagttgttgctgaagggagctagtgagcgtggtgctaaaagaatccgtgttcatgttctcactgatggtcgtgatgttttggatggttcgagtgtaggctttgtggagactctggagaatgaccttgcaaagttacgtgaaaaaggtgtagatgcccgcatcgcatctggtggtggccgtatgtatgtcacaatggaccgttatgagaatgattgggatgttgttaaaagaggatgggacgctcaagttctcggtgaagccccacacaagtttaagaatgccgttgaagctgtaaagaaactgagagaaaatgccaatgaccagtatttacctccctttgtcattgttgatgataacaacaaggctgtgggtccgatagtagatggtgatgctgttgttaccattaatttccgagcagatcgaatggttatgcttgctaaggcacttgaatatcaagatttcaacaaatttgatcgtgtacgggtccctaaaatccgttatgctggaatgcttcagtatgatggcgagttgaagcttccgagccgctaccttgtttctcctccagagattgatagaacatcgggtgaatatttggtgcataatggtgtccgtacttttgcctgcagtgagactgtcaaatttggccatgtcactttcttctggaatgggaatcgctccgggtatttcaatcctcaaatggaagaatatgtggaaatcccgagcgatgttggcattacgttcaatgttcaacctaagatgaaggcattggagatcggtgaaaaggctagggatgctattctgagtgggaaatttgaccaggtacgtgtgaacataccaaatggtgacatggtgggtcataccggagatatcgaggctacggttgtggcatgcaaggctgccgatgaagctgtcaagatgatcctcgatgcgatagagcaagttggcggaatatacattgtgactgcagaccacggtaatgccgaggacatggtgaagagaaataaatccggggaacctcttctcgacaagaatggagatctccagatactcacctcccacacttgtcaacctgtgcctattgcgataggaggtccaggattggcacctggtgttagattccgcagtgatgctccgaatggtggacttgcaaacgtggctgcaaccgtcatgaatctccacggtttcgtagctccgaatgactacgagacaacactcatcgaagtggctgacaactaggctcgccgatagaacattgcctcgatttttttatatttgctctgttcctatacccaaacatcaatttagaataaggttcaaaatgttatatttttgttcttttttgggccaaaaaacgttatatttttgctagacatttgtggttgtaagtgtttttccaggaaaactttgggcttcattgccccttttctttaaatttgacctcataattttcccttttaatggggccattttatgatgttttctgagggtcggccttgatcggttcgtagacaatgttattgtaatgtaatgcttcgcagacactgcgtgtattgagttttttccccaaatataattttatgaaattaaaagtattttattatcttta

SEQ ID NO: 5205 - DNA, 2150 bp, Populus trichocarpa
taaatcaaacggccagagacgtggtttctgagtatcagatccaagttcggtttgaataaagagaaaagaaaaggagagcctgggagtcttctcctccgagattgtttcgattaaagaagttagaaataagaaatggggagcccaggacagaacgcatggaaattggcggatcatcctaagcttccgaaggggaagactattgctatggtggttttggatggttggggtgaggctaaacctgatcagtataactgcatccacgtcgcccacactcctaccatggattccttcaaaactactgcccctgagaaatggagattgattaaggcccatggtactgctgttgggcttccaagtgaggatgacatgggcaacagtgaagttggtcacaacgctcttggtgctggtcgcatttttgcccaaggagccaagcttgttgatcttgctcttgcctcgggaaaaatctacgacggagagggatttaagtacattaaggaatgttttgacaacggcaccttgcatctcattgggttattgagtgatggtggtgttcactcaaggcttgatcagttgcagctgttgctaaaaggtgctgttgaaaatggtgcaaaaagaatccgtgttcacattctcactgatggccgtgatgttttagatgggtcaagcattggctttgtggagactcttgagaaggacctgtcaaatttacgtgagaaaggtatcgatgcacaaattgcatctggtggtggtcgcatgtatgttacaatggatcgttatgagaatgattgggatgtggtgaaacgaggatgggatgcccaagttcttggtgaagccccatacaagtttagaaatgcagtagaagctgtcaagaaactgagggaagaacccaaggcaaatgaccagtacttacctccttttgtcattgttgatgagagtggaaatcctgtgggaccaatcaaggatggtgatgctgttgtcacattcaacttccgagcagatcgcatggctatgcttgctaaggcgcttgaatacgaggattttgacaaatttgatcgggttcgagttcctaaaatccattatgctggaatgcttcaatatgatggcgagttgaagcttccaagccactaccttgtttctcctcctgagatagataggacatctggtgaatacttggtgcacaacggcattcgcacctttgcttgcagtgagactgtcaaatttggtcatgtcactttcttctggaatggaaatcgttctggttattttaatcaagaaatggaggaatatgtggaaattccaagtgatgttggaattaccttcaatgtccaacctaagatgaaggcaatagagattgctgagaaggcaagggatgccatccttagtggcaaatttgaccaggttcgtgtcaatctaccaaatggtgacatggtgggacatacaggagacattgaggccacagtcgtggcatgcaaggttgctgatgatgctgtcaagatgatcattgatgcaatagagcaagttggtggaatctttgtaatcactgctgatcatggtaatgctgaagacatggtcaagagggataagtctggcaaacctcttttagataagaatggcaaccttcagatactcacttcccacactcttcaaccagtgcctatcgcaatcggagggcctggactggcccctggtgccaggttccgcaatgatgttcccactggtggacttgccaatgtggctgcaaccgtgatgaatctgcatggatttgaggctcctagcgactacgagcccactctgattgaagttgtcgataactaggagaagggaagcataattaaaacacatcagtaatcccataaattttgattttaagcaactataattgcagaagcctgttgagaactatgtattatccggtaaaataagttgtaattttgattctgcccggtgggctttccatttcccagttgagacttgagagagaacattgtaatttctgccccctcggtggatgacagaattgtatttcaaatggcggtcttattagtgattgtgctcttgtttgtgatgatatcatgacatccagttgcctataagctgtgaaggagcactgtctgttttggaatgaatgccatgttttcttgtttatgcca

SEQ ID NO: 5206 - DNA, 2204 bp, Glycine max
aagtcacaggcacaaggtttggtcttgttaggttacctctgtgacatttgtgttgttagttcgtagttgcggctgacacccagaaagaaagaaagcaggaaaaaaacaaaaaggcgcagatgggtagcacaggtttctcatggaaattggcggatcatccaaagcttccaaagggtaagactgtggctgtggtggtgttggatggttggggagaggccacacccaatgagtacaactgcatccacaaggctgaaacaccctgcatggattctcttaaaaagggtgcccctgaacggtggagattggttagggctcatggtaccgctgtaggccttccaacagaagatgacatgggtaatagtgaagttggtcacaatgctcttggggctggtcgcatatttgctcagggtgctaagcttgtcgacctagctctagcctctggaaaattttttgaaggaggaggtttcaagtacataaaggaaagttttgaaaatggcacattgcatctcattgggttactgagtgatggtggagttcactccagacttgatcagttgcagttgttgcttaaaggagttagcgagcgaggtgttaaaagagtccgtgtccatattcttacagatggccgtgatgttttggatggttcaagtgtggggtttgtggaaaccctagaaaatgatcttgcaaacttgcgtgagaaaggtgttgatgctaggatagcatcaggtggaggtcgtatgaatgtcacaatggatcgttatgagaatgactggaatgttgtgaaacgagggtgggatgctcaagttcttggtgaagccccttataagtttacaaatgctcttgaagctgtcaagaagctgagggcagaaccaaaggccaatgatcagtatctgcctccttttgttattgttgacgagagtgggaaacctgttggtccgatagttgatggagatgctgttgttacattcaacttccgagctgatcgtatgacaatgattgctaaagctcttgaatatgaaaattttgacaaatttgatagagttcgtttcccaaaaatccgctatgctggaatgcttgaatatgatggtgaattgaaacttccaagtcattaccttgtttctccaccagagattgacaggacttctggtgaatatttagtgtataatggtattcggacttttgcttgcagtgagactgttaaatttggtcacgtcacattcttctggaatggaaaccgctctgggtattttaattcagaattggaggagtatgtggaaattcccagtgactctgggattacattcaatgaacaaccattaatgaaagcattgcagattgctgaaaaggctagggatgctattcttagcgggaaatttgatcaggtacgcgtcaaccttccaaatggtgacatggtggggcatacaggtgacattgaagcaacagttgtggcttgcaaggcagctgatgctgctgtgaagatgattcttgatgcaatagagcaagtgggtggaatttatgttgtcaccgctgaccatgggaatgcagaggatatggtcaagagggataaatctggaaaaccacttctaggcaaggatggaaaaatccagattcttacttcccatactcttgagcctgtgccaattgctattggtggtcccggattggcccctggtgtaagattccgaaatgatgttccaaccggcgggcttgccaacgttgctgcaactgtgatgaatcttcatggattcgaggctcccagcgactatgagacaactctcgtagaagtggttgataactaggaaccaatagatgaatttttataatttgaaaaacaaacagggaaagctgtagattgcagccctcaaaataattgaaagttttcatccttattccacatgtgtggtggttttgttcttatgagttaccaataccagtctgcagttgacagaaaagtatacctaattaatggcattttggcactctcttttaactttctatgattatgctgaattacatttgagttaggtattttgtgattggcaatttgcaaggccatctctaaatcatgcttgtgaaatgcctttactagggctgattcgtgtgttatgatgttgatgtgtctcctatttcaatcatgctttacaaaacttgcattttgatcgaatgttgtgttaaaaattatgtgccaataggattgaatttta

SEQ ID NO: 5207 - DNA, 1973 bp, Triphysaria pusilla
tctcactctcaagtttgtccccaaaaacagcacaaggaaatcgagatgggtagcagtggattttcatggaagttgaaggatcacccgaagcttccaaaagggaaaaccatagctatggtggttttggatggatggggtgaggcaaaacccaatcagtacaattgcatccatgttgcagaaactccaaccatggattcacttaaaaatggtgcccctgagaaatggagattggtgaaggctcacggtaaggctgtgggtctgcccacagaggatgacatgggcaatagtgaagttggacacaatgcacttggcgctggcaggatttttgctcaaggtgctaagcttgttgatattgctcttgaaactggaaaattatatgatggagaaggttttaagtacattaaagaatcgtttgaaaccggaacattacacctgattggattattaagcgatggaggtgtccactccaggcttgatcagttgcagttgttgcttaaaggtgttagtcagcgtggtgctaaaagaattcgagttcatatcctcactgatggacgtgatgttttggacggctcgagtgtaggttttgttgagactcttgaaaaagatctcacaaagctacgggagaatggtatcgatgctcagattgcgtccggtgggggccgcatgtatgttacaatggatcgttatgagaatgattgggaagtcataaaacgaggatgggatgcccaagtgctcggtgaagcaccacacaagtttaagaacgcagtcgaagctgtcaaaaagctgagagaggttcctaaatcgaacgaccagtatttgccccctttcgttattgttgatgagagtggcaaggctgtaggccccatcgttgatggtgatgctgttgtaactgtcaacttcagggcggatcgtatggtaatggctgccaagtcgcttgagtatgcagactttgacaaatttgatcgggtccgggttccgaaaatccgttacgctggaatgctacagtacgatggagagcttaagcttccaagtcgctacctggttgagcctccagaaatagagagaacttctggtgaatatttggtgaataatggtgttcgcacctttgcttgcagtgaaacagttaaatttggtcatgttacgtttttctggaatggaaatcggtcgggatactttaactcggacatggaagaatatgttgagattccgagtgacagtggtattaccttcaatgtccagccgaagatgaaagcattggaaattgctgagaagacaagggatgctatacttagcggcaaattcgaccaggtacgtgttaacctacctaacagtgacatggtgggacacactggtgatattgaagcaactgttgtagcttgtaaggccgctgacgaggccgtcaagatgatccttgacgcaatagagcaagttggtggaatatatgttgtgacagctgatcatggaaatgcagaggacatggtgaaaagggacaagaaaggcgagcctcaactcgacaagaatggccaaatccaaatacttacttctcacacacttgaacctgttcctattgcaattggtgggcccggactggcacccggtgtgagattccgcaaagatgttcctaatggtgggctggctaatgtggctgcaaccgtcatgaacttgcacggctttgaagcacccagcgactatgaaacgacccttattgaggttgttgagaattagatcatccaacttttgtttttattatctattattgtcgtgaaaggcaggcgtagacagtgaagcataatcctttattttgaataaagtactccagtcttgagtttttactagttagtacacttgattgttaaaacttaaatcagcattgttgcatcacaaagcatgctgaaatatctcgatttgatgagttgatacttgatatataattatcagctttatttttgagcaataaaaaaaaaaaaaaaaaa

SEQ ID NO: 5208 - DNA, 1937 bp, Malus domestica
aaaaatcgagaaaaaggaaaatggggagctcaggattcgactggaaactgccggatcaccctaagttgccgaaggggaaggtcatcggactcatcgttttggatgggtggggcgaggccaacgccgaccagtacaactgcatccatgtcgccgagacccccgtcatggattcgctcaagaagggtgctcctgaaagatggaggttagtgagagctcacggaactgccgtgggacttcccacagaggatgatatgggcaatagtgaagtgggtcacaatgccctcggcgccgggcgtatttttgcccagggtgctaagcttgttgatgctgcacttgcttctgggaaaattttcgagggagaaggttttaagtatgttaaggaatcctttgagactaacacattgcatctcattggtttaatgagtgacggtggagttcattctcggcttgatcaattgctattgttgcttaaaggagctagcgaacaaggtgctaaaaagatccgtgttcatattctcactgatgggcgtgatgttctggacggttcaagtgtgggatttgcagaaatccttgaaaatgaccttgcgaaattgcgtgagaaaggtgtggatgcacagattgcgtctggtggtggtcgtatgtatgtcaccatggatcgttatgagaatgattggagtgttgtaaaacgaggatgggatgcccaagttcttggtgaagctccctataaatttaagaatgcagttgaagctatcaagacgttgagggcggaaccaaacgccaatgaccagtatctacctccttttgttattgttgacgacagtggaaagcctgttggcccaatcgtggatggtgatgctgttgttacattcaacttccgtgcggaccgtatggttatgattgccaaggcgcttgagtatgccgattttgacaagtttgatcgagttcgagtcccaaaaatccgttatgctggtatgcttcagtatgatggtgagctgaagcttccaagccattaccttgtagaacccccagagattgatagaacatctggtgaatatcttacatataacggtgtccgcacttttgcctgcagtgagactgttaaatttggccatgtcactttcttctggaacggcaatcgctctggttattttaacgataaaatggaagagtatgtggaaattccaagcgatagtggaatcacattcaacgtccagccaaaaatgaaggcagtcgagattgctgaaaaggctagggatgctattcttagtggaaagtttgagcaggtacgtgttaaccttccaaatggcgacatggtggggcacacaggcgacattgaggccacaattgttgcttgcaaggctgctgatgaagccgtcaagataattcttgatgcaatcgagaaggttggtggaatttacgtcgtcactgctgatcatggtaacgctgaggatatggtgaagagaaataagactgggcaacctcttctcgacaagagtggcaacattcaaattcttacttcccatactctacagccagtcccaattgctattggaggtcctggacttgtacccggagtccatttccgcaaggatcttcctagcggcgggctggccaatgttgctgcaactgtgatgaacctgcatggattccaggctcctagcgactacgagccatccctcatcgaagttgttgataactaggaaggccagagaaaagaacgcactctagtttttcctaaattttgacataggtttacgaacgccatggaaagagggttgtcgattacggtttgttttattaaataagttcgaacaatgtctgctcacagcagcttccgtgggcgagtacggtaattggatgattgtctcaggagaatgacagaacaagaaagatacaaaaaatggaatattttttgcaattttatgcactctcaatta

SEQ ID NO: 5209 - DNA, 1839 bp, Castanea mollissima
ccgacgccttcagttgctgtttcaaacagaaagaaagaaagaaaggagagatgggaagctcaggattttcgtggaaattggcggatcacccgaagcttccaaagggtaagaccgttgctgtggtggttctggatggttggggcgaggccaagcctgatcagtacaactgcatccatgtcgccgagactcccactatggattccctcaaaaagggtgatcctgataaatggaggttggttaaggcccatggttctgcagtaggtcttccaacagaggatgacatgggcaacagtgaagttggtcacaacgcacttggggctggtcgcatcttcgctcaaggtgcaaagcttgttgaccaagctcttgaatctggaaaaatttatgacggagaaggttttaagtatataagcgaatgctttgaaaaaggcactttgcatctcattgggctattgagtgatggaggagtccactccaggcttgatcagttgctgttgttgcttaaaggatctggcgagcatggtgctaaaagaatccgcgttcatattcttactgatggccgtgatgttttggatggttcaagtgtaggatttgtagaaactcttgagaattaccttgcagaattacgtgagaagggtattgatgcacagattgcatctggtggtggtcgtatgtacgtcacaatggatcgttatgagaatgattgggaagtggtcaaacgaggatgggatgcccaagtgcttggtgaagcaccttttaaatttagaaatgctgttgaagctgtgaagaagctgaggcaagcccctaaagccagcgaccagtacttgcctccttttgttattgccgatgacaatgggaaacctgttggtcctatagttgatggtgatgctgtggttacaatcaactttcgagcagatcgtatggttatggttgccaaggcttttgaatatgaagattttgacaagtttgatagagtgcgagtacctaaaatccgttatgctggaatgcttcaatatgatggtgaattgaagcttccgagccattaccttgtttctccaccggagatagatagaacatctggtgaatatctagtgcacaatggtatccgtacatttgcttgcagtgagactgtcaaatttggtcatgtcactttcttttggaatggaaaccgctctgggtatttcaatgaagaactggaggaatacgttgaaattccaagtgattctggaattacattcaacgtccagccaaagatgaaggcattggagattggtgaaaaagtgagagatgctatacttagcggaaaatttgaccaggtacgtgttaacataccaaatggtgacatggtgggacatacaggtgatattgaggccacagttgtggcttgcaaggctgctgatgaagctgtcaagatgatccttgatgcaatagagcaagttggtggaatttatgttgttactgctgatcatggtaatgctgaggacatggtgaagaggaacaaaacagggcaacctcttcttgacaagactggcaaaattcaaatactcacttctcatacttgtcagccagtgccaattgcaattggaggtcctggattagcacctggttgcagattccgcagggatgttcctactggtgggcttgccaatgttgctgcaactgttatgaatctccatggatttgaggctcctagtgactacgagccaacccttgttgaagttgttgatatctagggcagcataaagatttatttctttaatgcgtggagtttgatataggttacaatgcaactcagaaggctgcggagtatggcatgctatcatgataaataagttttttttt

SEQ ID NO: 5210 - DNA, 2226 bp, Eucalyptus grandis
gctctcctcgttttcgtcgacatccggggtgccgaagcatattcgatttccgaccctccttttgtgttcgggcagatcacgcttcgccgctgttgctgtcgacgcgcgagagagactcctccgatcgtctgcttctcccgggtgatattttccgagcggaaaggttggaccttttttgttgcgtttgtaagaggagataagggaggaaaatgggtagctcatggaagctggcggatcacccgaagctgcccaaggggaagaccatcgccatggtggtcctggacgggtggggcgaggccaagcccgaccagtacaactgcatccacatcgccgagacccccaccatggactcgctcaaggagggtgcccctgagaaatggagattggtcagggctcatggaactgcagtgggtctcccaacggaggatgacatgggtaacagtgaggttggtcacaatgctcttggcgctggccgcatctttgctcaaggtgcaaagcttgtcgaccttgctcttgcttccggaaagatttatgatggagaaggtttcacctacattaaggatagttttgagactggtaccttacatttgattggtctcctgagtgacggcggagtccattctaggcttgatcaagtgcagttgctggtaaaaggatctgctgagcgtggtgccaaaagaatccgtgtccatattcttacagatggacgtgatgttttggatggttcaagcgtgggctttgtagaaactcttgaaaatgaccttgcggaattaagagctaaaggtgttgatgcacaaattgcatctggtggaggtcgtatgtatgtcactatggaccggtatgagaacgattgggaagttgtaaaacgaggatgggatgcacaagttcttggcgaagctccttacaagtttacaaatgctgttgaagctgtgaagaagctaaggcaggaacccaaggccaatgaccaatatttgcctccatttgtcattgttgatgacaatggaaaagcagtgggcccaatagtggatggtgacgctgttgtgacatttaatttccgagctgaccggatggttatgattgcaaagtcactcgaatatgaagattttgacaaatttgatcgtgttagagtccctaaaattcgttatgctggaatgcttcagtacgatggtgaattgcagcttccaagccattaccttgtctctcctccagagatagacagaacatctggtgaatatcttgtgcataatggcgtacggacatttgcctgcagcgagactgtcaaatttggtcacgtcacatttttctggaatggaaatcgctctggctattttaatcctaaaatggaagagtatgtggaaattcctagtgacagtggaattacattcaatgtccaaccaaaaatgaaggcaatcgaaattgctgagaaagctagggatgccatccttagcggtaaatttgaccaggtacgagttaatcttcccaatagtgacatggtggggcatacaggagacattgaggcgacaattgtggcatgcaaagctgctgatgaggcagtgaagatgatccttgatgcgatagagcaagtgggaggaatatatgtcgtcactgcagatcatggaaatgctgaagatatggttaagagaaacaagaagggcgagccggcactcgacaagagtggaaacattcagatactcacttcccacactcttgagccagtgcctgttgccatcggaggcccgggcttggcacctggagttaggttccgcagcgacgtacccagtggagggctcgcgaatgttgctgctactgtgatgaatcttcatgggtttgaggctcctagcgattacgagacgaccctcatagaagtggtcgattgataattaggctaactctattaaagtcttgacggtttggcgttgagtgccaggcgatgagcgtgctttggaccatatattgtttaaataagctcgatctgagcttgcttccctggatttattgagttatgggatcagccaagttttgttggttacagactgaacagcaattcgcagtcgggcaaattgttggaatattgctgaatatctgattactgttcttcatactctataaagcaggttgtcgaagtgtttcctacttgagagtgttttttgttcaagggaaataagaaagtatttcactctttgtgacagatcttgacatgtgctaaattatgtcatttatttcaaa

SEQ ID NO: 5211 - DNA, 2077 bp, Actinidia deliciosa
  misc_feature (1216)..(1216): n is a, c, g, or t
  misc_feature (1439)..(1439): n is a, c, g, or t
  misc_feature (1465)..(1465): n is a, c, g, or t
ctcgtcttctttccgctgctcgcaccaacagtttggttttgaactcttccgattcgactatagatcgatacatatagagagagagagagggatggggagctcaggattttcatggaaactggaggatcacccgaagctggaaaagggcaagatcttggcgatggtggtgttggacggttggggcgaagcaaatcccgatcagtacaattgcattcatgtcgccgaaacccccaccatggattgtctcaaaaagggtgctcctgataggtggagattggtgagggcgcatggtaaggccgtggggcttcccacagaggacgacatgggaaacagtgaagttggtcacaatgctcttggtgccggtcggatctatgctcaaggggcaaaacttgttgaccttgctcttgccaccgggaaaatttatgatggagaaggttttaactatattaaggaatcttttgaaactgggacattgcacctgattgggttattgagtgacggtggtgttcattcccgacttgaccagttgcagttgttgctaaaaggagccagtgagcgtggtgccaaaagaattcgcgttcatattctgactgatggccgtgatgttttggatggttcaagtgtaggctttgtggaaacccttgagaatgatctatcaaacttacgtgagaaaggtgttgatgcccagatagcatctggtggaggtcgcatgtatgtcacaatggaccgttatgagaatgactgggatgttgtgaaacgagggtgggatgcccaagttcttggtgaagcccctcataagtttaggagtgctattgaggctgtcaagaaactgagggagcttccaaaagcgagtgatcaatacttgcctccttttgttattgttgatgaacatgggacttctgttggtccaatagtggatggtgacgctgttgtgactctcaacttccgtgcagatcgtatggttatgcttgctaaggcacttgaatatgaaaattttgataaatttgatcgagttcgattccctaaaatccgttatgctggaatgcttcagtatgatggggagttgaagcttcctagccgctacctagtgtctcctccagagatagagaggacatctggtgaatatttggtcaacaacggtgtgcgtacttttgcttgcagtgagactgtcaaatttggccatgtcactttcttctggaacggaaatcgctcaggntattttaatccggagatggaggaatatgtggagattcctagtgattctggaataacatttaatgtgcaaccaaaaatgaaggccttggaaattgctgagaaggctagggatgctattctgagtcgcaaatttcaccaggtacgtgttaacctaccaaatagtgacatggtggggcatacaggtgacattggggctacggttgtggcttgcaaggctgctgatnaagcagtccagatcatacttgatgcnatagagcaagtgggtgggatatatgttgttactgcggatcatggaaatgctgaggacatggtgaagaggaacaagaagggggagcctcttcttgacaaggatggcaaaatacagatactgacgtctcacactcttgaaccagtgccgattgcaattggaggtcctgggctggcacctggtgtgagattccgcaaggatgttccagatggtgggcttgctaatgtggctgcaactgtgatgaatctccacggattcaacgctcctagtgattacgagccaaccctgattgaggtcgttgataactagcttactatggaatattgaaatttctctatttgtttccaaaatcttgagtgaagcaagaaacccgaatgacttcaattcgaatgcattcacttaatggacgtggagaccagaagagctcaaagttttcttagacaatgataagtataaaaaataacaaataatgttgctatggtgagagttcatagccttctagattatgttttgtgaagtattgaattttgttggatgaaattttactgccttatttatttttaacaaatcgtaacaatgctgttgtgaatttttttttttctattaaaaaaaaaa

SEQ ID NO: 5212 - DNA, 2183 bp, Cucumis melo
ttttagggttgttcttgctctcataaaagttgggtcttgccttttacctctcccttttgcccttttcattcaagaaatttaatcgcgatggggagttctggattctcatggaaattgcctgatcatcctaagcttcctaaggataagataattggtcttattgttttggatgggtggggtgaagccaacccagatcgctacaattgtatccatgttgctgaaactcccaccatggattcgcttaagaagggagcacctgagcattggagactgctcagagcgcatggcaaggcagtaggacttcctactgaagatgacatgggtaacagtgaagttggacataatgcacttggtgctggacgtatttatgctcaaggtgcaaagcttgttgaccttgctcttgaatctggaaaaatatatgagggagaaggtttcaaatacatcaaggaatcctttgagaccggcactttgcatcttataggattactgagtgatggtggagtgcactctaggctagaccaggttcagttgttactcaaaggagcaagtgagcgtggtgctaaaagaatccgtgtccatatacttacagacgggcgtgatgttttggatggctccagtgtaggctttgtagagactcttgaaaatgatcttgccaaattacgtgagaaagggattgatgcacaaatagcatctggtggaggccgtatgtatgtgactatggatcgttatgagaacgattgggaagttgtgaagcgaggatgggatgcacaagtgcttggtgaagcaccacacaaattcaaaaatgctctggaagctgtcaagacattaagagcggaacccaaagcaaatgatcaatatctacctccattcgtcatagttgatgatagtgggaagtctgtaggtccaattgttgatggtgatgcagtagttaccttcaattttagagcagatcgaatggttatgattgccaaggcccttgagtatgaaaattttgataaatttgatcgagttaggttccctaaaattcgttatgctggaatgctccagtatgatggtgaattgaagcttccaagccattaccttgtttctcctccagagattgagagaacatctggggaatatcttgtgcacaatggtgttcggacctttgcctgcagtgagactgtcaagttcggtcatgttactttcttctggaatggaaaccgttctggatatttcaattcagaaatggaagaatatgtggagattcctagtgattctgggatcacttttaatgttcagccaaagatgaaggctatagaaatcgctgagaaggcaagagatgcaattcttagtcggaaattccaccaggtacgtgttaacttaccaaacggtgacatggtgggtcacactggtgatattgaggccactgttgtagcttgcaaggctgctgatgatgctgtaaaaatgatcctcgatgcaattgaacaagtagggggaatttacgttgtcaccgcagatcatggaaatgcagaggacatggtgaagagaagcaagtctggggagcctcttcttgacaaaagtggcaaaattcaaatcctcacttctcacactcttcagccggttcctattgcgattggaggtccaggactggcccctggagttagattccgtaatgatgttcctactggagggttggccaatgttgctgcaactgtgattaatctccatggctatgaagctccaagcgactatgagacgaccctaattgaagttgtcgatggttaagctgagtgagatgggaagttcagttatccgattaagattatgtttttacaatcaatcgagcagagagaagactagcaatggctatgcatgctaggttgtggaataagtaaccctatttgatccttggattcatgttccttgtttatggtcagtctatgttaaactagaccatgaaagggggaggatataacaactgagaaattttgttgactctgaagatttgaatagctaaattgagggttgaacaaccctccaattttcaagtttttgctgatattttgtcttaactttgatgaattctcttatggtcttttgaagtgatggtaggagcagtgttttttgaaaaaagatttaggtacctaaatcttaaattgttttattaaatcttcttaattacacaaagtaatttttttgta

SEQ ID NO: 5213 - DNA, 2031 bp, Momordica charantia
agaaaaaaaaagttagggttgtggcttttcctctccctcggccttgattcgctgcttcttctactttcttcaggtaatttaatcggagatcgatggggagttctggattctcgtggaaattgcccgatcatcctaagcttccgaaggataagacagtggctcttattgttttggatgggtggggcgaagctaacccagatcgctacaactgcatccatgtagcggaaactcccaccatggactctcttaagaagggcgcccctgagaaatggaggttgctgagggcacatggtaaggctgtaggacttcctacagaagatgacatgggcaacagtgaggtaggacacaacgcgcttggtgccggacgtatttttgctcaaggtgcaaagcttgttgaccttgctcttgcctctggaaaaatatttgaaggagaaggtttcaaatatatcaaggaatcttttgctaccggcacattgcatcttattggattattgagtgatggtggagtgcactctaggctagatcagttacagttgttactcaaaggagcaagtgagaatggtgctaaaagaatccgtgtccatattctcactgatggacgtgatgttttggatggttcaagcataggctttgtagaaactcttgaaagtgaccttgccaagttacgtgagaaagggattgatgcacaagtagcatctggtgggggccgtatgtatgtcacaatggatcgttatgagaatgactgggaagttgtgaagcgaggatgggatgcacaagttcttggtgaagcaccacacaagttcaaaagtgctgctgaagctgtcaagacattaagagcggaaaccaaagcaaatgatcaatatctacctccatttgtcatcgttgatgacagtgggaagtctgtgggcccaatagtggatggtgatgctgtagttaccttcaattttagagcagatcgaatggttatgattgccaaggccctcgagtacgaaaatttcgataaatttgatcgagttaggttccctaagattcgttatgctggaatgcttcagtacgatggtgaattgaagcttccaagccgttaccttgtttctcccccagagattgatagaacatctggggaatatcttgtgcacaacggtgttagaacctttgcttgcagtgagactgtcaaatttggtcatgttacattcttctggaatggaaaccggtctggatatttcaattcagaaatggaggaatatgtggagattcctagtgattctgggatcacctttaatgttaagccaaagatgaaggctatagagatcgctgagaaggcaagggatgctattcttagccggaaattccatcaggtacgtgttaacctgccgaacggcgacatggtggggcataccggtgatatcgatgccacagtcgtagcttgcaaggctgctgatgatgctgtaaaaatgatccttgatgcaattgagaaagtcgggggaatttacgttgtcactgcagatcacggaaatgctgaggatatggtgaagagaaacaagtctggacagcctcttcttgacaaaagtggcaacattcaaatcctcacttctcacactcttgagccggttcctgttgcaattggaggccctgggctggcccctggagtcagattccgcaaggatgttcctaatggaggactggccaacgtcgccgcaactgttatcaatctccatggttacgaagctccgagcgactacgagacgaccctaatcgaggtcgttgatagctaagcgagcggcatggaagatcgggttattcgagtaagattatgtttttacgattaacagagcgagaagactggcaatgactatgccgggttgttgaataaaaacttgttttgatctttggattcatgttccttgttatggtctgcctatgttcaaccataacattgagggtataattcaactgagaaattttgttgactccttcagatttaatttaatagccaagttttgagggttgaaaaaccttccaattttctagtac

SEQ ID NO: 5214 - DNA, 1923 bp, Papaver somniferum
agatgggaagtgctgaagtttcatttaaattggcggatcatccaaagcttcctaaagggaaggtaatagctcagattgttttggatggatggggagaagctaatcctgaccagtttaactgtatccatgttgctcaaacaccaaccatggattctctaaaacagggtgcacctgagaagtggagattggtaagagctcatggtaaggcagttggtctcccaactgaagatgacatgggtaacagtgaagttggacataatgcccttggtgctggaagaatttttgctcaaggtgccaagcttgttgacattgcacttgcctcgggaaagatcttcgatggagaaggctttcagtacatcaaggaatcctttaaggatggcaccctccacctaattgggttattgagtgatggaggtgtccactctcgaattgatcaagtgcagttgctattaaaaggagccagcgagaggggtgccaaaagaatccgccttcatattctcacggatggtcgcgatgttttggatggttcaagcgtagggtttgttgaaactattgagaatgaccttgcacaactgcgagcaaatggcgttgatgcacaaattgcatctggtgggggtcgcatgtatgtcacaatggaccgttatgagaacgactggggtgttgtgaaaagaggatgggatgctcaagttcttggtgaagcaccatacaaatttaagagtgctttagaagcagttaagacactgagggcagaaccaaaggccaatgaccaatacttgcctccatttgttatagttgatgatagtggcaaggctgctggcccagttttggatggtgatgctgttgtgactttcaacttccgtgcagatcgtatgactatgcttgctaaggcccttgaatacgatgacttcaaggattttgaccgcgttagattcccaaagatccgttatgctggtatgctccagtatgatggtgagttgaagcttccaaacaaatacctagtttcaccaccagagattgatagaacatctggtgaatacttggtgcacaatggcgtccgtacttttgcctgcagtgagactgttaagtttggacatgttaccttcttctggaacgggaacagatctggatactttaaagaagatatggaggaatacgttgaaatcccaagtgatagcggaattacattcaatgcccagccgttaatgaaggccttggaaattggtgagaaggcaagggatgctattcttagtggcaaattcgaccaggtacgtgtcaacattccaaacagtgacatggttggacacactggtgacattgaggcaactgtgttgcttgcaaggctgctgatcaagctgtgaagatgattattgatgcgatcgagcaagttggtggaatttatcttgttactgccgatcatggtaatgctgaagatatggtgaagaggaacaaaaaaggagaacccctgctagataaaaatgggaacattcagatcctcacttcccacactcttcaaccagtcccagtcgccattggtgggcctggtctagctccaagagttagattccgcagtgatgttcctgagggtggtctcgccaatgttgctgcaacaatgatgaacctccatggatttgtggctccagatgactacgagaccactctaattgaggttgtctagagaactgttaatttgaaaaatcactcggatctgcagaggaagagataaattagagtcacaatataagtacttgcttaccggagtgtttatgtatttttttactcgatatggagcgctcaactagtcacgctgttcttagtgcgtgtgaagcggtattttacatcataatgtggcaaaacagttttttgttttttttttattttgagagactccagaggagaggagaggagatagtgtcataatttaat

SEQ ID NO: 5215 - DNA, 2410 bp, Cannabis sativa
ggatcattctggatggactcgatttttcaaccagcgttggaggttgtaaatggacaagcgcattgtaatacagtagaacccggaacaccagatcacaaagcgaggttccagaaagacgcaataagcacaagccacgtgtaccctaacaaagataaatcaacggcgtcagatctaatctaatctatgggagatggtttgtcttgcttttgtcgcctatatatatatacgtgggtagttgatagttcgaagtagtcaggttctatatttccttcttccattgattccatttctcctaattatttattttcggatttagcgaacagaaagcaccgagaatggggagttcaggctttaacttcaagttggcggatcatccaaagctccctaaggataagatcgtggctatggttgttttggacggctggggtgaagccaaacctgatgaatacaactgcatccatgtcgccgagacacccaccatggattccctcaagaagggtgctcctgaaagatggaggctagtcagagctcatggcaccgcagtaggactcccaactgaggatgatatgggcaacagtgaagttggtcataacgcacttggtgctggacgaatttttgctcagggggcaaagctcgtcgattctgcacttgcgaccggaaagatttatgaaggagatggttttaagtatataaaggaatcttttgaaactaacacattgcatctcattgggttattgagtgatggtggagttcattccagacttgatcaagtgcagttgcttcttaaaggagctagtgagaatggcgcaaaaagaattcgcctccacatacttactgatggtcgtgatgtcttggatggttcaagtgtgggatttgtggaaactattgaaaacgaccttgcaaaactacgtgaaaatggtgttgatgcacagattgcatctggtggtggtcgtatgtatgtcacaatggatcgatacgagaatgattgggaagttgtgaagagagggtgggatgcccaagttcttggtgaagctccttacaaattcacaaatgctcttgaagctgtcaagaagttgagacaggagcccaacaccagtgaccagtacctgcccccttttgttattgttgatgcgagtggaaagcctgtaggtccaatagtggatggtgatgctgttgttactttcaacttccgagctgatcggatggttatgatcgcaaaggcacttgaatatgaagattttgacaaatttgatcgagttagagttcctaaaattcgttacgctggtatgcttcagtatgatggtgagctgcagcttccaagtcattaccttgtctctcctcctgaaatagacagaacatctggtgaatacctaacacacaatggtgttcgtacttttgcctgcagtgagactgttaaattcgggcatgtcactttcttttggaatggaaaccgctcggggtattttaaccctgagatggaagaatatgttgaaatcccaagtgatagcggaatcacatttaatgtcaaaccattaatgaaggccgtagaaattgctgagaaggcaagggatgccatacttagccggaaattccaacaggttcgtgtcaacttgccaaatggtgacatggtgggacatactggtgatattgaggctactgtggtggcttgcaaggctgctgatgaggctgttaagattatcctcgatgcaatagagcaagttggtggaatttatgtcgtcactgcagatcacggaaatgctgaagacatggtgaagagaaataagtctgggaaacctcaacttgacaagaatggcaaaatccaaattcttacttctcacactcttgagcctgttccaattgcaattggaggtcccggactagcgccaggtgttaggttctgcaatgatgttcctagcggtgggctagccaatgttgctgcaaccgtcatgaatttgcatggatttgaggcacctagtgactatgagccaactttaattgaggtggttgataactaaaggctgcaaagaaagaagaacaagaatgactcgaggttttaataataattcgtctaaattttgactcaatttaaagccatacataggaggctgtggattatggttcaataagttgagtaaacttttattattgctgctatgatgttactttctcatagctgtgacagaacaaagatcaaatataatccgatttttgtgttcacatgattttgtcattcatggagttatatacaatgccaatgattgtatctacttttatgcaatttattttgggcttttttccttaatagattttttaggcctaaaatttacatttttatcttgttaaaagaaaaataaactaaaaaagaaattacaaattttattttcaaatatacggacggactgaaacaaaa

SEQ ID NO: 5216 - DNA, 1846 bp, Gossypium hirsutum
ttttttctctcccttattatatataaccatcatcaaaccttcattcaaatcttaattaaaatacaaacattcgaagcttaacaacaatggcgagttcaggacaagtatcgtttaaattagaggaccacccaaagcttccaaagggaaaacgtatcgccgtcgtggtcctcgatggttggggcgaatataaaccagatcaatacaattgtatccatgttgctcaaacacccaccatggattccctcaaacagggtgccccggacagatggagattaatccgagctcatggaaattctgtagggcttccaacagaggatgacatgggaaacagtgaagttggtcacaatgctctcggtgcaggccgcattttcgctcaaggggctaagcttgttgatcttgctcttgcctcggggaagatctatgatggtgaaggatttaagtatataagtgaatcttttgagaagggtacccttcacttgattggattacttagcgatggaggtgttcactcccgtctcgatcaattgcagttgttgctgaagggagctagtgagcgtggtgctaaaagaatccgtgttcatgttctcactgacggtcgtgatgttttggatggttcgagtgtaggctttgtggagattctcgagaatgaccttgcaaagttacgtggaaaaggtgtagatgcccgcatcgcatctggtggtggccgtatgtatgtcacaatggaccgttatgaaaatgattgggatgttgttaagagaggatgggacgctcaagttctcggtgaagccccacacaagtttaagaatgccattgaagctgtaaagaaactgagagaaaatgccaatgaccagtacttgcctccctttgtcatcgttgatgataacaacaaggctgtgggtccgatagtagatggtgatgctgttgttaccattaacttccgagcagatcgaatggttatgcttgctaaggcacttgaatatcaagatttcaacaaatttgatcgtatacgggtccctaaaatccgttatgctggaatgcttcagtatgatggcgagttgaagcttccaagctgctaccttgtttctcctccagagattgatagaacatcgggtgaatatttggtgcataatggtgtccgtacttttgcctgcagtgagactgtcaaatttggccatgtcactttcttctggaacgggaaccgctccgggtatttcaatcctcaaatggaagaatatgtggaaatcccgagcgatgttggcattacgttcaatgttcaacctaagatgaaggcattggagatcggtgaaaaggctagggatgctattctgagtgggaaatttgaccaggtacgtgtgaacataccaaatggtgacatggtgggtcataccggagatatcgaggctacggttgtggcatgcaaggctgctgatgaagctgtcaagatgatcctcgatgcgatagaacaagttggcggaatatacattgtgactgcagaccacggtaatgccgaggacatggtgaagagaaataaatccggggaacctcttctcgacaagaatggagatctccagatactcacctcccacacttgtcaacctgtgcctattgcgataggaggtccaggattggcacctggtgttagattccgcagtgatgctccgaatggtggacttgcaaacgtggctgcaaccgtcatgaatctccacggtttcgtagctccgaatgactacgagacaacactcatcgaagtggctgacaactaggctcgccgatagaacattgcctcgatttttttatatttgctctgttcctatacccaaacatcaatttagaataaggttcaaaa

SEQ ID NO: 5217 - DNA, 2127 bp, Elaeis guineensis
agctccagacgcttctactcgctttctgccatgcctcttttgtgggaaccggcaacgcgccccacccttcctcctcaaaccgacggcgtttgtctacctcaccgacttcttcttcctttaaattccttcagctttctagagggtggagactttgtctgcatcccatctgtagcaaggccactcgagaaatctcttgagagctttggaggagatggatagctcggagttctcatggaaattggcggaccacccgaagcttccaaaagggaagacggtggccgtcgtggttttggatggatggggcgaagccaatcccgacaagtacaactgcattcatgtcgccgagacgccgaccatggattcgctcaagaaaggtgctccagaaagatggaggttgataaaggctcatggcacagcagtgggactgcctaccaacgatgacatgggtaatagtgaggttggtcacaatgcactaggtgcagggcgaatttatgcccagggtgctaagcttgtggatcttgcacttgcctctggaaaaatatatgaaggagaaggttttaaatacattcaagaatgttttgatcaaggtactttacatctcattggtttattgagcgatgggggcgtccactcacggcttgatcagctacagttgctattaaaaggagacagtgagcatggtgccaaaagaatccgtgtccatatccttactgatggtcgtgatgttttggatggtactagtgtaggctttgtagaaacactagaaaatgacctttcaaatttacgggagaaaggcattgatgcacaaattgcatctggtgggggcaggatgtacgttaccatggaccgctacgagaatgactgggaggttgtgaagcgtggttgggatgctcatgttcttggtgaagcaccatacaagtttcgaagtgctcttgaagcagtgaaaaagttgagggaggatccccgggccaatgatcagtacttgcctccttttgttatagttgatgagagtggcaaggctgttggaccaataatcgatggtgatgctgttgtaacattcaacttccgagcagatcgaatggttatgattgctaaggctctggagtatgagaattttgacaaatttgatcgtgtacggttcccaacaattcgatatgctggaatgcttcagtatgatggtgaattgaagcttccaagccactatcttgtttctcctccagagattgagaggacatccggtgaatacttagtgcacaatggcatccgtacttttgcttgcagtgagactgtcaaatttggtcatgtcacctttttctggaatggaaaccggtcaggatactttgatccaaacatggaagaatatgtagaaattcccagtgatattgggatcacattcaatgttcaaccaaagatgaaggcctcagaaattgctgaaaaggctagggatgctatcctaagctgcaagttccaccaggtccgtgtcaacctaccaaatggagatatggtgggccatactggtgacattgaagccactattgtaggttgcaaggctgctgatgaagctgtgaagatgatactggatgcagtagagcaagtgggtggaatctatgttgtcactgctgatcatgggaatgctgaagacatggtaaaaaggaacaaatttggccaaccgctgcttgacaaaaatggaaatgttcaaatcctgacttcccatacagttcaaccagtaccaattgccattggaggccctggacttgctccaggagtcagattccgaaaggatttgcccactgctggccttgctaacgttgctgccaccgcgatgaatctccacggcttcgaggcccccagcgactatgaacctactctcattgaagttgttgacaactgatccaagatccaatgcctcattgtgtcaaggagacgttaaataatttttgtaattgggatctgcaaatcaactttgtgttaagatgctggtgcagaagatacttgatgttgctggcaagtttgtctaatgcttgttttattatcacgatgactcttagcatgttttaatatgcacgcgtaaatgcatgtaaatgtttgagaatcctgacgtgttgtgaaattcagacattctaaaac

SEQ ID NO: 5218 - DNA, 2105 bp, Quercus alba
ttgttcgatcacacactcccgacgccttcagttgctgtttcaaacagaaagaaagaaaagaaaggagagagagatgggaagctcaggattttcgtggaaattggcggatcacccgaagcttccaaagggtaagaccgttgctgtggtggttctcgatggttggggcgaggccaagcctgatcagtacaactgcatccatgtcgccgagactcccactatggattccctcaaaaagggcgatcctgataaatggaggttggttaaggcccatggttctgccgtaggtcttccaacagaggatgacatgggcaacagtgaagttggtcacaacgcacttggggctggtcgcatcttcgctcaaggtgcaaagcttgttgacctagctcttgaatctggaaaaatttatgacggagaaggttttaagtatataagtgaatgctttgaaaaaggcactttgcatctcattgggctattgagtgatggtggagttcactccaggcttgatcagttgctgttgttgcttaaaggatctggcgagcgtggtgctaaaagaatccgcgttcatattcttactgatggccgtgatgttttggatggttcaagtgtgggatttgtagaaactcttgagaattaccttgcagaattacgtgggaagggtgttgatgcacagattgcatctggtggtggtcgtatgtacgtcacaatggatcgttatgagaatgattgggaagtggtcaaacgaggatgggatgcccaagtgcttggtgaagccccttttaaatttagaaatgctgttgaagctgtgaagcagctgaggcaagcccctaaagccagcgaccagtacttgcctccttttgttattgccgatgagagtgggaaacctgttggtcctatagttgatggtgatgctgtggttacaatcaactttcgagcagatcgaatggttatggttgccaaggcttttgaatatgaagattttgacaagtttgatagagtgcgagtacctaaaatccgttatgctggaatgcttcaatatgatggtgaattgaagcttccaagccattaccttgtttctccaccagagatagatagaacatctggtgaatatctagtgcacaatggtgtccgtacgtttgcttgcagtgagactgtcaaatttggtcatgtcactttcttttggaatggaaaccgctctggttatttcaacgaaggactggaggaataccttgaaattccaagtgattctggaatcacattcaacgttcagccaaagatgaaggcattggagataggtgaaaaagtgagagatgctatacttagcggaaaatttgaccaggtacgtgttaacataccaaatggtgacatggtgggacatacaggtgatattgaggccacagttgtggcttgcaaggctgctgatgaagctgtcaagatgatccttgatgcaatagagcaagttggtggaatttatgtcgttactgcagatcatggtaatgctgaggacatggtgaagaggaacaaaacagggcaacctcttcttgacaagggtggcaaaattcaaatactcacttctcatacttgtcagccagtgccaattgcaattggaggtcctggattagcacctggttgcagattccgcagggatcttcctactggtgggcttgccaatgttgctgcaactgttatgaatctccatggatttgagcctcctagtgactatgagccaagccttattgaagttgttgatatctagggcagcataaagatttgtttctttaatgcgtggagttagatataggttacaatgcaactcagaaggctatcatgatatggcatgctatcatgataaataagtttttatttcttactaaagaagaaaaaaaagaaacagtcacgggtatggtggcttcggtattttgggctgtctgtgaggtttacagaacagtatggttaaaatggagtttttgttctatcttttcttaatatgatttttgtcatgattcggtttgtattaaacgttcctgtttagactttagattgaatggttttcagcttcaaaggcttaagcttaacagggttgttctatacttcaagttctatcaacg

SEQ ID NO: 5219 - DNA, 2403 bp, Populus trichocarpa
tcaaaccatcgccacccactcagatccaacttcagtttcggaaagaaaagcctcggtttcttctcttcctcttcatcctccattgctagctgcctctatctgtgttaattaaattgatcgaatcaatcgaatcagaagccagaatttataaagaaatggggagcgcaggacagaacgcatggaaattggcggatcatcctaagcttccaaagggaaagactatcgctatggtggttttggatggttggggtgaggctaaacccgatcagtataactgtatccatgtcgccgatactcctaccatggattccttcaaaactactgcccctgaaagatggagattgattaaggctcatggtactgctgttgggcttccaagtgaggatgacatgggcaacagtgaagttggtcacaacgctcttggtgctggtcgcatctttgctcagggagcgaagcttgttgatcttgctcttgcctctggaaaaatctatgacggagagggatttaattacattaaacaatctttcgacaatggcacgttgcatctcattggactattgagcgatggtggagttcactcaaggcttgatcagttgcagttgttgctgaaaggtgctgctgaacgcggtgctaaaagaatccgtgttcactttcttactgatggccgtgatgttttagacgggtcaagtgttggctttgtggagactcttgagaaagacctgtcaaatttacgtgagaaagctgttgatgcacaaattgcatctggtggtgggcgcatgtatgtcacaatggaccgctatgagaatgattggaatgtggtgaaacgaggatgggatgcccaagtacttggtgaagccccatacaagtttagaagtgctgttgaagccgtcaagaaactgagagcagaacccaaggcgaatgaccagtacttacctccttttgtcattgttgatgagagtggaaatcccgtgggaccaattaaggatggtgatgctgttgtcactttcaacttccgagcagatcgcatgactatgcttgctaaggctcttgaatatgcggattttgacaaatttgatcgggttcgagtccctaaaattcattatgctggaatgcttcaatatgatggtgagttgaagcttccaagccaatacctcgttactcctcctgagatagaaaggacatctggtgaatacttggtgcataatggtgttcgcacctttgcttgcagtgagactgttaaatttggccatgtcactttcttttggaatggaaatcgttctggttatttcaatgaagaaatggaggaatacgtggagattccaagtgatgttggaattacattcaatgtccaacctaagatgaaggcattagagattgctgaaaaggcaagggacgccatccttagtggcaaatttgaccaggttcgtgtcaatctaccaaatggtgacatggtgggacatacaggagacattgaggccactgtagtggcatgcaaggctgctgatggtgctgttcagacgatcatcgatgctatagagcaagttggtggaatctatgtaattactgctgatcatggcaatgctgaagacatggttaagagggacaagtctggtaaaccccttttggataaaagtggcaaactccagatactcacttctcacactcttgaaccagtgcctattgcaattggaggccctggattgaaagctggtgtcaggttccgcaatgatgttcccactggtggacttgccaatgtagcagcaactgtgatcaatcttcatggatttgaggctcctaacgactatgagcccaccctcattgaagttgtcgataactagaagtgatgtttactcaaaacccaccagttttccttgaattttgactgttagcaactataattgcggaaacctgttgagtacagtgtattatccggttaaataagttctatttatttttgactctggacgctgggctagcggactttaccattctcagttctgagtgaacatttcaatttctactccgtcggtgtaatgacagaattgtatttcaaatggccatttaatagttggcgtactattttcttcttgtatgtgatgtttttcatccagttgcccttgagttgcgagaggatcttctttttacacactgtcggaaacccgaggactcaagaggatggatatggaaagtataggatttcaaatcctagcaggaaaaggaggaggagggaaacagatactcaatttaaagggagtaatcagaattccattttcaatctcatagatacagttgtattcttgatgaaagttatatgcacagcttggagggaggtctttcattaaaaggtttcttgaatttgtttaatcttagatagttaccatctttatttgttactaagaggct

SEQ ID NO: 5220 - DNA, 2821 bp, Amborella trichopoda
atcaacttttaagcctggttcttgccatcgtttttgccctaactttaaacaggcggggagagcaaacttcttttcgcttgtataactacgcttttcttctactcgttctcgccctctctatcgatctacaatccgccatatctgtgcctcttcttttcttgcttgatttttgaagaatggatagtgctgggttctcatggaaattggctgatcacccgaagctcccaaagggcaaaactgtagctgttgttgttttagatggctggggcgaagccaatcctgacaaatataattgcatttatgttgcaaagacacctactatggattctcttaaagaaggtctgcctgagaaatggagattggtaagggctcatggtactgctgtagggcttcctacagaagatgacatgggtaacagtgaagttggtcacaatgctcttggtgccggacggatatatgcccaaggtgctaaattggtggactttgcgcttgcatctgggaaaatatatgaaggagaagggttcaagtacatcaaggaatgctttgacaagggcaccttgcatcttattgggttactgagtgatggtggtgttcattctcgactagatcagttgcagttattgcttaaaggtgccagtgagcatggcgctaagagaatacgtgtgcacatattgactgatgggcgtgatgtattggatgggtcaagtgtgggctttgtggagactcttgagaatgaccttgcaaagctacgagagaagggcgtagatgcacagatcgcctctggtgggggccggatgtatgttaccatggatcgttatgagaatgactgggacgtggttaaaagaggatggtatgcccatgtcctcggtgaagcaccttacaagttccgtagtgccttggaggctgtgaagaagctccgggaggacctaaaggtctctgaccagtaccttcctccatttgttatagtagatgagagtggaaagccagtgggcccaactatggatggggatgctgttgtcaccttcaacttccgagctgatcgtatggttatgcttgccaaagccttggaatatgaagatttcgacaagttcgatagggttcgcttcccaaagatccgatatgccggaatgctccagtatgatggtgaactaatgcttcctagtcagtacctggtttcgcctccggaaatagagagaacatctggtgaatatttagtccacaatggcattcgcacttttgcgtgcagtgagactgtgaagtttgggcacgtcacctttttctggaatgggaatcgttctgggtgttttaacccgaaattggaggaatatgtggagattccaagtgatagtggaatcacattcaatgtccaaccaaagatgaaggcattggagattgcagagaaggcaagagatgccatccttagcggcaaatttgatcaggtccgtgtcaaccttccaaatagtgatatggtgggacacacgggtgatattgaggcaacggttgttggctgtgaggctgctgatgaagctgtgaagatgatacttgatgcggtggagaaagtgggtggaatctaccttgttactgctgatcatgggaatgcagaggatatggtgaagagggacaagaaaggcaaacctcaactagataaagctggcaacattcagatccttacttctcacactctccaacctgttcctgtcgctattggagggcctggattaaaacaaggagtaagattccgaagtgatctccctcaagctgggcttgcaaatgttgctgccacttttatgaattttcacggtttcgtcgcccccgatgactatgagcccactcttatcgaggttgtcgacaactgagctcggagtaatcatggatttacttatttattactcaatattaaaacccttcaagctcgatatttattcaagggtttaatattgtgttatttattacttctttttgccatataaatctggtagatatggggaagttccttgtacgagactggatattaggtctttttgacttcaaagagaaggcctatgtaattggcctctttctctattgtttttttttttttaaaaaaaaaataattctgcatcgagatttttttctttggagcaaatatgcaataatttttaagagatggttattcctatattttctaagaatatttggttggaaaggtttattcagagtgctgttttttttagtcccacacgtgataatttttagtgagattcgtgtcaattttaatgatgatcttttagggtcttacatatatgggtgggggaggggatcattagtcatttataaatctgtctggatttgtattttttttacttttaaatttcataattgttcataaagaaggatttctaagcccttataaagtttcttcaccttggatttctcagcccttgcaaagtttctacacctctttgagcaaaatttaaaggtgcgccttatttctttagtacaataagaaagtcttatacatgcctcatccccatttagttgcacctcaaatctttactggaaatgttgtttttgacattagaaacgttgatcatggacctgagaaacaaaatagattttaagccttaataatggtccattttacaatattttccttaaagtctctgtcaattccacgaccaagaattatatttgaggtcatcaccaacgttttatgatgatagcccaaatttacagtgttattataaccaggagcatcacatggatttgtaaagttaaagaatggcctatcttatctattattgcgtaaatgtccatgtaatgctcttcattataatgatat

SEQ ID NO: 5221 - DNA, 2271 bp, Vitis vinifera
gccagttcgcccacagagtcaaatcttgttcctatatctatatatatatatatataccccttaaccttcataatatctgatctcggtcgagtcattcatctcaggagaaaatcagagagagagtatgggcagttcagggttctcatggaaactggcggatcacccgaagctcccgaaagggaagatcttgggcatggtggtgctcgacggatggggcgaggccaatcccgatcagtacaactgcatccacgtcgccgacactcccaccatggattccctcaagaagggtgcccctgagaaatggagattggttaaggctcatgggagtgcagtagggcttccaactgaggatgacatgggcaacagtgaagttggccataatgctcttggtgctggacgcatatatgctcaaggtgcaaagcttgttgattttgctctggactctgggaagatctatgagggagaaggctttaagtatatcaaggagtgttttgaaactggcacattgcacctcattgggttgttgagtgatggcggtgtccactcccgtattgatcagttgcaattacttttaaaaggagctagtgagaatggtgcaaaaagaatccgtgtccatatccttactgatgggcgtgatgttttggatggttccagtgttgggtttgtagaaactcttgagaatgatcttgcaaaattacgggagaaaggtgttgatgcacagattgcatctggtggaggtcgtatgtatgtgacgatggatcgttatgagaatgattgggaagttgtaaaacgtggatgggatgcccaagttcttggtgaagcccctcacaagtttaggtctgctgtggaagctgtcaagaaactgagggaggacaccaaggccagtgaccagtacatacctccttttgttattgttgatgagaatgggaagcctgtgggcccaatagtggatggagatgctgttgttacatttaacttccgagcagatcgtatggttatgattgctaagtcgcttgaatatgaggactttgataaatttgatcgagttcgatttcctaaaatccattatgctggaatgcttcaatatgatggcgagttgaagcttcccaatcattaccttgtttctcctccagagatagagagaacatctggtgaatatttagtgcacaatggtgttcgtacttttgcttgcagtgagactgtcaaatttggtcatgttacctttttctggaatggaaatcgctcagggtattttgatccaagtatggaggaatatgtagaaattcccagtgattctggaattacatttaatgtcaaaccaaagatgaaggcagtggagattgctgaaaaggcaagggatgctatcctcagccgcaaattccaccaggttcgtgttaacctaccaaatggtgacatggtggggcacactggtgatattgaggctacaattgtagcttgcaaggctgctgatgaagctgtcaagatcatccttgatgcaatagagcaagtgggtggaatatatgttgtcactgcagatcatggaaatgctgaggacatggtgaagaggaataagtctggtcagcctctcttggacaagactggcaaaattcaaattcttacatctcacactcttcaacctgttcctattgcaatcgggggtcctggactggcggctggtgtgagattccgcaatgatgttccgggtggtgggcttgccaatgttgcagcaactgtgatgaatctccatggatatgaggcgcccagtgactatgagccaaccctgatcgaggttattgataactagaatgaaattagtcagtatggtatcataaattttggaggtaaagcgggcatgcaatgtaagagcatgtgaagtagagtatctatgttttggcaaaataagttgaatcaggagtgccctttctgcactggggaaagggtattttttgacataggacatatttatgtttgtgtcattgttacccagtctggggacgtgggattcaatgttatatgagtgagatttgacacaagcggatctttgttttggtttgataagagggaaccgacgcttggcaagttttgttcgttttaaaaaggttcattattatgtttttttggagggttatgcctaagatgaaacacaaaggcaaattgcataaaccctatcttaattactctgttatagtccacgtcattaaacttatattatgatggatctagtttttttcaaaagaaatcagtaatacgagacacgggcgtatttgtata

SEQ ID NO: 5222 - DNA, 2011 bp, Quercus alba
gagagagatgggaagctcgtggaaattggcggatcacccgaagcttccaaagggtaagaccgttgccgtggtggttctcgatggttggggcgaggccaagcctgatcagtacaactgcatccatgtcgccgagactcccactatggattccctcaaaaagggtgatcctgataaatggaggttggttaaggcccatggttctgccgtaggtcttccaacagaggatgacatgggcaacagtgaagttggtcacaacgcacttggggctggtcgcatcttcgctcaaggtgcaaagcttgttgacctagctcttgaatctggaaaactttatgacggagaaggttttaagtatataagtgaatgctttgaaaaaggcactttgcatctcattgggctattgagtgatggaggagtccactccaggcttgatcagttgctgttgttgcttaaaggatctagcgagcgtggtgctaaaagaatccgcgttcatattcttactgatgggcgtgatgttttggacggttcaagtgtgggatttgtagaaacacttgagaattaccttgcagaattacgtgggaagggtgttgatgcacagattgcatctggtggtggtcgtatgtacgtcacaatggatcgttatgagaatgattgggaagtggtcaaacgaggatgggatgcccaagtgcttggtgaagctccttttaaatttagaaatgctgttgaaggtgtgaagcagctgaggcaagcccctaaagccagcgaccaatacttgcctccttttgttattgccgatgagagtgggaaacctgttggtcctatagttgatggtgatgctgtggttacaatcaactttcgagcagatcgtatggttatggttgccaaggcttttgaatatgaagattttgacaagtttgatagagtgcgagtacctaaaatccgttatgctggaatgcttcaatatgatggtgaattgaagcttccaagccattaccttgtttctccaccagagatagatagaacatctggtgaatatctagtgcacaatggtatccgtacgtttgcttgcagtgagactgtcaaatttggtcatgtcactttcttttggaatggaaaccgctctgggtatttcaatgaagaactggaggaatacgttgaaattccaagtgattctggaattacattcaacgtccagccaaagatgaaggcattggagattggtgaaaaagtgagagatgctatacttagcggaaaatttgaccaggtacgtgttaacataccaaatggtgacatggtgggacatacaggtgatatcgaggccacagttgtggcttgcaaggctgctgatgaagctgtcaagatgatccttgatgcaatagagcaagttggtggaatttatgttgttactgcagatcatggtaatgctgaggacatggtgaagaggaacaaaacagggcaacctcaacttgacaagggtggcaaaattcaaatactcacttctcatacttgtcagccagtgccaattgcaattggaggtcctggattagcacctggttgcagattccgcagggatattcctactggtgggctagccaatgttgctgcaactgttatgaatctccatggatttgaggctcctggtgactacgagccaacccttattgaagttgttgatatctagggcagcataaagatttgattctttaatgcatggagttagatataggttacaatgcaactcagaaggctgcggagtatggaatgctatcatgataaataagtttttatttcttaccaaaaaagaaaaaagaaacagtcaccggtatggtggcttcggtattttgggctgtctgtggaggtttacagaacagtatggctaaaatggagtttttgttatatcttttcttaatcatgatttttgtcatgattcggtttgcattaaacgttcctgtttagactttagattgaatggttttcagctcaaaaggcttaagcttaacaggcttgttctata

SEQ ID NO: 5223 - DNA, 2013 bp, Trigonella foenum-graecum
caggttaagagtttggtcgtgtttggtttccctctgtgacatttgttcagttgttagttgcgcctctctcacaacatcgttcgttaatttagaatctgttatagaaaagatgggtagcactgatttttcatggaaattacctgatcatcctaagcttccaaagggaaagactattgctgttgttgttttggatggttggggtgaggctaaccctaatgaatacaattgtattcatattgctgaaacacccaccatggattcccttaaaaagggtgctcctgaacattggagattggtgagggctcatggtaaagctgttggacttccaactgaggatgatatgggtaatagtgaagtaggtcacaacgccctcggtgccggtcgtatttttgctcaaggtgcaaagcttgttgacattgctctagaaactggaaagattttcgaaggagatggtttcaattacataaaagaaagcttcgaaactggcacattgcatctgattggattactgagcgatggtggagttcactccagacttgatcaagtgcagttgttgcttaaaggagccagcgagcgaggtgttaaaagaatccgtctccatattcttacggatggtcgtgatgttttggatggctcaagtgtgggttttgttgaaacccttgaaaatgatcttgcaaaattgcgtgagaaaggtattgatgcaaagattgcatcaggtggaggtcgcatgaatgtcacaatggatcgttatgagaatgactggggtgttgtgaaacgtggatgggatgctcaagttctcggtgaagcaccttttaagttcacaaatgctcttgaggctgtcaagacactgagagcagaaccaaaggccaatgaccagtatctgcctccttttgttattgttgatgagaatggaaaatctgtcggtcctatagttgatggcgatgctgttgttacatttaacttccgggcagatcgtatgactatgcttgctaaggctcttgaatatgaaaattttgacaactttgatagagtacgtgtccctaaaatccgttatgctggtatgcttgaatatgatggtgaattgaagcttccacgccattaccttgtttctccaccagagatcgacaggacttctggtgaatatttagtcaaaaatggtgttcgcacttttgcttgcagtgagactgttaagtttggtcatgtcacatttttctggaacgggaaccggtctgggtattttaatgacaaactggaggaatacgttgaaattccaagtgactctgggataacattcaatgaacaaccactaatgaaggctgtggagattgctgagaaggcaagggatgcaattcttagcggtaaatttgatcagattcgtgtcaacctaccaaacggtgacatggtggggcatacaggtgacattgaagcaacaattgtggcctgtaaggcagctgaccaagctgtgaagattattcttgatgcaattgagcaagtaggtggaatttatgttgtcactgctgaccatgggaatgcagaagatatggtcaagagggacaagtctggaaaacctcagctaaaggatggaaaagtccagattcttacttctcatactctcgagccagtgccaattgccattggaggtcctggattggctcctggtgtcagattccgcaacgatgttcccaccggtgggttggccaacgtagctgcaaccgtgatgaatcttcatggatttgaggctccaagtgactatgagacaactctcatagaagtagttgataaatgagaaacaaatagatgatgagtttttttacaattttcagcaacttttaaataattttgaactttccattcctccacacatgtgttgtggacttttgttcttcttaaatggctgtaatagtctccggttgacagaacaatatactaattttgaacgcagttattttcttttgaactttagttgtgctgaataagaatcagattagcattgtcaatcaaatataaacttag

SEQ ID NO: 5224 - DNA, 1964 bp, Phalaenopsis aphrodite
tctctataaaaggagacattggggctgcgattttctcccacagatctgcgaaatctgaagttcttgcgagcgtgtacttgaggaaatgggtagctttgatttttcatggaaactggcggatcacccaaagcttccgaaggggaagacggtagccgtagttgttttggatggatggggggaggctaaacctgatgaatacaattgcatccacacagccaagacgccgacgatggattcccttaagacgggtgctcctgaaaaatggcgcttggttagggctcatgggacagcagtggggcttccaactgaagatgatatgggtaacagtgaagttggacataatgcactcggggccggacgcatctttgcacaaggggctaagcttgtggatcttgctcttgcctcgggaaaaatatatgaaggagatggttttaaatacatcaaagaatcctttgacaaaggtactttgcatttgattggattgctaagtgatggaggtgttcactcccgccttgatcaattacagctgctgctgaaaggtgctagcgagaatggcgccaaaagaatcagagtacatttttaactgatggccgtgatgtcttagatggaagcagtgtaggctttgtggaaacccttgaaaatgaccttaaaatttacgtgaaaatggcattgatgcacagattgcgtctggtggtggacggatgtatgttactatggatcgttatgagaatgattgggatgttgttaaacggggctggtatgctcaggttcttggcgaagcaccttacaagttccaaaatgcagttgaagcggtgaaagagctcagaaaggaacctaaggctaatgatcaatatttgcctccatttgtcatagttgatgagagtggtaaagcagtcggcccaatagtggatggtgatgctgtcgtcacgtttaacttccgagcggaccgaatggttatgcttgctaaagctcttgaatatgataactttgataaatttgaccgtgtccgttttccaaagattaaatatgctggaatgcttcaatatgatggcgaattaaagcttccaaactattatcttgtttctcctccagagatagataggacatcaggtcaataccttgtgaagaatggtattcgtactttcgcttgcagtgagacagtgaagttcggtcatgtcacctttttctggaatggaaatcgatctggatgctttgattcaacactggaagagtatgttgaaattccaagtgatgttggaatcacctttaacgttcagcctaaaatgaaggcacttgaaattgccgaaaaggcaagggatgctattctcagcggcaaatttgaccaggtacgagttaatataccgaacggtgacatggtaggccacactggtgatattgaggctaccactgtggcttgtgaggctgcagatgtagctgtaaagatgattcttgatgccattgtgcaagtgggtggcatctatgttgtcactgcagatcatggcaatgctgaggacatggtgaaaaggggtaaatctgggcagccactttttgacaaagaagggaaagttcaaattctcacctctcatacccttcaaccggttcctatcgccatcggcggccccggcttgagtcccagtgttcgtttccggagtgatgtgccagatggtggccttgccaatgttgctgctactgtgctgaacttccatggctttgaagctcccagtgactatgaaaccaccctaattgaagtagttgagaactaaatatactgtgtaattttctatttataatatgctaatatgatttttatattacttatgctcatagaaaatcttaaaataagtttactccattgaagtggagaatggtcttgaggggcggtggtcaaagttttgggatgtttcattatagtttgtatttatgtgtggagtttctcccacagtgactttcttgctttgaatatt

SEQ ID NO: 5225 - DNA, 2022 bp, Tropaeolum majus
ttgacttctcctcctttaattcttcattttcactcccaaactcatatttccatctaaattcttttcagatcaaagacaaagatgggtagctcaggagtcaactggaagctggcggatcacccaaaactcccaaaggataagatccttgccatgatcgttttggatggatggggcgaggcaaaccctgataagtataactgcatccacgttgctgagacccccgttatggactctctcaaaaacggtgccccagataagtggagattaattaaagctcatggtactgctgttggccttccaactgaggatgacatgggaaacagtgaagttggtcataatgctctaggtgctggacgcatttacgctcaaggtgcaaagcttgttgatattgctcttgcctctgagaaaatttatgatgaagacggattcaagtacatatctgaatcttttgaaagtggtacattgcacctcattagcttattgagtgatggtggagtccattctcgtattgatcaattgcagttgttgctaaagggagctagcgagcgtggtgctaaaagaatccgtgtccatattctcactgatggacgtgatgttttggatggttccagtgtaggctttgcagaaactcttgagagcgaccttgccaagctacgtgagaatggtattgatgcacaggttgcatctggtggaggtcgaatgtatgtcacaatggatcgttatgagaatgactggagtgttgtgaaaagagggtgggatgcccaagtcctaggggaagccccatacaaatttaagagtgccgttgaagctatcaagacactgaggcaggaacccaaggcaaacgatcagtacttacctccatttgtcattgttgatgacagtgggaaggctgtgggtcctatcgtagatggtgatgctgtagttactatgaacttccgtgcagatcgtatggttatgcttgctaaggcacttgagtatgaaaattttaacaattttgatcgtgtgcgcttccccaaaatccgttacgctggaatgcttcaatatgatggagagttgaagctccctagtcgctatcttgtttctccccctttgattgaaagaacatctggtgaatacttggtgcacaatggtgtccgtacttttgcttgcagtgaaactgtcaagtttggtcatgtcactttcttctggaacggaaaccgctctggatacttcaaggaagacatggaagagtatgtggagattccaagtgacagtggaatcacattcaacgtcaaaccaaaaatgaaggcgcttgaaattgcagagaaggccagagatgctattcttagccgcaagttccagcaggtacgtgtcaacctacctaacagtgacatggtagggcataccggagacattgaggctacagttgttgcatgtaaggctgccgatgaggcggtcaagatgatcattgatgccatagaacaagtgagtggtatatatgtggtcactgcagatcatgggaatgctgaggacatggtaaagagagataaggctgggaagcctgctatggacaagagtgggaacattcagatactcacttctcatactctacagccagtgccggttgcaattggaggccctggattggcttctggtgttagatttcgcaaggatgtaccaacaggcggacttgctaatgttgctgctactgttatgaacctccacgggtatatagcacctgatgactatgagacaactctgattgaagtggtagatgcctagaatgatctgattagtttgattgttgcctagacttgaagttggaaataagcaacaattctatattactgttttgtttggagttcactttttggttactggtggaggcagacagaaaagtagttaaattatgagttactactccttgtactgtgtgattgatttcattatcacaaatagttgttttgatacttgtgatagtttttagttgacacaagaataagattgtttgatttggaatcttaatgctgatgttattgacgt

SEQ ID NO: 5226 - DNA, 2206 bp, Amorphophallus konjac
cttctcgtcccgtttctgcttttctaaatttgcaggcgtccctcgcagaacttcagtcatgggcagctctggattctcatggaagttggctgaccacccgaagcttccaaaggggaagacaattggccttattgttttggatggatggggcgaagcgaatccggacaaatacaactgtattcatgttgctgagacacccaccatggactcccttaaaaagggtgcaccggagaagtggaggctgataagagctcatgggatggctgtggggcttcctactgaagatgacatgggcaacagtgaagtaggacacaatgcattaggtgctgggagaattttttcccaaggtgctaagctggtggaccatgcactggcctctgggaaaatttatgaaggtgaaggttttaaatacatcaaggaatgctttgaccagggtaccttgcatttacttggattattaagtgacggtggggtccattctcggcttgatcaactacagttgcttctaaaaggtgctagtgagaatggtgccaagaggatccgggtccatgtcctcactgatggacgtgatgtgatagatggcactagtgttggttttgtggaaactcttgagaatgaccttgtaaagctgcgagagaagggtgttgatgctaaaattgcgtcaggcggtggtcggatgtatgtcacgatggaccgttatgagaatgactgggatgttattaagcgtggttgggacgcccaggttcttggtgaggcaccacacaaatttcgtagtgctgtggaagctgtcaagaagttgagagaggctcccaaggccaatgaccaatacttgccacctttcgttattgttgacgaaagtggaaaagcagttggtcctatagtagatggtgatgctgttgtgacattcaacttccgtgctgatcgtatggtcatggttgccaaagcatttgaatacgaaaagtttgataaatttgatcgtgttagggttccaaaaattcattatgctggaatgcttcagtatgatggcgaactgaagcttccaagccactatcttgttgctcctccagagatagagaggacttctggtgaatacctggtccataatggtgtccggacttttgcttgcagtgagaccgtcaagtttggccatgtcacctttttctggaatgggaaccggtctgggtattttgacccctcaatggaagaatatgttgaaattccaagtgatgttgggatcacatttaatgttcaaccaaacatgaaggccgtagagattgctgagaaggcgagggatgcaatcctcagtcgcaaatatgatcaggtacgtgtgaatctacctaatggagacatggtaggtcacactggtgacatagaggcaaccattgtggcttgcaaggctgctgatgaagctgtcaagatgattcttgatgcaatagagcaagttggtggaatctacgttgtcactgcagatcatggaaatgccgaggacatggtgaagagaaacaagagtggtcaaccactccttgacaaaagtgggaacattcaaattctcacttctcatacacttcaaccggttcctattgccattggaggtcctggacttgcccctggtgtcagattccggaatgacttgcctgctggtggcctagcgaatgtggctgctactgtgatgaatctccatggtttcgaggcccccagcgactatgaacccacgctcattgaggttgtcgacaactaacccagtgagatatgattatatgctgtcattacaggttttagactggcagctatatatcatttaggcgcgccttcgtttgctctggaggattctccctccccttcttttgtttgagtataaattggaattgtcacggccataaaaggaggcactgtttatggatacctcgttcgtgtcctgaggtgttgcaatttttggtttcgttacttatctcaataccaggcctcatccggctgatgtaactacccttgtggactgtcggcatttttgtcccttgggggatgtttcgaattgatatgtgatcgtgagcttttagacctgttcaggaagattttgaaataattaaaatgtggcgagagagagagagagagattgtaagcgtaggttcaagtacctggatagccatgtagtggttattttgacatttatatcaaaataggatgaatcttctcctattttgatataaat

SEQ ID NO: 5227 - DNA, 2047 bp, Amorphophallus konjac
cctctctccgcatttgctcttcgccgatctcaaagatctctagttatgggtagctctgatttctcgtggaagttggctgaccaccggcagcttccgaaagggaagacgatcgccgttgtggttctggatgggtggggcgaggcgaatggagaccagtacaactgcattcatgtggccgagacgccgacgatggactcgcttaagcagggtgctccagagaagtggagactgataagagctcatgggatggctgtggggcttcctactgaagatgacatgggtaacagtgaagtgggtcacaatgcactaggtgctggaaggatttatgctcaaggtgccaagttggtggattttgccctggcttctgggaaaatttatgaaggtgaaggctttaagtacattaaagagtgctttgatcaaggcaccttgcacttaattgggctacttagcgatggtggggtccactctcggctggatcagctacagttattactaaaaggtgcccgtgaaaatggtgccaaaagaatccgtgtccacatccttacagatggccgtgatgtgttggatggttcaagtgttggctttgtcgaaactcttgagaatgaccttgcaaagctgcgggagaaaggtgttgatgctcgtattgcatcaggtggtggtcgaatgtatgttacaatggaccgctatgagaatgactgggatgttgttaaacgtggatgggatgcccaggttcttggtgaggcaccatacaaatttcaaaatgctgtggaagctgtcaagaaactgagagaagatcccaaggctaacgaccaatacttgcccccttttgttatagttgatgaaagtggcaaggccgttggccctatagtagatggtgatgctgttgtgacattcaacttccgtgcagatcgtatggtcatggttgccaaagcatttgaatatgagaattttgacaaatttgaccgtgttaggtttccaaaggttcattatgctgggatgcttcagtatgatggtgaactgaagcttccaagtcactatctggtcgatcctccggagatagaaaggacttctggtgaatacttggtgcataatggcgtccgaacttttgcatgcagtgagactgtcaagtttggccatgtcacctttttctggaatgggaatcgatctgggtactttgacccctcaatggaagaatatgttgaaattcctagtgacagtggaatcacatttaatgttcaaccaaagatgaaggcagtggagattgctgagaaggcgagggatgctatcctcagtggcaaatttcaacaggttcgtgtcaatctacccaatggagacatggtgggtcacacaggagacatagatgcaactattgttgcttgcaaggctgctgatgaagctgtcaaaatgattcttgatgcaatcgagcaagtaggtgggatctatgttgttactgcagatcatgggaatgccgaggacatggtgaagaggaacaagaagggccagccactccttgacaagaatgggaagattcaaattctcacttctcatacacttcaaccagttcccattgccattggcggccctggcctcgctcctggtgtcagattgcggacggatgtgcctgatggtggccttgcaaatgtagctgccactgtgatgaatctccatggttttgaggctcccagtgattatgaacctaccctcattgaggttgtcgacaactgatatcagtgccgattgcaaccccatacttggcaaagcttttagcctcagccataccactcagatgctcttttgtgcatttgagctttgagtattctcttgtcattgttgttcatggtgaggtgctgcaaattttgtattatgggggttctgtcctgtaataccaggaacaccccgccccctctgtgatgtatgtgtcttataagttgaaagctctcgcgtgggcttctacattacacttgctgtttggttttttttctctttctgaagagcactcaaaataagaaaagagattaaagaggagggaagagactctggctccaat

SEQ ID NO: 5228 - DNA, 2206 bp, Quercus alba
agtacgcggggaaaagcgactttaggcgcacgccaagtgtcgttactgcgaatcaaacagcgggcgtaagaaattggtttatctgtgggaaggggtttctagggtcttttgtgttgtgtgtataaatatagacacaaacttgtgtgttgttttcattgatcgatcacacactcccgacgccttcagttgctgtttcaaacagaaagaaaggagagagatgggaagctcgtggaaattggcggatcacccgaagcttccaaagggtaagaccgttgccgtggtggttctcgatggttggggcgaggccaagcctgatcagtacaactgcatccatgtcgccgagactcccactatggattccctcaaaaagggtgatcctgataaatggaggttggttaaggcccatggttctgccgtaggtcttccaacagaggatgacatgggcaacagtgaagttggtcacaacgcacttggggctggtcgcatcttcgctcaaggtgcaaagcttgttgacctagctcttgaatctggaaaactttatgacggagaaggttttaagtatataagtgaatgctttgaaaaaggcactttgcatctcattgggctattgagtgatggaggagtccactccaggcttgatcagttgctgttgttgcttaaaggatctagcgagcgtggtgctaaaagaatccgtgttcatattcttactgatggccgtgatgttttggatggttcaagtgtgggatttgtagaaagtcttgagaattaccttgcagaattacgtgggaagggtgttgatgcacagattgcttctggtggtggtcgtatgtacgtcacaatggatcgttatgagaatgattgggaagtggtcaaacgaggatgggatgcccaagtgcttggtgaagctccttttaaatttagaaatgctgttgaaggtgtgaagcagctgaggcaagcccctaaagccagcgaccaatacttgcctccttttgttattgccgatgagagtgggaaacctgttggtcctatagttgatggtgatgctgtggttacaatcaactttcgagcagatcgtatggttatggttgccaaggcttttgaatatgaagattttgacaagtttgatagagtgcgagtacctaaaatccgttatgctggaatgcttcaatatgatggtgaattgaagcttccaagccattaccttgtttctccaccagagatagatagaacatctggtgaatatctagtgcacaatggtatccgtacgtttgcttgcagtgagactgtcaaatttggtcatgtcactttcttttggaatggaaaccgctctgggtatttcaatgaagaactggaggaatacgttgaaattccaagtgattctggaattacattcaacgtccagccaaagatgaaggcattggagattggtgaaaaagtgagagatgctatacttagcggaaaatttgaccaggtacgtgttaacataccaaatggtgacatggtgggacatacaggtgatatcgaggccacagttgtggcttgcaaggctgctgatgaagctgtcaagatgatccttgatgcaatagagcaagttggtggaatttatgttgttactgcagatcatggtaatgctgaggacatggtgaagaggaacaaaacagggcaacctcaacttgacaagggtggcaaaattcaaatactcacttctcatacttgtcagccagtgccaattgcaattggaggtcctggattagcacctggttgcagattccgcagggatattcctactggtgggctagccaatgttgctgcaactgttatgaatctccatggatttgaggctcctggtgactacgagccaacccttattgaagttgttgatatctagggcagcataaagatttgattctttaatgcatggagttagatataggttacaatgcaactcagaaggctgcggagtatggaatgctatcatgataaataagtttttatttcttaccaaaaaagaaaaaagaaacagtcaccggtatggtggcttcggtattttgggctgtctgtggaggtttacagaacagtatggctaaaatggagtttttgttatatcttttcttaatcatgatttttgtcatgattcggtttgcattaaacgttcctgtttagactttagattgaatggttttcagctcaaaaggcttaagcttaa

SEQ ID NO: 5229 - DNA, 2212 bp, Orobanche aegyptiaca
tagacatcatttggcatattccgccggagatcccaattagaaatatagtattaacagccttacgttgaataaatacccactctcctaatcacaggctttctccattcaaaccttgattcacttttcacactctacttttttcctgcacaaattcgttcataaaacagcccaagaaaatcgagatgggcagcactggattttcatggaaactgaaggatcacacaaagctgtcaaagggtaaaaccatagccatggtggttttggatggatggggtgaggccaaacccaatcagtacaattgcatccatgtggctgagacgcccaccatggattcacttaaaaatggtgcccctgatagatggagattggtgaaggcccatggtaaggcggtgggtctgcccacagacgatgacatgggcaatagtgaggttggacataatgctcttggtgctgggaggatttatgcacaaggtgctaagcttgttgatattgcccttgaaactggtaaaatcttcgatggagaaggtttcaattacgttaaacaatcttttgaaactggaacactacacctcattggattattaagtgatggaggtgttcactctaggctcgatcagttgcagttgttgcttaaaggtgctagcgagcatggtgctaaaagaattcgtgttcatattctcacggatggacgtgatgttttggatggatcaagtgtaggctttgttgagactcttgaaaaggatcttgcaaatctacgtgagaaaggtgttgatgcccggattgcatctggtggaggtcgcatgaatgttacgatggaccgttatgagaatgattgggatgtcgtgaagcgaggatgggatgcccaagtgctaggagaagcaccacacaagttcaagtgtgccgtcgaagctgtaaaaaagctgagagaaattcctaagatgaatgaccaatacttacccccttttgttattgttgatgaaagcgggaaggctgtggggccaattgtcgatggtgatgctgttgtaactttcaactttcgggctgatcgtatggtcatgattgccaagtcactcgagtacgaggactttgctaaatttgacagagttcgagtccctaaaatccgttatgctggaatgcttcagtatgatggtgaacttaagcttccgagtcactatcttgtttctcctcccgaaatcgaaagaacttctggagaatatttggtgaataatggtgtccgcacttttgcttgtagtgaaacagttaaatttggccatgtcacgtttttctggaatggaaatcggtcgggatacttcaacaaagacatggaagaatatgttgaaattccaagtgatagtggaattaccttcaatgtccaaccgaagatgaaagcattggaaatcgccgagaaggccagagatgccatacttagccgcaaattcgaccaggtacgtgttaacttacctaatggcgacatggtgggacacactggtgatattgaagcaacagttgtggcttgtaaggttgctgacgaggctgtcaagatgatccttgatgccatagagcaagtgggtggaatatatgttgtaacagctgatcatggaaatgccgaggacatggtgaaaaggaacaagaaaggcgaacctgagcttgacaagaatggcaaaatacaaatactaacttctcacacacttgagcctgttcctattgcaattggtgggcctgggctggcacccggtgtgagattccgaaaagacgttccacatggtggtctggctaatgtggctgcaaccgtcatgaacttacacggctttgaggcacctagcgactacgagccgacccttattgaggttgtcgacatttagactcatccgaattttgttctcaaattttttgacattgagagaacccgtggatgaatcttatggaattaatacgctattcgttccaataatgtacaactgaattttttacctcttcgtatacttgattgttaacataagatgcattgtattgcattgcatgctgaaatatcaggatataccttgccggtgattagacgatttgatgagttgagactataactatcgaatatcagaagctggttttgcctgtctttgcttttatttgatcaatatgtttgtttcttctgtattaacattggttttttggtaactgtttaattcaaggtgtaaactaacaaaaaaaaaaaaaa

SEQ ID NO: 5230 - DNA, 2100 bp, Fragaria vesca
agcgttttgtttataaatatcgtcagagtgttctggttctctcttctatctcgacgcttctcttccgcacacatcactgttcgctcttgcctccgccattgtttgcgatttcgtgagagagactgagaaaaaatggggagcactggagactggaaattggcggatcacccgaagcttccgaaggggaagactatcgcgctgatcgtcttggacggttggggcgaggccgaggccgatcagtataactgtatccacgtggcggagactcccaccatggattcgcttaagaatggtaaaccggataagtggagattagtgagagctcatggaactgctgtggggcttcctactgaggatgatatgggcaacagtgaggtcggtcacaacgctcttggtgctggccgtattttcgcccagggggcgaagcttgtggaccaagctcttgaatctggaaagatttaccaaggagaaggcttcaagtacattaaggaagtgtttgggaccggaactttgcatctcattgggttgttgagtgatggtggagtccactctcggcttgatcaagttcagttgttgcttaagggtgttgctgagcatggtgctaaaaggatccgtcttcatgttcttactgatggacgtgatgttctggatggttcaagtgtgacatttgctgaaacacttgaagaggaccttgcaaagttacgtgagaaaggtgtggatgcacagattgcatctggtggaggtcgcatgtacgtcaccatggaccgttatgagaatgactggtcagttgttaaacgaggatgggacgcccaagttcttggtgaagccccctacaaatttaagagtgctgttgaagcaatcaagacactgagagcagaaccaaaagccaatgaccagtatttacctccttttgttattgttgatgacagtggaaagcctgtgggcccaatagtcgatggtgatgctgttgttacattcaacttccgagcagaccgtatggttatggctgctaaggcatttgagtatgcagattttgataaattcgatagagttcgagttcctaaaatccgttatgctggtatgcttcagtatgatggtgagctgaagcttccaaaccgttaccttgtagaacctccagagattgatagaacatctggggaatatctaacttacaatggagtccgtacttttgcctgcagtgagactgtaaagtttggccatgttactttcttctggaatgggaatcgctctggatactttaaccctgaaatggaggaatatgtggaaattccaagtgatagtggaatctcattcaacgtccagccaaagatgaaggcagtggagattgccgaaaaggcaagggatgctattctgagcaagaagtttgaacaggtgcgtgttaacctaccaaatggggacatggtggggcatactggtgacattgaggccacagttgttgcttgcaaggctgctgatgaagctgtcaagattattcttgatgcggtagagcaagtgggtggaatttatgttgttacagctgatcatggtaacgccgaggatatggtgaagagaaataagactgggcaacctgctcttgacaagagtggaaagatccaaatccttacctcccacactctccagccagttccaattgctatcggaggccctggactgtcgcctggtgttcggttccgcagggatcttcccagtggtggtcttgccaatgtcgctgcaactatgatcaatctgcatggatttgaggcccctgctgactacgagccatccctcattgaagttgttgataactaggaaacagaaggcaacatagggaaaaggacttctcaatctagtatttcctaagttttgatgttaggttacattgccaaaggaggcgtcagctacagttaattttgttaaataagttggaaaactatgtttgctcacagctgctgtgagagtactggaatttggagaatgatagaaacaattgagatgaaaatggatttttttgctattttctgctttccaattagcaatttcttcccctgaacatgaatatcataaatgtctttgttaaattaaagttgccttaaaatccct

SEQ ID NO: 5231 - DNA, 2109 bp, Malus domestica
ggagaagcatagcattccagttacttctcgctctcttcaactcctctcttccacaagaaaaatcgagaaaaaggaaaatggggagctcaggaatcgactggaagttaccggatcaccctaagttgccgaaggggaaggtgatcggactcatcgttttggatgggtggggcgaggccaacgcagaccagtacaactgcatccatgtcgccgagacccccgtcatggattctctcaagaagggtgctcctgaaagatggaggttagtgagagctcacggaactgccgtgggacttcccacagaggatgatatgggcaacagtgaagtgggtcacaatgctctcggtgccgggcgtatttttgcccagggtgctaagcttgtcgacgctgcacttgcttccgggaaaatgtttgagggagaaggttttaagtacattaaggaatcctttgcgactaacacattgcatctcattggtttaatgagtgatggtggagtccattctcggctcgatcaattgctattgttgcttaaaggagctagtgagcaaggtgctaaaaggatccgtgtgcatgttctcactgatggacgtgatgttctggatggttcaagtgtgggatttgcagaaatccttgaaaatgaccttgcgaaattgcgtgagaaaggtgtggatgcacaggttgcatctggtggtggtcgtatgtatgtcaccatggatcgttatgagaatgactggagtgttgtaaagcgaggatgggatgcccaagttcttggtgaagctccctataaatttaagaatgtagttgaagctatcaagacattgagagcggaaccaaaggccaatgaccagtacctacctccttttgttattgttgacgacagtggaaagcctgttggcccaattgtggatggtgatgctgttgttacattcaacttccgagctgaccgtatggttatgcttgccaaggcacttgagtatgcagactttgacaagtttgatcgggttagagtccctaaaattcgttatgctggtatgcttcagtatgatggtgagctgaagcttccaagcaaataccttgtagaacccccagagattgatagaacatctggtgaatatcttacatacaacggtgtccgtacttttgcctgcagtgagactgttaaatttggccatgtcactttcttctggaatgggaatcgctctgggtattttaacgataaaatggaggaatatgttgaaattccaagtgatagtggaatcacattcaacgtccagccaaaaatgaaggcaattgagattgctgaaaaggcgagggatgctattcttagtggaaagtttgagcaggtacgtgttaacctaccaaactcagacatggtcgggcacactggcgacattgatgccacagttgtagcttgcaaggctgctgatgaagctgtcaagataatttttgatgcaatcgagaaagctggtggaatttacgtcgtcactgcagatcatggtaacgctgaggatatggtgaagagaaacaagactgggcaacctcttcttgacaagaatggcaacattcaaattcttacttcccatactctacagccagttccaattgcaattggaggtcctggacttgcacccggagttcgcttccgcaaggatcttcctagcggtgggctggccaatgttgctgcaaccgtgatgaacctgcacgggttccaggctcctagcgactacgagccatccctcatcgaagttgttgataactaggaaggcagcagcagcagcgcaaagaagagaactcccatctactatttcctaaattttgacttaggtttccgaacaccatggaaagaggcttgtcgattacagtttgttgttttattaaataagttcgaacaatgtccgctcacagcagcagcttttgtgagccggtacggtaatcggatcattttctcaggagaatgacagaactagaaagatcaaaaactggaatttttgctatttttatgctcttatcgattaccgtttaggttttgttgtcttcaaatatctcggtttatgaagaacattgtttttcggattgaaggtttaaatctcagtttataatttttcgtcttcc

SEQ ID NO: 5232 - DNA, 2106 bp, Malus domestica
attccagttacttctcgctctcttcaactcttctcttccacaagaaaaatcgagaaaaaggaaaatggggagctcaggaatcgactggaagttacctgatcaccctaagttgccgaaggggaaggtgatcggactcatcgttttggatgggtggggcgaggccaacgccgaccagtacaactgcatccatgtcgccgagacccccgtcatggattctctcaagaagggtgcgcctgaaagatggaggttagtgagagctcacggaactgccgtgggacttcccacagaggatgatatgggcaacagcgaagtgggtcacaatgctctcggtgccgggcgtatttttgcccagggtgctaagcttgtcgacgctgcacttgcttctgggaaaatgtttgagggagaaggttttaagtacattaaggaatcctttgcgactaacacgttgcatctcattggtttaatgagtgatggtggagtccattctcggctcgatcaattgctattgttgcttaaaggagctagtgagcaaggtgctaaaaggatccgtgtgcatgttctcactgatggacgtgatgttctggatggttcaagtgtgggatttgcagaaatccttgaaaatgaccttgcgaaattgcgtgagaaaggtgtggatgcacaggttgcatctggtggtggtcgtatgtatgtcaccatggatcgttatgagaatgactggagtgttgtaaagcgaggatgggatgcccaagttcttggtgaagctccctataaatttaagaatgtagttgaagctatcaagacattgagagcggaaccaaaggccaatgaccagtacctacctccttttgttattgttgacgacagtggaaagcctgttggcccaattgtggatggtgatgctgttgttacattcaacttccgagctgaccgtatggttatgcttgccaaggcacttgagtatgcagactttgacaagtttgatcgggttagagtccctaaaattcgttatgctggtatgcttcagtatgatggtgagctgaagcttccaagcaaataccttgtagaacccccagagattgatagaacatctggtgaatatcttacatacaacggtgtccgtacttttgcctgcagtgagactgttaaatttggccatgtcactttcttctggaatgggaatcgctctgggtattttaacgataaaatggaggaatatgttgaaattccaagtgatagtggaatcacattcaacgtccagccaaaaatgaaggcaattgagattgctgaaaaggcgagggatgctattcttagtggaaagtttgagcaggtacgtgttaacctaccaaactcagacatggtcgggcacactggcgacattgatgccacagttgtagcttgcaaggctgctgatgaagctgtcaagataatttttgatgcaatcgagaaagctggtggaatttacgtcgtcactgcagatcatggtaacgctgaggatatggtgaagagaaacaagactgggcaacctcttcttgacaagaatggcaacattcaaattcttacttcccatactctacagccagttccaattgcaattggaggtcctggacttgcacccggagttcgcttccgcaaggatcttcctagcggtgggctggccaatgttgctgcaaccgtgatgaacctgcacgggttccaggctcctagcgactacgagccatccctcatcgaagttgttgataactaggaaggcagcagcagcagcgcaaagaagagaactcccatctagtatttcctaaattttgacttaggtttccgaacaccatggaaagaggcttgtcgattacagtttgttgttttattaaataagttcgaacaatgtccgctcacagcagcagcttttgtgagccggtacggtaatcggatcattttctcaggagaatgacagaactagaaagatcaaaaactggaatttttgctatttttatgctcttatcgattaccgtttaggttttgttgtcttgaaatatctcggtttatgaagaacattgtttttcggattgaaggtttaaatctcagtttataatttttcgtcttccttcatacaaa

SEQ ID NO: 5233 - DNA, 2029 bp, Medicago truncatula
gtccaataaacaacccaaaaaacggtatttatatccaacgaaccaaccaaaccaaacacaacacaattcaacaggttaaggttttggtctgtgttaggttacctctgtgacatttgtgcaaacagttagtcgcgcctctcacacaataaaaaatcgttagttagaatctgatataaagaaagatgggaagcactgatttttcatggaaattaccggatcatcctaagctaccaaagggaaagacagttgctgttattgttttggatggttggggtgaagctaatgctaatgaatacaattgtattcacaacgctgaaacacctaccatggattcccttaaacagggtgctcctgaacattggagattggtgagggctcatggtaaagcagtaggacttccaactgaggatgatatgggtaacagtgaagttggtcataacgcgcttggtgccggtcgtatatttgctcaaggtgcaaagcttgttgacattgctctagaaactggaaagattttcgaaggagatggtttcaattacataaaggaaagttttgaaaccggcacattacatctcattggactgctaagtgatggtggagttcactccagacttgatcaagtgcagttgttgcttaaaggagctagtgagcgaggtgttaagagagtccgtctccatattcttactgatggtcgtgatgttttggatggctcaagtgtgggttttgtggaaacccttgaaaatgatcttgcaaaattgcgtgagaaaggtattgatgcacagattgcttcaggtggaggtcgcatgaatgtcacaatggatcgttatgagaatgactggggtgttgtgaaacgtggatgggatgctcaagttcttggcgaagcacctcataagttcacaaatgctcttgaagccatcaagacattgagggcagcaccaaaggccaatgaccagtatctgcctccttttgttattgttgatgagagtggaaaatctgttggtcctatagtcgacggagatgctgttgttacatttaacttccgggcagatcgtatgactatgcttgctaaggctcttgaatatgaaaaatttgacaacttcgatagagtacgtgtacctaaaatccgttatgctggtatgctcgaatatgacggtgaattgaagcttccaaaacattaccttgtttctccaccagagatcgacaggacttctggtgaatatttagtcaaaaatggtgttcgcacttttgcttgcagtgagactgttaagtttggtcatgtcacatttttctggaatgggaaccggtctggatattttgatgagaaactggaggaatatgttgagattccaagtgactctggcataacattcaatgagcagccattaatgaaggctttggagattggcgagaaggcaagggatgcaattcttagcggtaaatttgatcagatacgtgtcaacataccaaatggtgacatggtggggcatacaggtgacattgaagcaacagttgtggcttgtaaggcagccgacaaagctgtaaagatgattcttgacgcaattgagcaagtgggtggaatttatgtagtcactgctgaccatgggaatgcagaagatatggtcaagagggacaaggctggaaaacctctgctaaaggatggaaaagtccagattcttacttctcatactcttgagccagtgccaattgccattggaggtcctggattgactcctggtgtcagattccgcaacgatgttcccaccggtggtttggccaacgtagctgcaactgtgatgaatcttcatggatttgaggctccaagtgactatgagacaactctcatagaagtagtttgataaatgagaaacaaatagataatgagttttttacaattttcagcagtgtttaaataattttgaactttttcattcctccacacttgtttgtggacttttgttcgtatgaaacggctgtattagtctgcggttgacagaacaatatactaattttgaatgcagttattttgttttga

SEQ ID NO: 5234 - DNA, 2231 bp, Medicago truncatula
gtccaataaacaacccaaaaaacggtatttatatccaacgaaccaaccaaaccaaacacaacacaattcaacaggttaaggttttggtctgtgttaggttacctctgtgacatttgtgcaaacagttagtcgcgcctctcacacaataaaaaatcgttagttagaatctgatataaagaaagatgggaagcactgatttttcatggaaattaccggatcatcctaagctaccaaagggaaagacagttgctgttattgttttggatggttggggtgaagctaatgctaatgaatacaattgtattcacaacgctgaaacacctaccatggattcccttaaacagggtgctcctgaacattggagattggtgagggctcatggtaaagcagtaggacttccaactgaggatgatatgggtaacagtgaagttggtcataacgcgcttggtgccggtcgtatatttgctcaaggtgcaaagcttgttgacattgctctagaaactggaaagattttcgaaggagatggtttcaattacataaaggaaagttttgaaaccggcacattacatctcattggactgctaagtgatggtggagttcactccagacttgatcaagtgcagttgttgcttaaaggagctagtgagcgaggtgttaagagagtccgtctccatattcttactgatggtcgtgatgttttggatggctcaagtgtgggttttgtggaaacccttgaaaatgatcttgcaaaattgcgtgagaaaggtattgatgcacagattgcttcaggtggaggtcgcatgaatgtcacaatggatcgttatgagaatgactggggtgttgtgaaacgtggatgggatgctcaagttcttggcgaagcacctcataagttcacaaatgctcttgaagccatcaagacattgagggcagcaccaaaggccaatgaccagtatctgcctccttttgttattgttgatgagagtggaaaatctgttggtcctatagtcgacggagatgctgttgttacatttaacttccgggcagatcgtatgactatgcttgctaaggctcttgaatatgaaaaatttgacaacttcgatagagtacgtgtacctaaaatccgttatgctggtatgctcgaatatgacggtgaattgaagcttccaaaacattaccttgtttctccaccagagatcgacaggacttctggtgaatatttagtcaaaaatggtgttcgcacttttgcttgcagtgagactgttaagtttggtcatgtcacatttttctggaatgggaaccggtctggatattttgatgagaaactggaggaatatgttgagattccaagtgactctggcataacattcaatgagcagccattaatgaaggctttggagattggcgagaaggcaagggatgcaattcttagcggtaaatttgatcagatacgtgtcaacataccaaatggtgacatggtggggcatacaggtgacattgaagcaacagttgtggcttgtaaggcagccgacaaagctgtaaagatgattcttgacgcaattgagcaagtgggtggaatttatgtagtcactgctgaccatgggaatgcagaagatatggtcaagagggacaaggctggaaaacctctgctaaaggatggaaaagtccagattcttacttctcatactcttgagccagtgccaattgccattggaggtcctggattgactcctggtgtcagattccgcaacgatgttcccaccggtggtttggccaacgtagctgcaactgtgatgaatcttcatggatttgaggctccaagtgactatgagacaactctcatagaagtagtttgataaatgagaaacaaatagataatgagttttttacaattttcagcagtgtttaaataattttgaactttttcattcctccacacttgtttgtggacttttgttcgtatgaaacggctgtattagtctgcggttgacagaacaatatactaattttgaatgcagttattttgttttgaactttagttgtgctgaataagaatcagattagcattgtcaatcaaatactacaaatttagaatactttttggtcaaaaaaagaataatattcttttacttcagttatgtttggcaactatgatgtgtccttttttggtttcttgtcttttcatttgtatgaggagacatatgttattatctgttactacatcttgattgatg

SEQ ID NO: 5235 - DNA, 2123 bp, Phaseolus coccineus
ctaccaagaaacttgtatttataaataaaccaaaccacacaaaacagttcggtcttgttaggttaccttttgtgacatttgtgttgttagttgcggctgacaccgagaaacaaacaggagaaaaaaagggagaaagcgcagatgggtagctcaggtgtctcatggaaattggcggatcatccaaagctcccaaaggggaagacagtggctgtggtggtgttggatggttggggagaggccaagcccaacgagtataactgcatcgctaccgctgagacaccatgcatggattctcttaaaaagggtgcccctgaactgtggagattggttagggctcacggtaccgctgtaggccttccaacagaagatgacatgggaaatagtgaagttggtcacaatgcccttggagctggtcgcatatttgctcagggtgccaagcttgtcgacattgctctggccactggaaaattttttgaaggagaaggttttaattacataaaggaaagttttgcaaatggcacattgcatctcattgggttattgagtgatggtggagttcactccagacttgatcagttgcagttgttgcttaaaggagttggtgagcgaggtgttaaaagagtccgtgtccatattcttacagatggtcgtgatgttttggatggctcaagtgtggagtttgttgaaacccttgaaaatgatcttgcaaaattgcaggagaagggcattgatgctaagatagcatcaggtggaggtcgtatgaatgtctcaatggatcgctatgagaatgactggaatgttgtgaaacgggggtgggatgctcaagttcttggtgaagccccttataagtttacaaatgctcttgaagctgtcaagaagctgagggcagaaccaaaggccaatgaccagtatctgcctccttttgttattgttgatgagagcgggaaacctgttggtccgattgtcgatggtgatgctgtagttacattcaatttccgagctgatcgtatggtcatgattgccaagtctcttgaatatgaaaattttgacaaatttgatagagttcgtgttccaaaaatccggtatgctggaatgcttgaatatgatggtgaattgaaacttccaagtcattaccttgtttctccaccagagattgacaggacttctggtgaatatttagtgaagaatggtattcgtacttttgcttgcagtgagactgttaaatttggtcacgtcacatttttctggaatggaaaccggtctggatattttaatgcagaattggagaaatatgtggaaattcctagcgactctgggattacattcaatgaaaaaccaaacatgaaagcattgcaaattgctgaaaaggctagggatgctattcttagcaggaattttgatcaggtacgtgtcaacctaccaaatggtgacatggtgggtcatacaggtgacattgaggcaacagttgtggcttgcaaggctgctgatgaggctgtgaagataattcttgatgcaatagagcaagtgggtggaatctatgttgtcacagctgaccatggaaatgcagaggatatggtgaagagggataaatctggaaaaccagttctaaaggatggaaaagtccagattcttacttcccatactcttgagcccgtgccaattgctattggaggtcctggattgagctcgggtgtcagattccgcaatgatgttccatcaggtgggttggccaacgttgctgcaactgtgatcaatcttcatggatttgaggctcccagcgactatgagcagactctcatagaagtagttgataaataggaaccaatacaagagttataatattttgcaaaaatacagggaatgctgtagattatacagctcaaataattgaaggtttcatccctccacatacatcatatgtgaggtggttttgttctttaagagtttcccatttcagtctgcagatgacagtacactaattaatgccattttgacactttattgtgctgaattatatttgaatcaggaatttttcttgttcatctctgtgtaatgtttttaattaacattatgatcaaatatagctactctaaacagtaatattaaactttttatttgatcaa

SEQ ID NO: 5236 - DNA, 2283 bp, Fagus grandifolia
tagatttgttaatttaggagtgagaacacaggatttttggagcggctttgtccccacgccaagtgtacgaatcaaacagcggcgtgggaggtgggaagtggtttctgtgggagtaaattttatttgatatataactagtgtgggactctctcatttctcattactcattactcgtgtggttctttcgtcgcttacaactacatagttttgtgcccagaaagaaagataagaaaaaaagatggggagctcgtggaaattggcggatcacccaaagctcccaaagggtaagaccgtggctatgatagttttggatggctggggcgaggccaagcctgatcagtacaactgcatccatgtagccgagactcccaccatggattccctcaaacagggtaatcctgatacatggaggttggttagggcccatggtactgctgttggccttccaacagaggatgacatgggcaacagtgaagttggtcacaacgcacttggggctggtcggatctttgctcaaggtgcaaagcttgttgaccaagctcttgcctctggaaaaatttatggaggagaaggttttaagtatatcagtcaatcttttgaaactggaacattgcatctcattgggttattgagtgatggtggagtccactccaggcttgatcagttgcagttgttgcttaaaggagctagcgagcatggtgctaaaagaattcgtgttcatattcttactgatggccgtgatgttttggatggttcaagtgtaggatttgtagaaactcttgagcaagaccttgcaaaattacgtgagaagggtgttgatgcacaagttgcatctggtggtggccgcatgtatgtcacaatggatcgttacgagaatgattgggaagttgtcaaacgaggatgggatgcccaagtgcttggtgaagcccctcataaatttagaaatcctgttgaagctgtgaagaaactgagggaagtccctaaatccaatgaccagtacttgcctccttttgttattgtcgatgagaatgggaaacctgttggtcctatagttgatggtgatgctgtggttacaatcaacttccgagcagatcgtatggttatgattgccaaggcccttgaatatgaaaattttgacaagttcgatcgagttcgagtccctaaaatccgttatgctggaatgcttcagtatgatggcgaattactgcttccaaagcattaccttgtttcgccaccggagatagagagaacatctggtgaatatctagtgcacaatggtatccgtacttttgcttgcagtgagactgtcaaatttggtcatgtcactttcttttggaatggaaatcgctctgggtgtttcaacgcagaactggaggaatatgttgaaattccaagtgattctggaattacattcaacgtccagccaaagatgaaggcattggagattggtgaaaaggcaagggatgctatacttagccgaaaatttgatcaggtgcgtgttaacataccaaatagtgacatggtgggacatacaggtgatattgaggcgacggttgtagcttgcaaggctgctgatgaagctgtgaagatgatccttgatgcaatagagcaagttggaggaatttatgttgttactgcagatcatgggaatgctgaggacatggtgaagaggaacaagtcagggcaacctcttcttgacaagaatggcaacattcaaatactcacttctcatactcttcaaccagtgccaattgcaattggaggtcctggcttggcacctggtgtaaggttccgcaaggatgttcctactggtgggcttgccaatgttgctgcaactgtcatgaatctccatggatttgaggctccaagtgactatgagacaacccttattgaagttgttgataagtagggaagcataaagaatgatttctttaaggcgtcaagttagatttaggttacaatgcaactcagaaggctgtggagtacggcatgccatcaaataagttgttttttgttttttaaaaatttttgtcactgcaccggtatggtggcttcggtattttggattgtctgtcgatgttgacagaacagtatgtttaaaatggagtttttttgttatatgtttccttaatcatgatcatcatcatgatgcggttgtattaaacgttcctgatctagattggatggttttttcagctaaaaaggcttaagtttaacaggataattctatttctctcagcgtatgaatgctttaatgttgcacttttgccacaaaaaggggct

SEQ ID NO: 5237 - DNA, 1976 bp, Arabidopsis lyrata
cccaccatacctcaccacatcacccgcttcgtctctgcgaatctccatacgactctttgacaagctttcctctgtttctccgctgttatgggtagctccggcgacgttaactggaaacttgcggaccaccccaagcttcccaaaggcaaaaccatcggtttaatcgttctcgatggatggggtgaatctgatcctgatcagtacaattgcatccataaagctcccactcctgccatggattcccttaaaaacggaagacccgacacatggaggctgatcaaagcccacggtactgccgttggcctgcccagcgaagacgacatgggaaacagtgaagttggccacaatgctctcggagctggtcgaatttacgctcaaggtgctaagcttgttgatctcgctcttgcttctgggaaaatctatgaagatgaaggcttcaaatacatctctcaatcttttgagaaaggcactgtgcaccttattggtcttctaagtgatggtggagttcactctcgtcttgatcaagtgcagttgctgcttaagggttttgcagaacgcggtgctaagagaatccgcgtccatattcttactgatggtcgtgatgttttggatggttctagtgttggatttgtggaaactcttgaagctgacctcgctgatttacgttcgaaaggtgttgatgctcaggttgcatctggtggaggtcgtatgtatgtcacaatggaccgttatgagaatgattggagtgttgttaaacgaggttgggatgcacaagtccttggagaagctccccacaaattcaaaagtgctcttgaagcagttaagacactgagggccgaacctggtgccaatgaccagtacttgcctccgtttgttattgttgatgatagtggaaaggctgtgggtccaattgttgatggtgacgcagttgttactttcaatttccgtgctgatcgaatggtcatgcatgcaaaggcccttgaatatgaagatttcgataagtttgatcgcgtacgagtccctaagatacgttatgcaggaatgctccaatatgatggagagcttaagcttcctagccgctatcttgtttccccaccattgattgatagaacttctggtgaatatctggcacacaatggcgttcgtacttttgcttgcagtgagactgtgaagtttggccatgtaaccttcttttggaatggcaaccgctctggatatttcaatgaaaagttagaagagtatgttgagattccaagtgatagtggaatatcattcaatgtccagccaaagatgaaagctctggaaattgccgagaaggcaagggatgctatccttagtggcaagtttgaccaggtgcgtgtgaacctgccaaatggagatatggtgggtcatactggtgatattgaagcaactgttgttgcctgtgaagctgctgatcgtgctgtgaggacaatccttgatgccatagaacaggtcggagggatatacgttgtgactgcagatcacggaaatgccgaggacatggttaaaagggacaaatctggcaagcccgctctcgataaggaagggaaccttcagattcttacctctcacacccttaaaccagtgccaattgccataggaggtcctggcttgtcagcaggagttaggttcagacaggatatcgagacacctgggcttgcgaatgtagctgcgacagtgatgaacctccatggatttgtggccccgaacgactatgagccaagtctaattgaagtagtcgacaagtgatgattcttgttgttgtagttccctttaaattcccacctgagcctctctagactctgattctctttttatgttactattttcaccgctctctaataaggctcgtgatttttggggagccatactcgccggccctctcacgatgttgttcacgttataaactacgtttgattttatcctttccgtcataacataacttcattaaaaaa

SEQ ID NO: 5238 - DNA, 1945 bp, Cleome gynandra
tcggggtaccaaccatcgatctgtgctgattctctctcacaaccgaagttcgatttgctgtagccattcgtgggtctctccaaattctataacgtcttctccatcagctatgggtagctccgctgttgatgtcaactggaaactagaggatcatccgaaactccccaagggcaagcccatcgccgtcatcgtcttggatggttggggtgagtctgatcctgatcagtacaactgcatccacaaggctcctactcctgccatggactccctcaagaacggtgcccctgaacattggaggctcatcaaagcccatggtactgccgttggccttcctagcgaagatgacatgggcaacagcgaagttggccacaatgctcttggcgctggtcgcattttcgcccaaggtgctaagcttgtcgacattgctcttgagactgggaaaatctttgacggagaaggtttcaaatacatctctgaatcttttgacaagggcaccttgcacctcatcggacttttgagcgatggtggagtacactcccgcctcgatcagttgcagttgctgcttaagggtaccgctgatcgtggcgccaaaaagatacgagttcatattctcaccgatggtcgtgatgttctcgatggtagtagtgttgggtttttggaaactcttgaaaacgaccttgcaaaattacgcgagaatggtgttgatgcacggatcgcatctggtggaggtcgcatgtatgtgacgatggatcgttatgagaacgactgggatgttgtgaaacgaggatgggatgctcaagttctcggagaagctcctcacaagtttaaaaatgcggtagaagctgttaaaaagttgagggaggatactggttgtaatgaccaatatttgcctccttttgtcattgttgatgacagtggcaaggccgtgggcccaattgtggatggtgatgctgttgttactttcaacttccgggccgatcgcatggttatgcttgcaaaggcacttgaatatgaaaattttgacatatttgatcgtgtgcgattcccaaagatacgatacgctgggatgcttcaatatgatggtgagctgaagcttcccagccgttaccttgtttcgcctccagagatagatagaacgtctggcgaatatttggtacacaatggcatccgcacttttgcatgcagtgagactgtcaagtttggacatgtgacattcttctggaatggcaaccgctctggatatttcaacaacgacctggaggagtatgttgaaatcccgagtgatagtgggatatcatttaatgttaagccaaagatgaaagccctggaaatagccgagaaggcacgagatgcaatccttagtggcaagtttgatcaggtgcgtgttaacctgccaaatggagatatggtggggcatacaggtgatattgaagccacggttgttgcatgtgaggctgctgatgttgctgtgaagatgatccttgatgccatagaacaagtgggaggtatatacgttgtcactgcagatcatggcaatgccgaggacatggtgaagagagataaacatggcaagcctcttttgagcaaggatgggaaccttcagattcttacatctcacactctgaaaccagtgccaattgcgataggaggtcctggtttgtcagcgggagtgagattccggaaagatcttccaaccgggggacttgcaaacgtggctgcaacggtaatgaacctgcacggatttgtggctcccagcgactacgagccgacccttgtggaagtagcggagaactaaaaggatatatacactttgattgccattagaatgaatggcctattatttatcattgagctctccttttgttctgttttccgtttgcatctctgtcaaagtatcacaatacatttatacaactaataatccaacattgaaagatgttatttt

SEQ ID NO: 5239 - DNA, 1947 bp, Valeriana officinalis
ataaattgagaaagatggggagtactggattttcatggaagctggaagatcatcctaagctacccaaggataaagttgttgccgtcattgttttggatggatggggcgaagctaaggacaatcagtacaattgcatctctgttgccgaaacacccaccatggattcacttaagaagggtgcccctgaaagatggagattggtgagggctcatggtacggctgtgggacttcctacagaagatgatatgggcaacagtgaagttggccacaatgcccttggtgccgggcgtatttttgctcaaggagcaaagcttgtggatcttgctcttgaatctggtaaaatatttgaaggagaaggttttaagtacattaaggaatcttttggaaccggcacattgcaccttgttgggttgttgagtgacggaggtgtccattcacgtattgatcagttgcagttgttgctgaaaggtgctagtgagcatggtgctaaaagaatcagacttcacattctaacggatggtcgtgatgttttggacggttcaagtgtggggtttgttgaaactattgagcaggatcttttcgaattacgtgcaaaaggtgttgatgcccaaattgcgtctggtggtggtcgtatgtatgttaccatggatagatacgagaatgactgggaagttgtgaaaagaggatgggacgcccaagttcttggagaagcaccttacaaattcaagagtgctctagaagcagttaaggaactaagagctgctcccaaagcaaacgatcaatatttacctccatttgtgatcgttgacgagaatgacaaggcagtaggtcccatagtggacggtgatgctgtggtgaccataaatttcagagcagatcgtatggttatggctgctaaagcttttgaatatgaagattttgataaatttgaccgagttcgtgtacccaagattcgttatgctggtatgcttcagtatgatggcgagttgaaattacccaacaagtatcttgttgagcctcctgagattgaaagaacgtctggcgaatacttgacttataatggcgttcgtacttttgcttgcagtgagacagtgaaattcgggcacgtcacatttttctggaatggaaaccgatctggatattttaacccagaaatggaagaatatgtagaagttccgagtgatagtggcattacatttaatgttaagccaattatgaaggctgtagagattgccgagaaagcaagggatgctatacttagcggcaaatttcagcaggtgcgtgttaatttaccaaatggtgacatggtgggtcataccggtgatattgatgcgactgtagttgcttgtaaggctgctgacaaagctgtcaagatgattcttgatgcagttgagcaagtaggcggaatatacgttgtcactgctgaccatggaaatgcagaggacatggtcaaacgaaacaaaaaaggagagcctgagcttaaaaatggcaaaattcaaatcttaacttcccacactcttgagcctgttccgattgcaataggcgggccggggctattaccaggtgtgagataccgtacagatgttccgagcggggggcttgctaatgtggctgcaactgtaatgaatcttcatggttttgtcgcccctagtgattacgagaccacgttgattgaagttgtcgacacttgagtcttttttttttttctttatgtttttgttggaaacacaattggcatatcattatttggtcaattggatggttttctttttggttttggtttccatacttgagagagatctattttgagttaaaaaaaaaatgctcatcgtgcttagcatgactaataaagccgttttctttcttcttttaagcattgttgtgttgtgttctttctaactgctactctaagaacctacactaatgtggaaagtaaattgttctccg

SEQ ID NO: 5240 - DNA, 2008 bp, Eutrema parvulum
aacctaccatacctcaccacatcaacactcagtctctgcgaatttccatacgactctctgagctttctctgtatctcctccgctgctatgggtagctccggcgacgttaactggaaacttgaggaccaccccaagctccccaagcgtaaaaccatcggattgattgttcttgatggatggggtgaatctgaacctgatcaatacaattgcatccacaaagctccaactcctgccatggattcccttaaaaacggacgtcccgacacatggaggctgatcaaagcccatggcacagccgttggtctccccagcgaagacgacatgggaaacagtgaagttggccacaatgctctcggtgccggtcgaatttacgctcaaggtgccaagcttgtcgatctcgcccttgcttccgggaaaatctatgaagacgaaggtttcaaatacatttctgagtctttcgagaaaggcaccgtccaccttatcggacttttaagcgatggtggagtccactcccgtctcgatcaagtgcagttgctattgaagggtttctcagaacgtggcgctaaaagaatccgagtccatattcttactgatggtcgtgatgttttggatggctctagtgtcgggtttgtggaaactcttgaaggtgacctcgctgagttacgttccaaaggtgttgatgcgcagattgcctctggtggtggtcgtatgtatgtcacaatggaccgttatgagaatgattggactgttgttaaaagagggtgggatgctcaagtccttggagaagctccccacaaatttaaaaatgctcttgaagcagttaagacactgagggccgaacctggtgccaatgaccagtatttgcctccgtttgtcattgttgatgacagcggaaaggctgtgggtccaattgttgatggtgacgcagttgttactttcaatttccgtgctgatcggatggtcatgcatgcaaaggcgcttgaatatgaagatttcgataagtttgatcgcgtacgcgtcccaaagatacgctatgcaggaatgctccaatatgatggagagctaaagcttcctagccattatcttgtttcgccaccattgattgacagaacttcgggtgaatatcttgcacacaatggcatccgtacttttgcttgcagtgagactgttaagtttggccatgttaccttcttctggaatggaaaccgctctggatatttcaacgaaaagctagaagagtacgttgagattccgagtgacagtggaatatcattcaacgtccagccaaagatgaaagcgctggaaatagctgagaaagcaagggacgctatccttagtggcaagtttgaccaggtgcgtgtcaacctgccaaatggagacatggtgggtcataccggtgatattcaagctactgttgttgcctgtgaggctgctgatgttgctgtgaggatgatcctcgacgccatagaacaggtgggagggatatatgttgttactgcagatcacggaaatgccgaggacatggttaaaagggacaaagctggcaagcccgctctcgataaggagggaaaccttcagattctcacctctcacaccctgaaaccggtgccaattgccataggaggtcctggtttgtcagcaggagttaggttcagacaggatttggagacacctgggcttgcgaatgtagctgcgacggtgatgaacctccatggatttgtggccccaggcgactatgagccgagtctgattgaagtagtcgacaagtaatgaggatgtggtcgttgttccctttagaagtcccccccacctatgattctgcttaagttacgttttcttccttctcgtgcactttatttaataaggctcgtgatttttgggtagccattctttagactcgtcaccctcatctgtcgatgtgggtcaagttaaagactacatttgatgttctgttttattttgtttttaaaaggttttcagtattactaaacgaattacataaagtcta

SEQ ID NO: 5241 - DNA, 2166 bp, Tropaeolum majus
tgcccgggattcggccattacggccggggaccaccgatatcaacacgctacggccaatctcagtatttcttaagataatagagacaagtaaagatgggctgctcaggagaaatgaattggaaattggctgatcacccaaagcttccaaaggataaaatagtggccatggttgtcttagatgggtggggcgaggccaaacctgatcagtacaactgcatccacgttgctgacacccctgttatggacttcctcaaaaagggagccccggataagtggagattagtcaaggctcatggcactgctgttgggcttccaaccgaagatgacatgggaaacagtgaagtaggtcataatgcgcttggtgctgggcgcatttttgctcaaggtgcaaagcttgttgatcttgctcttgcctcggggaaaatttatgacgatgaaggatttaagtacatatccgagtcttttgaaaagggtacattgcaccttattggcttattgagtgatggtggagtccattcccggaatgatcagttgcagttattgctaaaaggagcaagtgatcgtggtgccaaaagaatccgtgttcatattctcactgatgggagagatgttttggatggttcaagtgttggttttgcagaaagtctcgtgaacgatcttgcaaaattacgtgagaaaggtgttgatgcgcaggttgcatctggtggaggtcgaatgtatgtaacaatggatcgttacgagaatgactggagtgttgtgaaaagaggttgggatgcccaagtcctgggggaagcgccacacaagtttaagaatgctgttgaagctattaagaaactgagggaagaacccaatgctaatgatcagtacctacctccatttgttattgttgatgacaatgggaaagctgtaggtcctatagttgacggtgatgctgttgtgacctttaacttccgagcagatcgtatggtaatgattgctatggctctcgagtatgaaaatttcaataaatttgatcgtgtgcgattcccaaaaatccgttatgctggaatgcttcaatatgatggagagttgaagcttccaagtcactatcttgtctctcccccggaaatagaaagaacatccggagaatacctggtgtataatggtgtgcgtacttttgcttgcagtgaaactgtcaagtttggtcatgttactttcttctggaatggaaatcgttctgggtattttaaggaagatatggaggagtatgtggagattccgagtgacagtggaataacattcaatgtccagccaaaaatgaaagcactggaaatcgccgagaaggcaagagatgctattcttagccgcaaatttcaccaggtacgtgttaacctaccgaacggtgatatggtagggcatactggagacatagaggccacaattgtggcatgcaaggctgctgatgaggctgtaaagatgattgttgatgcaatcgagcaagtgggtggaatatatgttgtaactgcagatcacggcaatgcggaggacatggtaaagagagataagtccggaaagcctctcgtggacaagaatggaaacattcagatacttacttcacatactcttcaaccagtgcctattgcaattggaggccctggattggcatctggtgttagattccggaaggatgtagctactggtgggcttgctaatgttgctgctactgtaatgaacctccatgggtttattgcgcctgatgactatgagccaactcttattgaagtggtggataactagaatgacatatgccataatatattgttggaccagcttacttgaaactgaaacttaattatgttcgtataaataattaattagcgtgtgatagctatgtgcaggggtgtctatgaatgagcagagctgttcgagctcgtatcgaaaaaaattgagcttgaactcgaatttgatactgttcgagtaagggtggtaaaatgggtttattctcagaggtggaaaaaataacccaataatatgggagtcgggctttgatttttaaaaattatcaattcagtccggtcagtacccgatccgattttcaaaagctcaactcgagctagtccacatcgagtcggatttagcccgaattgtgtgtgtaaaaaaatgagattttattatctttaatcatac

SEQ ID NO: 5242 - DNA, 1897 bp, Lippia dulcis
gtcttgcatagtttagctagtggccaatcaaatacaagatgggtagttccgggttttcatggaaattgaaggatcaccccaagttgcccaagggcaaaaccatcgccatggtggttttggacggatggggtgaggccaaggccaacaagtacaactgcgtccacgtcgccgagacccccacatggattcacttaaagatggggcgcctgatagatggagattggtgagggcgcatgggaatgccgtggggttgcctacggaggatgatatgggtaatagtgaggttggtcacaacgctctgggtgctggccggatctttgcccaaggtgcaaagcttgttgatattgctcttgaaactggaaaaatctatgatggagaaggtttcaattacatcaaagaatgttttgaacacggaactctccacctcattggtttgctaagtgatggaggtgtccactcgaggctcgaccaattgcagttgttgcttaaaggtgctagcgagcgtggtgctaaaagaatccgtgttcatgttctgaccgatgggcgtgatgttttggatggttcaagtgttggctttgttgaaactcttgaaaaggatttagctgacctctgcgctaaaggtattgatgctaaggttgcatctggtggaggtcgtatgtatgttaccatggaccgttatgagaatgattgggaagttgtgaaacgaggttgggatgcacaagttcttggagaagctccacacaagttcaagagcgctctcgaagcggtcaagaagctgagacagattcccaaaacaactgatcaatacttacctccatttgtgattgttgacgacaatggaaaatctgtggggcccattgttgacggtgatgctgtcgtgaccatcaacttcagggctgatcgtatggttatgttagcaaaggccctcgaatacaaagactttgacaaatttgaccgggttcgagtccccaacattcgttacgctggaatgcttcaatatgacggtgaacttaaacttccaagccattacctcgtttctcctcctgagattgatagaacatcgggagaatatttagtgcataatgggatccgtacttttgcttgtagtgagacggtcaagtttggccacgtcacgtttttctggaacgggaatcggtccggatacttcaaccctgaaatggaagaatatgttgagattcaaagtgatgttggtattacctttaatgtccagccaaagatgaaggctgtgcaaattgctgagaaggccagggatgccatacttagtgggaaatttgaccaagttcgtgtgaacatacctacccccgacatggtgggacacactggtgacattgaagcgacagttgtggcttgtaaggctgctgatgacgccgtcaagatgatcctggatgcaatagagcaagttggcggaatatatgttgttacagccgatcacgggaatgctgaggatatggtgaagagaaacaaaaagggtgaacctcttctcgacaagaatggcgatgttcagattcttacttcccacactttagaaccggttcctattgcaattggtggtccagggctggcacctggtgtaagattcaggaaagacgttcccaacggtggtcttgccaatgtggctgcaaccgtcatgaacctacatggactcgaggctcccgaggattacgagacaacgctaattgaggttgtcgacaattagatctttttaaaatctgctgagaagaaagtgtggtaatacactatattattccattgttttgaataaacacttgtttgcctgcccgtacaattcaccagattttgaagttatttgttatagtgcatttccaaagatgctatatgtacgccaaattataatggaggtgtacacgagttgagc

SEQ ID NO: 5243 - DNA, 2325 bp, Prunus persica
ggagcattatagttgtttctgccttcttcaactattctcttccacacaccactctggtcttgtgactcttgagatagaagaaaagagaaaaatggggacctcaggattcaattggaaattggcggatcacccaaagcttccaaaggggaagaccattgggctcatagttttggatggctggggcgaagctaatcccgatcagtacaactgcatccatgtcgctgagacccccgtcatggattcatttaagaagggtgctcctgaaagatggaggctagtgagagctcatggaactgctgtgggtcttcctacagaggatgatatgggcaacagtgaagtcggccacaacgctctcggtgccgggcgtatttttgcccagggtgcaaagcttgttgacagtgcccttgagactgggaaactttatgaaggagaaggtttcaagtacattaaggaatcttttcctactaacacattgcatctcattggtttattgagtgatggtggagtccattctcggctagatcaactgctattgttggttaaaggagctagtgagcgcggtgctaaaaggatccgtgttcatattctcactgacggccgtgatgttttggatggctcaagtgtgggatttgcggaaacacttgaaaattaccttgcacaattgcgtgagaaaggtgtggatgcacaaattgcgtctggtggtggtcgcatgtacgtcaccatggatcgttatgagaatgattggggagttgtaaaacgaggatgggatgcccaggttctaggtgaagctccccacaaatttaagaatgctgttgaagctatcaagacgttgagacaggaaccaaacactagtgaccagtatctacctcctttcgttattgttgatgagaacggaaagcctgtgggcccaatagtggatggtgatgctgttgttacattcaacttccgcgcagaccgtatggttatgattgccaaggcgctcgagtatgctgattttgacaaatttgatagagttcgattccctaaaatccgttatgctgggatgctgcagtatgatggtgagctgaagcttccaagcaaataccttgtagaacctccagagatagacagaacatctggtgaatatctaacgtacaatggtgtccgtacttttgcctgcagcgagactgttaaatttggacatgtcactttcttctggaatgggaatcgttctgggtattttaaccctcaaatggaggagtatgtggaaattccaagtgatagtggaatcacattcaacgtccagccaaaaatgaaggcagtggagattgccgaaaaggcgagggatgctattcttagtaagaaatttgagcaggtacgtgttaacctaccaaatagtgacatggtggggcatactggtgacattgaggccacagttgttgcttgcaaggctgctgatgaagctgtcaagataattattgatgcaatagagcaagtgggtgggatttatgtcgttactgcagatcacggtaatgctgaggatatggtgaagagaaacaagaaagggcaacctcttcttgacaagaatggcaacattcaaattcttacctcccacactcttcagccagttccaattgcaattggtggtcctggactggcacctggcgtccagttccgcaaggatgttcccaatggtgggctggccaatgtcgctgcaaccgtgatgaatctgcatggatttgaagctcctgcagactatgagacgacactcattgaagttgttgataactaggcagcatgatagaggagagggttgaatctagtatttcctaaattttggcttaggttacaatgtcatgcgaagaggctgtcgatttcagttgctattacagcttgttattttgttaaataagttataaaaccatgcatgctcagagaagcagctgtgtgctatggtaattggatcaccgtctctggaggaggacaggacaagaaagatgaaaatggatttttgctgtttcttgcttttatcacctttcgtggcggtgtttttaataacgtttcttggattgaagttttaattcccagatgaataatttcgttctaaattgtatatttcctttttaacagtcggaagttcgagaaaatcttaattaatagtaatgacgttgatatgacagggtcttaaagccgattgtttctgtacaacattgtcattcatgagcttcgaactcatatactccgagtccttttgaacttgtaaactcgctcctctaatgaaagtggagattaaatactgttacatcattcggcgagtttttgctaatttaatctgaatttcagttg

SEQ ID NO: 5244 - DNA, 1992 bp, Tropaeolum majus
agataatagagacaagtaaagatgggctgctcaggagaaatgaattggaaattggctgatcacccaaagcttccaaaggataaaatagtggccatggttgtcttagatgggtggggcgaggccaaacctgatcagtacaactgcatccacgttgctgacacccctgttatggacttcctcaaaaagggagccccggataagtggagattagtcaaggctcatggcactgctgttgggcttccaaccgaagatgacatgggaaacagtgaagtaggtcataatgcgcttggtgctgggcgcatttttgctcaaggtgcaaagcttgttgatcttgctcttgcctcggggaaaatttatgacgatgaaggatttaagtacatatccgagtcttttgaaaagggtacattgcaccttattggcttattgagtgatggtggagtccattcccggattgatcagttgcagttattgctaaaaggagcaagtgatcgtggtgccaaaagaatccgtgttcatattctcactgatgggagagatgttttggatggttcaagtgttggttttgcagaaagtctcgtgaacgatcttgcaaaattacgtgagaaaggtgttgatgcgcaggttgcatctggtggaggtcgaatgtatgtaacaatggatcgttacgagaatgactggagtgttgtgaaaagaggttgggatgcccaagtccttggggaagcgccacacaagtttaagaatgttgttgaagctattaagaaactgagggaagaacccaatgctaatgatcagtacctacctccatttgttattgttgatgacaatgggaaagctgtaggtcctatagttgacggtgatgctgttgtgacctttaacttccgagcagatcgtatggtaatgattgctatggctctcgagtatgaaaatttcaataaatttgatcgtgtgcgattcccaaaaatccgttatgctggaatgcttcaatatgatggagagttgaagcttccaagtcactatcttgtctctcccccggaaatagaaagaacatccggagaatacctggtgtataatggtgtgcgtacttttgcttgcagtgaaactgtcaagtttggtcatgttactttcttctggaatggaaatcgttctgggtattttaaggaagatatggaggagtatgtggagattccgagtgacagtggaataacattcaatgtccagccaaaaatgaaagcgctggaaatcgctgagaaggcaagagatgctattcttagccgcaaatttcaccaggtacgtgttaacctaccgaacggtgatatggtagggcatactggagacatagaggccacaattgtggcatgcaaggctgctgatgaggctgtaaagatgattgttgatgcaattgagcaagtgggtggaatatatgttgtaactgcagatcacggcaatgcggaggacatggtaaagagagataagtccggaaagcctctcgtggacaagaatggaaacattcagatacttacttcacatactcttcaaccagtgcctattgcaattggaggccctggattggcatctggtgttagattccggaaggatgtagctactggtgggcttgctaatgttgctgctactgtaatgaacctccatgggtttattgcgcctgatgactatgagccaactcttattgaagtggtggataactagaatggcatatgccataatatattgttggaccagcttacttgaaactgaaacttaattatgttcgtataaataattaattagcgtgtgatagctatgtgcaggggtgtctatgaatgagcagcgaaaaaattgagctcgaactcgaatttgatactgttcgagtaagggtggtaaaatgagtttattctcggaggtggaaaaaataacccaataatatgggagtcgggctttgattttttaaaaaattatcaattcagtccggtcagtacccgatccgattttcaaaag

SEQ ID NO: 5245 - DNA, 2457 bp, Theobroma cacao
gccgtcaccttcttgtcattcgtcaggttttaggattcacttttcagcgttcactatttcacctatcgtcgctggtttttcgatttttcatttataaatagtgaaccctccgtctgttgtaaccaaaaactaaaaaaagggcaacatttgttaacaatgaggagttcaggacaggtgtcgtggaggttggaggatcaccctaagcttccaaagggtaagaccgtggccgttgttgttctcgatggctggggcgagaacaagcccgatgaattcaattgcatccatgttgcccaaactcccaccatggactccctcaaacagggtgcgccagaaaaatggagattaatcagagctcatggaactgctgtagggcttccaacagaggatgacatgggaaacagtgaagttggtcacaatgctcttggtgcagggcgcatttatgcccaaggggctaagcttgttgatcttgctcttgcctctgggaaaatctatgagggagaaggatttaagtatataagcgaatcttttgaaaagggaactctgcacctgattggattacttagtgatggtggtgtccactcccgacttgatcaattgcagttgttgctgaagggagctagtgatcatggtgctaaaagaattcgtgttcatgttctcactgatggtcgtgatgttttggatggttcaagtataggctttgtggagactcttgagaatgaccttgcaaaattacgtgagaaaggagttgatgcccagattgcatctggtggaggccgcatgtatgtcacaatggatcgttatgagaatgactggaatgttgtcaaacgaggatgggatgctcaggttcttggtgaagcccctcacaagtttacaaatgctgttgaagctgtgaagaaattgagggaaaatgctaatgaccagtacttgcctccctttgtcattgttgatgagaacaagaaggctgtgggcccgatagtagatggtgatgctgttgttacttttaacttccgagcagatcgtatggttatgcttgccaaggcacttgaatatgaagattttgataaatttgatcgtgtaagattccctaaaattcgttatgctggaatgcttcagtatgatggcgagttgaagcttccaagctgctaccttgtttctccacctgagattgaaagaacatccggtgaatatttggtgcataatggtatccgtacttttgcctgcagtgagactgtcaaatttggtcatgtcactttcttctggaatggaaatcgctctggctatttcaaacctgaaatggaagaatatgtggaaattccaagtgatattggcattactttcaatgttcagccaaagatgaaggcattggagataggtgaaaaggctagggatgcaattctgagcggcaaatttgaccaggtacgtgtgaacataccaaatagtgacatggtgggccatacaggagatatccaggccacagttgtggcatgcaaggctgctgatgaagctgtcaagatgatccttgatgccatagagcaagttggtggaatatatgttgtgacggcagaccatggcaatgctgaggacatggtgaaaaggagtaagtctggccaacctctttatgacaagaatggcaacctccagatactcacctcccacacttgtcaacctgtacctattgcaattggaggtccaggagtggcacctggtgttagattccgcaaggatgttcctgatggtggacttgccaatgtggctgcaaccgtcatgaatctccatggtttggtagctcctaatgactatgagccaacactcattgaagtagttgacaactagggtagcatgagaacatgccctagattatgtattgcgctattttgcactaaggcgaatgccgaatcaaacaatttagaataagtattatttggttgaggcaaaaattttaaatggtgtattttggatgccatttgtggttgagttataattccgaattgtgtacggaaaattaattttgggcttcaatgcctctaaattttacctcataattatctctcactcgttcttgtttcttctgcactgttgtttcttataaatggttagttttaggattgatttccgttcatatatttattataatgttgttgtattgctttcccagtgaaatttgatttggtcatgaggagaaaggagtgattgtggagacaaggagaagggtgtgagcagtgcaaccgatttgggtgttagcagtggagtttgaactcttgtatgggccaagcctacaaaacgtctcactttcgatagaactctgtttcctctttaacatcattgggttttcctctctctaaatcgtggcatataatactcactactcaagttaagcatattccaaatgtcaagctttgcaaattataccatgtgtatcacgttaaagctagtttataatacaagatcatgtataag

SEQ ID NO: 5246 - DNA, 2071 bp, Manihot esculenta
ggttttttgttttctctgtttcattgttgtttatttttattagtcccaggatttgattttgctctcgctggttaattctattcagatctttttttttgaggtataaaaaagaaatggggagctctggggaattcacatggaagctggcggatcatccaaagcttcccaaggggaagactattgcaatggttgttttggatggttggggtgaggctaaacccgatcaatataattgtatccatgttgctgatactcccaccatggactcattcaaaaagactgccccagagaaatggaggttgattagggctcatggaactgcggtgggtctcccaactgaagacgatatgggcaacagtgaagttggtcacaacgctcttggcgctggacgcatttatgctcaaggtgcaaagcttgttgaccttgctcttgcctctggaaaaatctttgatggagaggggttcaagtacataaaagaatgttttgcaactggtactctacaccttattggcttattaagtgatggtggagttcactccaggcttgatcagttgcagttgttgctaaaaggtgcagctgaacatggtgctaaaagaatcagagttcatgtgcttactgatggacgcgatgtaatagatggtacaagtgttggctttgtagaagctcttgagaatgacctggcaaatttacgtgggaaaggtgttgatgcacagattgcatctggtggaggccgcatgtatgtcacaatggatcgctatgagaatgactggaatgttgtgaaacgaggatgggatgcccaggttcttggtgaagccccacataagtttaagaatgctgttgaagctgtcaagaaactaagagaagaacccaaagccaatgaccagtacttacctccttttgtcattgtcgatgagagtgggaagcctgtaggcccaattgtggatggtgatgctgttgtaacgttcaacttccgtgctgatcgtatggttatgcttgctaaggcccttgaatatgagaattttgacaaatttgatagagtcagattccctaaaatccgttatgctggaatgcttcagtatgatggcgagttgaagcttccaagccattaccttgtatctcctcccgagatagaaagaacatctggtgaatatttagtccacaatggtgtccgtacctttgcttgcagtgagactgtcaaatttggtcatgtcactttcttctggaatggaaatcgttctggatattttaacgcagaaatggaggaatatgttgaaattcccagtgatgttggaattacattcaatgtccaaccaaagatgaaagcaatagagattgcagagaaggcaagggatgctatcctcagcctcaaattccaccaggttcgtgttaacctaccaaatagtgacatggttggacatacaggagacattgacgccacagttgtggcgtgcaaggctgcagatgatgctgtaaagatgataattgatgctatagagcaagttggtggaatatatgttgttactgcagatcacggcaatgctgaggatatggtgaagagggacaaatctgggaaacctcttctcgataagagtggcaacattcagatactcacttctcacacccttcagccagtgcctattgcaattggaggccctggattggcagctggtgtcaggttccgcaatgatgttcccagtggaggacttgctaatgtggctgcaactgtgatgaatctccatggatttgaggctcctagtgactatgaaaccaccctgattgaagtagtcgataactaggattgaagaaaacccatagattaacttagctttgcttaaattttgatcagcaactgagcaatgcaaatctagttaaataagttaattttgagtctgctttgcggctccctattttggatttaaatctattttgcagtttcttcgtcttatttctttttcttttgagaattaatgtaccccattatttatggtagcatatagaagaagtgatgattgaaacaatgtcgttaactccagcattttttctttttgaaatctgatcttgagaggaattt

SEQ ID NO: 5247 - DNA, 1941 bp, Cleome spinosa
tctctgcttctttctcaaccccaaagttcgatttactctaggattcatcggtctgtccgatttctatcacgctcttcaccaacagcaatgggtagctccactggcgatgtcaacaactggaaactggaagaccatcccaagctccccaagggaaagccaattgccgtcatcgtcttggatggttggggtgagtccgatcccgatcagtacaactgcatccacaaggctcctactcctgccatggattccctcaagaacggtgcccctgatcggtggaggcttatcaaagcccatggtggtgccgttggccttcccagcgaagatgacatgggcaatagtgaagttggccacaatgctcttggtgccggtcgcattttcgctcaaggtgctaagcttgttgacactgcccttgcttccgggaaaatctttgatggagagggtttcaagttcatatctgaatcttttgacaagggcactttgcacctcatcggacttctgagcgatggtggagtccactcccgcctcgaccagttgcagttgttgctgaagggttcggtagaacgtggtgccaaaaggatacgagtccatattcttacagatggccgtgatgttattgatggtactagtgttgggtttgtggaaacacttgagaatgaccttgtgaaattacgtgagaacggtgttgatgctcggattgcatctggtggaggtcggatgtacgtgacaatggatcgttatgagaacgactggagtgttgtgaaacgaggatgggatgctcaagttctcggagaggctcctcacaagtttaaaagtgctgtagaagctgttaagaggctgagggaggatactggttgcaatgatcaatacttgcctccatttgttattgttgatgatagcggcaaggctgtgggcccaatcgtggatggtgatgctgttgttactttcaattatcgggcagatcggatggttatgcttgcaaaggcgctcgaatatgaaaattttgacatatttgatcgtgtgcgattcccgaagatacgttatgctggaatgcttcaatatgatggtgagctgaagcttcctagccgttatcttgtttctcctccagagattgacagaacctctggtgaatatctggtgcacaatggcatccgcacttttgcatgcagtgagactgtcaagtttgggcatgtcaccttcttctggaatggcaaccgctctggatatttcgacaagaatctggaggagtatgttgaaatccctagtgatagtgggatatcgttcaatgttaagccaaagatgaaagccgtggaaatagccgagaaggccagagatgcaatccttagtggcaagtttgaccaggtgcgtgttaacttgccaaatggagatatggtggggcatacaggcgatatcgaagccactgtcgttgcatgtgagactgccgatgtggctgtgaagatgatcctcgatgccatagaacaggtgggaggaatctacgttgttacagcggatcacggaaatgcagaggacatggtgaagagagacaaagctggaaagcctcttctggcaaaggatgggagccttcagattcttacctctcacactcttaaaccagtgccgattgcgataggaggtccaggtttgtcggctggtgtgaggttcaggaaagatgttccgacaggggggcttgccaacgtggctgcaaccgtgatgaacctgcatggctttgtggctccaagcgactatgagccgacccttattgaagtagcggataactgaatacatatacacatataattcattgccttggcccttgggaatgaatggcctttgatttgaaactctctatttatatcgattttgaacatttcgtctacatctttgtcatgtaaactgtctcaacatttctacaactaataattgagcgtcaaaggttttcttcga

SEQ ID NO: 5248 - DNA, 1932 bp, Silene vulgaris
acatctcaaatctcaaacacctctcatcacatattcattcacatctcaatctcgtcctgtaatttctgaaacaaacacaatgggaagctcatggaagttggctgatcatcctaaactacccaaggataagatcattgctatgattgttcttgatggttggggtgaagctaatcctaatcaatacaattgtattcatgttgctgaaactcctaccatggattctcttaaacagggtgctccggataaatggaggttgattagggctcatggtaaagccgtcgggcttccgaccgaggatgatatgggtaacagtgaagttggtcacaatgctcttggtgctggccgaatcttcgctcaaggagcaaagttggttgatcttgctcttgcctctggaaaaatcttcgacggtgcagggttcaattatatcaaggagtcctttgagactaacacattgcatcttattgggctgttgagtgatggaggtgtacattcccgtcttgatcagttacagttgttgttgaaaggagcttccgaacgtggtgccaagaagatccgtgtccatattcttactgatggtcgtgatgttttggatggttcaagtattggttttgcggaaacccttgagaaagatctctctgacttacgtgagaaaggcattgatgcacagattgcatctggtggtggtcgcatgtacgtcacaatggatcgctatgagaacgattgggaagttgtgaaacgaggctgggatgctcaagtgcttggggaagcgccatacaagttcaagaatggagtcgaagccattaagacattgagatcacaacaatccaaggcagacgaccaatatttgccaccttttgtcattgtcgatgacaatggcaaagccgttggtccaatagttgatggggatgctgttgtaacgatgaacttccgtgctgatcgtatggttatgatggccaaagcccttgagtacaaggattttgataagtttgatagagtccgtgttcctaaaatccgttatgctggtatgcttgaatatgatggcgagttgaagcttcctagtcactaccttgtttctcctcctgaaattgatagaacttctggagaatacttgacttacaatggagtgcggacttttgcctgcagtgaaactgttaaatttggtcatgttacctttttctggaacgggaaccgctctgggtacttcaactcagaaatggaagagtacgtggaaatccctagtgatagtggcattacttttaacgtccaaccgaagatgaaggctgtggagattgctgaaaaggccagggatgctattttgagccgtaaattccaacaggttcgtgtcaacctacccaatagtgacatggtgggtcacactggtgatatagaagctactgttgtggcttgcaaagctgccgatgaagctgttaagattatgattgatgcaattgagcaagttggaggaatttacgtcgttaccgctgatcatggtaatgccgaagacatggtgaagagggacaagaaagggcagccacagcttgacaaggctggaaaaattcagattcttacatctcacacacttgaacctgtccctattgcaattggaggacccggccttgcttctggtgtaagattccgcaaggacgttcctactggtggccttgctaatgtagcagcgaccgtcatgaaccttcatggattcgaggctcctagtgactacgagccaacccttatcgaggtggtggataattaggtctagtgctaatcctcccgacggttattcctatctgaaattttcaactttgagggaccatgtctatttattgtggcttgccttgattatgaattaaggtcaataaaggcccttcaattttttgtaaccctacagatttttatatgaagttgagatgttgctttactcatcttattttc

SEQ ID NO: 5249 - DNA, 1999 bp, Catharanthus roseus
cagttttttaggttttgagtgttctgatttgtgaattttgaagagaaggagaaagaaaaaagatatgggtagctcaggattttcatggaaattgaatgatcatcccaagcttcctaaagggaagattattgctatgattgttttggatgggtggggtgaagcaaagcccaatgagtacaattgcatccacgtcgctgagactcccactatggactccttcaagaagggtgctcctgagaagtggagattagtgaaggctcacgggaaagccgtgggactgcctaccgatgacgacatgggaaacagtgaagttggtcataacgctctcggtgctgggaggatctatgctcaaggtgcaaaacttgttgatctggctcttgagtctggaaagatctatgaagatgaaggttttaattatatcaaggaatgttttgaaactggaacattgcatctcattggacttctgagtgatggaggtgtccactcaagacttgaccagctgcagttgttgcttaaaggtgccagtgaacgtggtgccaaaagaatccgtgtccatgctctcactgatggacgtgatgttttggatggttcaagtgtaggcttcatggagactcttgagaatgatcttgcaaaattgcgagagaaaggcattgatgcacaagttgcatcaggtggtggtcgaatgtatgttaccatggatcgttatgagaatgattgggaagttgtaaagcgaggttgggatgctcaagttcttggtgaagctccacacaagtttaggaatggtgttgaagctgtcaagaaactaagggaggcaccacagtccaatgaccaatatttacctccatttgttatcgttgatgagaacgggaagccagttgggcctattgtggatggtgatgctgttgtgactttcaatttccgagcggatcgcatggttatgttagccaaggcccttgaatatgaagattttgataaatttgatagagttcgagtccccaagattcgttatgcaggaatgctccagtacgatggagaattgaagcttcctagtcattaccttgtttctcctccattgattgaaagaacatctggtgaatatctggtgcataatggtgttcgtacttttgcttgcagtgagacagttaagtttggtcatgtcacgtttttttggaatggaaatcggtctggatactttaatcaagaaatggaggaatatgttgaaattccaagtgatagtgggattacctttaatgtccagccaaagatgaaggctttggagattgctgagaaggctagagatgctatccttagtcgcaagttccaccaggtacgagttaatctaccaaatggtgacatggtgggtcacacaggcgatattcaagcaacagttgtggcttgcaaggccgctgatgaggctgttaagatgattattgatgcgattgagcaagtgggtgggatatatgttgtcactgctgatcatgggaatgctgaggatatggtgaagaggaacaagaagggggagcctcttttagacaaaaatggcaacattcaaatacttacttctcatactcttgaaccagttcccattgcaattggtggagctgggctggaaccgggagttagattccgtcaagatcttcctggtggtggacttgcaaatgtggctgcaactgttatgaatttacatggttttgaggcacctaacgattatgagccaaccttgattgaggttgttgactaataggctctatattatttaatcataaacaaacttcaaattttggcctgaaaatgcgaggtagcaatggagtacaatatccattatagtgactaaaataattcagttgggttcatttgctactgcattgatttttaaaaatatttgcagtactattgttgctctgtaattttaactgcagataaaacagcaggtgtgtcttcatcttcctatggttgcttgcttcaagcatatgtgcaatatttttatgcattagtttaa

SEQ ID NO: 5250 - DNA, 2060 bp, Mimulus guttatus
attcgattctacttgtttcttcagaaatctatactcacaaaacaacaagcggcaaaagaaaagaaagaaaaggaaaaggagatgggtagctctggattttcatggaaattgaaggatcacccaaagctggcaaaggggaaaacgatagcaatgattgttttggatgggtggggcgaagctaaacccaatcagtacaattgcatccatgtggcggagactccaaccatggattcacttaagaatggtgcccctgataaatggagattggtgaaggcccatggtaaggcggtgggtctgcccacagatgatgacatgggcaatagtgaggttggtcacaatgctcttggtgctggcaggatttatgcacaaggtgctaagcttgttgatagtgctcttgatactggaaaaatttatgatggagaaggtttcaactacatcaaggcatcttttgaaagtggaacacttcacctcatcggattattgagtgacggaggtgtacactctaggctaaatcagttgcagttgttgcttaaaggtgctagtgagcgtggtgctaaaagaatccgtgttcacgttctgacggatggacgtgatgttttggatggaacaagtgtggcctatgttgaaactcttgaagaggatcttgcaaagctacgcgaaaacggtgtcgatgcccagattgcatctggtggaggtcgcatgtatgtcacaatggatcgatatgaaaatgattgggaagttgtaaaaagaggatgggatgcacaagtcctcggagaagcaccatacaagtttaagagtgccgttgaagctgtcaagaagctgagagagattcctaacacgagtgatcaatacttgcctccctttgtcattgttgatgatagtggcaagtctgtggggcccattgtcgacggtgatgctgttgtgactttcaacttccgggctgatcgtatgtccatggttgcccaggcacttgagtatgagaagtttgataaatttgaccgtgtcagatttcccaagattcgttacgctgggatgcttcagtacgatggcgaacttaaacttccaaaccactacctcgtttctcctcctgaaatggaaagaacttctggagagtatttggtccacaacggtgtccgtacctttgcttgcagtgaaacagttaaatttggtcatgtgacctttttctggaacggaaaccggtcaggatacttcaacgcggacatggaagaatatgttgaaattccaagcgatagtggtattacctttaatgtcaagccaaagatgaaagccttgcagattggtgagaaggcaagagatgctatcctcagcggcaaatttgaccaggtacgtgttaacctgccaaatagtgacatggtgggacacaccggtgatattgacgcaacagttgtggcttgtaaggctgctgatgaagccgtcaagatgatacttgatgcgatagagcaagtgggaggaatatatgtagttacagctgatcacggaaacgcagaggacatggttaaaaggaacaagaaaggcgaaccccttcttgacaagaatggcaacattcagattcttacttctcacacacttgaacctgtcccgattgcaatcggaggaccagggctggcagctggtgtcaagttcaggaaagatgtaccgaatggtgggcttgcaaatgtggctgcaactgtcatgaacctacacggcttcgtggcccctgacgactatgagacgaccctcattgaggttgttgacgtttagattctgttctttttttcgttttcgtttcaaaattttgcactaggggggatggctacagaaagaatacactacacactatccattctttctgaataaatacaccttttgcttgctgagttttactttctagtgtaattgagactattaacttaagcagcatcgaactatttttctcctatttcgatggggttgtgatttgttcgacaattcgatgatttgaaatataattatcaactcttagtgtctttccattcgtgacctactacttctcttcactatgcattatttttctttgaggt

SEQ ID NO: 5251 - DNA, 2109 bp, Arachis hypogaea
cagatgccaagtggaaattggctgatcacccaaagctgccaaagggaattaaagccagttgctgtggtggttttggatggatggggtgaggccaacgctgatcaatacaactgtatccacaccgctgaaactccaaccatggattccctcaaaaagggtgcacctgaaaggtggagattggtgagggctcatggtactgctgtgggacttcctacagaggatgacatgggcaacagtgaagtcggtcacaatgctcttggtgctggccgcatctttgctcaaggtgccaagcttgtggaccttgctcttgaatctggaaaaatttatgaaggagaaggcttcaagtacatacaggaaagttttgccaatggcacattgcatctcattgggttattgagtgatggtggagtccattcccgacttgatcagttgcagttgttgcttaaaggtgttagtgagcgaggtgttaagagagtccgcgtacacattcttacagatggtcgtgatgttttggatggctcaagtgtcggatttgtagaaactcttgaaaatgatcttgccaagttgcgtgagaagggtattgatgcaagaattgcatcaggtgggggtcgtatgcatgttacaatggatcgatatgagaatgactggaatgttgtgaaacgagggtgggatgctcaagttcttggcgaagcccctcataagtttaaaagtgctcttgaagctgtcaagaaactaagagcagaaccaaaagccaatgatcagtacctgcctccttttgtcattgttgatgataatgggaaggctgttggaccaattgttgatggtgatgcagttgttacattcaacttccgggcagatcgtatggttatgattgccaagtctcttgaatacgaagactttgataaatttgatagagtccgtttccccaagattcgctatgctggaatgcttcagtacgatggtgaattgaagcttcctagtcattatcttgtttctccaccagaaattgacaggacttctggtgaattcttggtgcataatggtgttaggacttttgcatgcagcgagactgttaaatttggtcatgtcacattcttctggaatggaaaccgctctggctattttaatcgacaactggaggaatatgtggaaattcctagtgacattgggattacattcaatgtacaaccaaaaatgaaggcactggagattgctgaaaaggctagggatgccattcttagtcggaaatttgatcagatccgtgtcaaccttccaaatggtgacatggtggggcatacaggtgatattgaagcaacagttgtggcttgcaaggctgctgatgaagcagtgaagatgattcttgatgcaattgaacaagtaggtggaatttatgtcgtcactgctgaccatggcaatgcagaggacatggtcaagagagacaaatcgggaaagcctcttcttgacaaggagggaaagattcagattcttacttcacatacccttcagccggtgcctattgccattggaggtcctggattggcccctggggtcaggttcagaaatgacgttcccgacggtgggctggccaatgtagctgcgactgtgatgaatcttcatggatttgtggctcccagtgactatgagacaactctcattgaagtagttgataagtagaaaatcgttagataaactataatgtgcacaactacagggaaggctggagattgcagcccttttaaataattcgaaagttttcgtctcctccacacatatggcggggttttgatttttcattttttgaagaattgttagtgaatcagtctgcggatgacagaacaggataacttattaatggccatttgagtgtagcttttgttttttttttttttttaaaaaaaggaaaagaaaaaaaactctttgattgtccttaataattattgaaacattatgtgatttttccagtcaaatatggtaggtttctagttatgactgtgatgtttgatgtcattttggaatgccgccttagctgattttgtatattgaggttgatgagaggacgttttgttcagtgcaaaggcaaagtttctttgaatttaaaaagtagatgtc

SEQ ID NO: 5252 - DNA, 1898 bp, Cicer arietinum
ttaccaccgtgacatttgtgtagttagttgcggctgaaacagaaatcgttggaatctgttatagaaaagaaaacaaagatgggtagttctggattctcatggaagttaccagatcatcctaagcttccaaagggaaagccaattgctgttattgttttggatggttggggtgaggccaaggaaaatgaatacaactgtattcacatcgctgaaacacccacaatggattcccttaaaaagggtgcacctgaacattggaggttggttagggctcatggtaaagcagtaggtcttccaacagaagatgacatgggcaacagtgaagttggtcacaatgcactcggtgccggtcggatatttgctcaaggtgcaaagcttgttgaccttgctttagaatctggaaaaattttcgacggagaaggtttcaattacataaaggaaagttttgaaactggcacagtgcatctcattgggctactgagtgatggtggagttcactccagacttgatcaagtgcagttgttgcttaaagggcttagtgagcgaggtgttaagagagtccgtctccatatccttacagatggtcgtgatgttttggatggctcaagtgtaggttttgtggaaacccttgaaaatgatcttgcgaacttgcgcgagaaaggtatcgatgcaaggatagcatcaggtggaggtcgcatgtatgtcacaatggaccgttatgagaatgactggagtgttgtgaaacgaggatgggatgctcaagttcttggtgaagcgccttataagtttacaaatgctgttgaagctgtcaagaaactgagggcagaaccaaaggccaatgaccagtatctgcctccatttgttatcgttgacgagagcgggaaatctgttggtccgatagttgatggggatgctgtggttacattcaacttccgggctgatcgtatgactatgcttgctaaggctcttgaaaatgaaaattttgacaaatttgatagagtacgcttccctaaaatccgatatgctggcatgcttgaatatgatggtgaattgaagcttccacgtcattaccttgtttctccaccagagattgataggacttctggtgaatatttagtgcataatggtgttcgcacttttgcttgcagtgagactgttaaattcggtcatgtcacattcttttggaatgggaaccggtctgggtattttaattcggaattggaagaatatgttgagattccaagtgactctgggattacattcaatgaacaaccaaaaatgaaggcattggagattgctgagaagacaagggatgcaattcttagccgaaaatttgatcaggtacgtatcaacctaccaaatggtgacatggtggggcataccggtgacattgaagcaacgattgtggcttgtaaagcagctgatgaagctgtgaagatggttcttgatgcaattgagcaagtgggtggaatttatgttgtcactgctgaccatggaaatgcagaagatatggtcaagagggataaatctggaaaacctcagctagacaagaatggacaagtccagatcctcacttctcatactcttgagccagtgccgattgccattggaggtcctggattagcgcctggagtcagattccgcaccgatcttcccgatggtgggctggctaatgtagctgcaactgtgatgaatcttcatggatttgaggctccaagtgactatgagccatctctcatagaagtagttgataattgaggaaccaaaaatagacgatgacttacaattttcagtaattttcaaataatttaaactttacattcctctccacacatgtttgtggacttttgttcttttgaaatggctgtatcagtctgcggttgacagaacattatact

SEQ ID NO: 5253 - DNA, 2328 bp, Cajanus cajan
acacaacacaacacaacaagcgagccacagggtttggttttgttaggttacctctgtgacatttgtgttgttagttgcggctgacacccagaaacaaagaggaaaaagagagaaaagcgcagatgggtagcacatggaaattggcggatcatccaaagcttccaaaggggaagcaggtggctttgattgtgttggatggttggggtgaggccaagcccgatgagtacaattgcatccacaacgctgaaacaccctgcatggattcccttaaaaagggtgcccctgaacggtggagactggttaaggctcatggtactgctgtaggccttccatcagatgatgatatgggcaatagtgaagttggtcataatgcccttggggctggtcgcatatttgctcagggtgctaagcttgtcgaccttgctctagcctctggaaaaatatttgaaggagaaggtttcaaatacataaaggaaagttttgaaacgggtacattgcatctcattgggttactgagtgatggtggagttcactccagacttgatcagttgcagttgttacttaaaggagttggtgagcgtggtgttaaaagagtccgtgtccatattctaacagatggccgtgatgttttggatggttcaagtgtcgggtttgtggaaacccttgaaaatgatcttgcacaattgcgtgagaaaggtatcgatgcgaagatagcatcaggtgggggtcgaatgaatgtcacaatggatcgttatgagaatgactggaatgttgtgaaacgagggtgggatgctcaagttcttggtgaagcccctcacaagtttacaaatgctgttgaagctgtcaagaagctgagggcagaaccaaaagccaatgaccagtatctgcctccttttgttattgttgatgagaatggaaaacctgttggtccaatagttgatggtgatgcggttgttacattcaacttccgagctgatcgtatggttatgattgctaagtctcttgaatatgaaaattttgacaaatttgatagagttcgtttcccaaaaatccgctatgctggaatgcttgaatatgatggtgaattgaagcttccaagtcattaccttgtttctccaccagagattgataggacttctggtgaatatttagtgcataatggtattcgaacctttgcttgcagtgagactgtcaaatttggtcatgtcacattcttctggaatggcaaccgatctgggtattttaataaagaattggagcaatatgtggaaattcctagcgactcagggattacattcaatgaacaaccaaaaatgaaagcattacagattggtgaaaaggctagggatgctattcttagcgggaaatttgatcaggtacgtgtcaacctgccaaatggtgacatggtggggcatacaggtgacattgaagcaacagttgtggcttgcaaggcagctgacgaagctgtgaagatgattattgatgccatagagaaagttggaggaatttatgttgtcacagctgaccacggaaacgcagaggatatggtcaagagggataaatctggaaaacctcttctcaaggatggaaaaatccagattcttacttcccatactcttgagcctgtgccaattgctattggaggccctggattgatccctggtgccagattccgtaacgatgttccaaccggcgggctggcgaacgttgctgcaactgtgattaatcttcatggatttgaggctcccagcgactacgagacaactctcatagaagtagttgataattgataactaggaacaagtagatgaattattataattttcgaaactacagggaaagctgtagattacagccctcaaataattgaaagttttcatccctccacatgtgtggtggttttgttcttgtgagtttccaatcagtctgaagttgagacagaacggtataagtacttttaagtgatattttgatactttcactcttgtgctttgaatcaggttttttgattgacaacttaacttgcaaggtcacttgcaaggtcatctctaaggctaaatcatgcttgtgaaatgtctttattggctgattcgtgcgttatcatgttgacgagggaactcatgtctctatcatcatcatgctttgtaatcaaaatcatgtgacactaggatttgaaatagaacgttttgaccatagaagtgattgcaaccgtcagaaattaagccgactgaaaagcatattttttcttctcgaaatgaataatgcttttaggtctatgtgtaaaatcctatgctttgaagatatgaatattatctcctttgaatcgaa

SEQ ID NO: 5254 - DNA, 2207 bp, Eucalyptus grandis
ctggtctcttgcattcaatggtctcacgtcactctcgctacattcatcacttccattccagcaccttctccttctttcttcttccttcttcgtcttcttcttcttcttcttcttcgtggtcgttgttgaggacgtgacgaagttattctggtctggtcggtctggtcgcggattcattggtacgtgcggaattttggtttcggtggtgctgaagagagagatagagagatggggagctcggagttcacgtggaagctgccggatcacccgaggctgccgaaggggaggaccgtggcggtggtggtgctggacggctggggcgaagccgaacccgacccgtataactgcatccacgtcgccgatactcctgccttggattctctcagaaagggtgctcctgacaagtggagattgataaaggctcatggaactgcggtggggcttcccacggacgatgacatgggcaacagcgaggtcggtcacaacgccttaggcgccgggcgcatttatgcgcaaggtgcaaaacttgttgacctagccctagcttctggaaaaatttacgaaggagaaggttttaagtatataaaggagtgctttgagaatggaacgttgcacctaattgggctattaagtgatggtggtgttcactctaggcttgatcagttgcagttgcttgtaaaaggtgctgccgagcatggagctaaaagaatacgagttcatattctgactgatggccgtgatgttttggacggttcaagtgtgggctttgtagaaactcttgaaaatgatcttgcaaagttacgtgaaaaaggagttgatgcacatatcgcttctgggggaggtcgcatgtatgtgaccatggaccgttatgagaacgactggaatgtggttaaacgaggatgggatgcgcaagttcttggtgaagctccttataagtttagaagtgctgttgaagcagtaaaaaagctcagggcagagcctaatgccaacgaccaatatttgcctccttttgtcattgttgatgagaatggaaaggctgttggtcccattgtggatggtgatgctgttgttacattcaattttcgagcagatcgtatggtcatgcttgccaaggcacttgaatatgaaaattttgacaaatttgatcgggttcggtttcctaaagttcactacgctggaatgcttcagtatgatggtgaactgaagcttccaagccattaccttgtctctccaccagaaatcgagaggacatccggtgaatacttagttcataatggtatccgaacatttgcttgcagtgagactgtcaaatttggtcatgtgacatttttctggaatggcaatcggtctggctattttaaccccgaattggaggagtatgttgaaatcccaagcgacacaggaattccatttaacgtccgcccaaagatgaaggcagtagagattgctgaaaaggcaagggatgccattctcagtagaaaatttgaccaggtgagggtgaacctaccgaatggtgatatggtggggcatacaggagatatggaggcgacgattattggatgtaaggctgctgatgaggctgtcaagattatcctagatgcagtagagcaggtcggtggaatttatgttgttacagcagaccatgggaatgccgaggacatggtgaagagggataaatccgggcaacccctagtcgacaagagtggcaacattcagattcttacttctcacacccttcgaccggtgccgatcgcgatcggagggccaggactggcaccaggtgtcaggttccgccgggatttggctgaggctgggctcgccaacgtcgccgccactgtgattaatcttcacgggttcgaggctcccagcgattacgagcccaccctcatcgaagttgtctagtaaccctgagcctctgccaaactcaaatcacagagctaatgtgcatagtttcgtattgtaactagtctactgttcatggtaaaataagctattggtcctcccggagtgtagggaactcttttggagcctgagcagttcagcctccggttggccatgtttagcatgttaatagcaattaactacggctgattaatagtggtcctataagataaaagaacagatgtctgggcatctccttccatctcatgcaatcttaggttgacttattcagaaaaaagagtcaaattcattcttgcaagtacccg

SEQ ID NO: 5255 - DNA, 1986 bp, Arabidopsis thaliana
tcaacctaccatacttcaccacataaccacttctgtctctgcgaatctccataagactctttgagaagctttcctctgtttctccgctgttatgggtagctccggcgacgttaactggaaacttgcggaccaccccaagcttcccaaaggcaaaactatcggtttgattgttctcgatggatggggtgaatctgatcccgatcaatacaattgcatccataaagctccaactcctgccatggattcccttaaagacgggaagcccgacacatggaggttgatcaaagctcatggtaccgccgttggtctccccagcgaagacgacatgggaaacagtgaagttggccacaatgctcttggagctggtcgaatttacgctcaaggtgctaagcttgttgatctcgcccttgcttcagggaaaatctatgaagatgaaggtttcaaatacatctctcaatcttttgagaaaggcactgtgcaccttattggtcttctaagcgatggtggagttcactctcgtttggatcaagtccagttgctgcttaagggttttgcagaacgtggtgctaagagaatccgcgtccatattcttactgatggtcgtgatgttttggatggttctagtgtcggatttgttgaaactcttgaagctgacctagctgctttacgtgcgaaaggtgttgatgctcaggttgcatctggtggaggtcgaatgtatgtcacaatggaccgttatgagaatgattggagtgttgttaaacgaggttgggatgcacaagtccttggggaagctccccacaaatttaaaagcgctcttgaagcagttaagacactgagggcagaacctggtgccaatgaccagtatttgccttcgtttgttattgttgatgataatggaaaggctgtgggtccaattgttgatggtgacgcagttgttacattcaatttccgtgctgatcgaatggtcatgcatgcaaaggccctcgaatacaaagatttcgacaagtttgatcgcgtacgtgtccctgatatacgttatgcaggaatgctccaatatgatggagagcttaagcttcctagccgctatcttgtttctccaccattgattgacagaacttctggtgaatatctggcacacaatggcgttcgtacttttgcttgcagtgagactgtgaagtttggccatgtaaccttcttctggaatggcaaccgctctggatatttcaatgaaaagttagaagagtacgttgagattccaagtgatagtggaatatcattcaatgtccagccaaagatgaaagcactggaaattgccgagaaagcaagggatgctatccttagtggcaagtttgaccaggtgcgtgtaaacctgccaaatggagatatggtggggcatactggtgatattgaagcaactgttgttgcctgtgaagctgctgatcgtgctgtgaggacaatccttgatgccatagaacaggtcggagggatatacgttgtgactgcagatcacggaaatgctgaggacatggttaaaagggacaaatccggcaagcctgctctcgataaggaagggaaccttcagattcttacctctcacacccttaaaccagtgccaattgccataggaggtcctggcttgtcagcaggagttaggtttagacaggatatcgagacacctgggcttgcaaatgtagctgcgacagtgatgaacctccatggatttgtggccccgagtgactatgagacaagtctgatcgaagtcgtcgagaagtgatgattcttgttgttgtagttctttttaaaagtcccacctgagcctctatagactctgattctcttttaagttactattttcaccgctctctaataaggctcgtgattttttgggagccatactgtatactcgccggccctctcacgatgttgttcaattcacagactaaatttgatttatctatttcgccaaaacataacttcattaaaaaa

SEQ ID NO: 5256 - DNA, 2012 bp, Cichorium intybus
ggcggggactactctttcgcttcttatcgaacccaaacgaagatctagagaagagactgagattgaaagacagcgagagagatggggagcactggattttcgtggaaattggccgatcatccgaagctacccaaggggaagcttgtagccatgattgttttggatggttggggtgaagcctctcccgataagttcaactgcatccatgttgctgaaactccaaccatggattctctcaaaaacggcgcccctgataaatggagattggtgagagctcatggtactgctgtagggcttccaactgaagatgacatgggaaacagtgaagtcggacataatgctcttggtgctggaagaatctatgctcaaggtgcaaaactcgttgatgcagctcttgaatctggaaaaatctacgaagatgaaggtttcaattacatcaaggaatctttcgcaaacaacaccttacaccttattggactaatgagtgacgggggtgtgcactctcgccttgaccaagtacagttgttgttaaaaggagccagtgaacgcggtgccaagaagatccgagtccacgtgctcacagatggacgcgatgttctagatggttccagtgttggttttgctgaaaccctcgaaaatgaactttcagaattacgtaagaaaggcatcgatgcacaagttgcttctggtgggggccgcatgtatgtcaccatggatcgttatgagaatgattgggaagtggtgaaaaggggatgggatgctcaagttcttggtgaagctccacataagtttaacaacgttgttgaagctgtgaagacattaagagaggtacccggttcaaatgaccagtacttacccccatttgtgattgttgatgaaagtggaaaccccgtgggtcccattgttgacggggacgctgttgtcactttcaatttccgggcagaccgtatgaccatgctcgcacaagctcttgaatacgagaaattcgataaatttgaccgagtgcgggtcccgaaaatccggtacgcgggtatgcttcagtacgacggggaattaaaacttccaaatcactaccttgtatcaccaccattgatcgatagaacatctggcgaatacttggtgcataatggggttcgtacttttgcttgcagtgagactgtgaaattcggtcacgtgacgtttttctggaacggaaaccggtcgggatatttcaatgctgagttggaagaatatgttgagattccaagtgatagtggaattacatttaacgttcaaccaaaaatgaaagctttggagattggtgaaaaggcacgtgatgcaattcttagtggaagatttgaccaggtgcgtgtgaatataccaaatggtgacatggtcgggcatactggtgatgttgaagctactgttgtggcttgcaaggctgctgatgaagctgttaagatgatacttgatgcggtggaacaagtaggtggaatatatgtggtgacagctgatcatggtaatgctgaggacatggtaaaaagaaacaagaagggtgagcctgctcttgacaaggatggaaatgttcaaattttaacctcccacactcttcagccggtgccgattgcaattggtggaccggggttaacagagggagtgaagttccggaaggatgttccgagtgggggattagcgaatgttgcggcgactgtgatgaatcttcatgggtttgtggctcctgatgattatgagacgactctaattgaagttgttgactgttgattgattaaaagcaagttgaaaggtggttaaaggatttttcgttttgaataatttgtgatggaaattgtgaacacatatgtgacgatatggatgtttagttgcattttccaattttgggacacacgtgtgagtgggttttatttgtaggcacgacttaatgttgctgctttatatttaagcaacggatggttgtgaaatgaatggttgatagttttgggtttttgcataatggatgttattgtttgacattg

SEQ ID NO: 5257 - DNA, 2141 bp, Euonymus alatus
gaatagtccgaagccacatgttcggtgatggtgcacgctgcacaactgttggtcacgccgtatgcgtgattgcgtggtgaccacggaatctgctagcggcaaatagtttctcttcttgcattttatatcacgcacgattccttttatcaagcaagctttggtagtcacatccactagtctcttcctcctttgaagttcagttgcaggtgagagagagagagattgacgaggatggggagcgcaggcgaagttaactggaaactggcggatcatccgaagctgccgaaagataagatcgtggcgatggtggttttggatgggtggggtgaagctaatcccgatcagtataactgcatccacgtcgccgatactcccaccatggactccctcaggaagggtgctcccgagaagtggagattagttagggctcatggtaaggctgtgggccttccaactgaggatgacatgggcaacagtgaagttggtcacaatgcactgggcgctggccgcatttttgctcaaggagcaaagcttgtagaccttgctcttgcttctgggaaaatctatgaaggagcagggtttaactacataaaggagtgctttgaaaccggtacattgcatttgattgggttattgagtgatggaggagtgcactccaggcttgatcagttacagttgttgctaaaaggagccgcccaacatggtgctaagagaattcgtgttcatatacttactgatgggcgtgatgtcctggacggttcaagtgtaggattcgtggaaactcttgagaaagatattgaagaactacgtgcaaagggggttgatgcatatatagcatctggtggcgggcgcatgtatgtgactatggatcgctatgagaatgactggaatgtggtgaaacgtggatgggatgcccaagttcttggtgaagcaccacacaaatttagaaatgctgttgaagctgtcaagaaattgagggaagatccaaaagccaatgatcagtacttacctccttttgttattgtcgatgagaatgggaagcctgttggccccataaatgatggtgatgctgttgtcacgttcaacttccgagcagatcgtatgactatgcttgctaaggctcttgagtacgaagattttgacaagttcgatcgtgttcgatttcctaaaatccattatgctggaatgcttcaatatgatggtgagttgaagcttcccagccattaccttgtttctccaccagagattgacagaacttctggtgaatatttagtgcacaatggcgttcgtacctttgcttgcagtgagactgtcaagtttggtcatgtcactttcttctggaatggaaatcgctctggttgtttcaatcctgagatggaagaatatgtggaaattccaagtgatattggaattacttttaatgtccaaccaaaaatgaaggcaaaggagattgctgaaaaggcgagggatgctatccttagccgcaaatttcatcaggttcgtgttaatctaccaaatggtgacatggtgggtcatacaggagatattcaggccaccgttgtgggatgcaaggtcacagacgatgctgtcaaggtgatccttgatgcgatagagcaagttggtggcatatatgttgtgactgcagatcatggaaatgcagaggacatggtgaagaggaataaatctgggcaacctcttcttgacaagaatggcaacattcaagttctcacatctcacactctccagccggtgcccattgcaattggaggtcctggattggcacctggtgtcagataccgcaaagatttaccagatggtgggcttgccaatgtggctgccactgtgatgaatctccatggatttgaggcgcctggcgactatgagccaactctcattgaagttgttgacagctagggtaaccataaaatggtggatgtaccttatgtatggcctaaattttgactgcttttttgcggcacggtagtttccacattatattatttagggaaaataatgcttcagggatgatgagctctccctatatggcattcgcgtttggttgctgtctgttatatgaggacatgaaagtttatgaaataacaatataacactccatacccaaaaaaaaaaaaaaaaggccg

SEQ ID NO: 5258 - DNA, 1964 bp, Tripterygium wilfordii
aggtgagagagaaagagagttacgaggatggggagcgcaggcgaagttaactggaaactggcggatcatccaaagctgccaaaagataaggtcgtggcgatggtggttttggatgggtggggtgaagctgatcccgatcagtataactgcatccacgtcgccgatacgcctaccatggactccctcaagaagggtgcccccgagaagtggagattagttagggctcatggtaaggctgtgggccttccaactgaggatgacatgggcaacagtgaagttggtcacaatgcacttggcgctggccgcatttttgctcaaggagcaaagcttgttgaccttgctcttgcttctgggaaaatctttgaaggagaagggtttaactacataaaggagtgctttgaaaccggtacattgcacttgattgggttattgagtgatggaggagtgcattccaggcttgatcagttgcagttgttgctaaaaggagccgccaagcatggtgctaaaagaattcgtgttcatatacttactgatgggcgtgatgtcctggacggttctagtgtaggattcgttgaaactcttgagaaagaacttgcagaactacgtgcaaagggggttgatgcacagatagcatccggtggcgggcgcatgtatgtgacaatggatcgttacgagaatgactggaatgtggtgaaacgtggatgggatgcccaagttcttggtgaagcgccatacaaatttagaaatgctgttgaggctgtcaagaaattgagggaagaaccaaaagccaatgatcagtacttgcctccttttgttattgtcgatgagaatgggaagcctgttggccccataaatgatggtgatgctgtagtcacgatcaactaccgagcagatcgtatggttatgcttgctaaggctcttgagtatgaagattttgacaaattcgatcgtgttcgttttcctaagatcaattatgctggaatgcttcaatatgatggtgagttgaagcttcccaaccattaccttgtttctccaccagagattgacagaacttctggcgaatatttagtgcacaatggcgttcgtacatttgcttgcagtgaaactgtcaagtttggtcatgtcactttcttctggaatggaaatcgctctggttgtttcaaccctgagatggaagaatatgtggaaattccaagtgatgttggaattacttttaacgtccaaccagaaatgaaggcaaaggagattgctgaaaaggcgagggatgctatccttagccgcaaatttcatcaggttcgtgttaacctaccaaatggtgatatggtgggtcatacaggagatattcatgccaccgttgtgggatgcaaagtgacagatgatgctgtcaaggttatccttgatgcgatcgagcaagttggtggcatatatgttgtgactgcagatcatggaaatgccgaggacatggcgaagaggaataaatctgggcaacctattcttgacaagaacggaaacattcaagttcttacttcccacactctccaaccggtgcccattgcaattggaggtcctggattggcacccggtgtcagattccgcaaagatttaccaaatggtgggcttgccaatgtagctgccactgtgatgaatctccatggatttgaggcacctggcgagtatgagcctactctcattgaagttgttgacaactagaataaccataaaatgctggatgtaccttatgtgagggcctaaattttgattgctgtttgtgggacacaggagttcctgcagtattttatttaggcaaaataaattatttctaattctgctacagggatcatgagctctccccctatatgggattcacgtttggttgctgtctgttatatgcggcggacagaacggcttatgaaataacattttgtctgttaagtcttgtattttctattcattactatctgttt

SEQ ID NO: 5259 - DNA, 1984 bp, Eutrema halophilum
tcaacctaccatacctcaccacatcaccctcacgtctctgcgaatctccatacgactctttgagctttctctctgtttctccgctgctatgggtagctccggcgacgttaactggaaacttgaggaccatcccaagctccccaagggtaaaaccattggcttaattgttctcgatggatggggtgaatccgaacctgatcaatacaattgcatccacaaagctccaactcctgccatggattcccttaaaaacggaaagcctgatacatggaggctgatcaaagcccatggcacagcggttggtctccccagcgaagatgacatgggaaacagtgaagttgggcacaatgctctcggagccggtcgaatctacgctcaaggtgctaagcttgtcgatctagctcttgagtcagggaaaatctacgaggatgaaggtttcaaatacatttctgaatctttcgagaaaggcactgtgcaccttatcggacttttaagcgacggtggagtccactcccgcctcgatcaagtgcagctgctgttaaagggtttcgcagaacgtggcgcgaaaagaatccgtgtccatgttcttactgatggtcgtgatgttttggatggctctagtgtcggctttgtggaaactcttgaagctgacctcgctgacttacgttccaaaggtgttgatgctcagattgcctctggtggaggtcgtatgaatgtcacaatggaccgttacgagaatgactggaatgttgtgaaacgagggtgggatgctcaagtccttggagaagctccccacaaattcaaaagtggtcttgaagcaattaagacactgagggccgagcctggtgccaatgaccagtatttgcctccctttgtcattgttgatgacagcggaaaggctgtgggtccaattgttgatggtgacgcagttgtcactttcaatttccgtgctgatcgaatggtcatgcatgcaaaggccctcgaatatgaagattttgataagtttgatcgcgttagagtcccaaagatacgttatgcaggaatgctccaatatgatggagagctaaagcttccaagccattaccttgtttctccaccactgattgataggacttctggtgaatatcttgcacacaatggcatccgcacttttgcttgcagtgagactgttaagtttggccatgtaaccttcttctggaatggaaaccgctctggatattttaacgaaaagctggaaaagtacgttgagattccaagtgatagtggaatatcattcaatgtccagccaaagatgaaagcgctggagattgccgagaaagcaagggatgctatcctcagtggcaagtttgaccaggtgcgtgttaacctgccaaatggagacatggtgggtcatacgggtgatattaaagcaactgttgttgcctgtgaagctgctgatgttgctgtgaggataatcctcgatgccatagaacaggtgggagggatatatgttgtgactgcagatcacggaaatgctgaggacatggttaaaagggacaaagctggtaagcccgctctggacaaggaaggaaaccttcagattctcacctctcacaccctgaaaccggtgccaattgcgataggaggacctggtttgtcagcaggagttaagttcagacaggatttggagacacctgggcttgcgaatgtagctgccacagtgatgaacctgcatggatttgtggcccctggcgactatgagccgagtttgattgaagtagtcgacaagtaatgatatggtgtggatgttattccctgcaaaagtccaacctgagcctctctaaactattgttctgttcaagttacgtatttctcgtgctctttaataaggcccgtgatttttaaccttttagttactcgccaccctcacgatgtgggtcgagcaagttctccttttttttgaacaatgtgggtcaagcaagttaaagactacttttgatgtttt

SEQ ID NO: 5260 - DNA, 2141 bp, Euonymus alatus
attttcattagctttgggaataacttccgccaccgttaaagttcaggttaggcaaaaatcgtccttactggttaatttcgcgtgaactggatcctatacgaaatcgatatttgcagttggcaggtgagagagaaagagagagattgacgaggatggggagcgcaggcgaagttaactggaaactggcggatcatccaaagctgccaaaagataagatcgtggcaatggtggttttggatggatggggtgaagctaatgccgatcagtataactgcatccacgtcgccgatacgccaaccatggactccctcaagaagggtgccccggagaattggagattaattagggctcatggacactctgtgggccttccaactgaggatgacatgggcaacagtgaagttggtcacaatgcacttggtgctggccgcatatttgctcaaggggcaaagcttgtagaccttgctcttgcttctgggaaaatctatgaaggagatgggtttaactacataaaagagtgctttgaaaccggtacattgcacttgattggtttattgagtgatggaggagtccactccaggcttgatcagttgcagttgttgctaaaaggagctgcccagcatggtgctaaaagaattcgtgttcatatacttactgatgggcgtgacgtgctggacggttctagtgttggatttgttgaaactcttgagaaggagcttgcggaactacgtgcaaagggggttgatgcgcagacagcatccggtggagggcgaatgtatgtgacaatggaccgttatgagaatgactgggatgtggtgaaacgaggatgggatgcccaagttcttggcgaagcaccattcaaatttagaagtgctgttgaagctgtcaagaaattgagggaagaaccaaaagccagtgatcagtacttacctccttttgttattgtcgatgagaatgggaagcctgttggccccataaatgatggtgattctgtagtcacgttcaacttccgtgctgatcgtatgactatgcttgccaaggctcttgagtacgaagattttgacatatttgatcgtgttcgattccctaaaatccattatgctggaatgcttcaatatgatggtgagttgaagcttcccagccattaccttgtttctccaccagagattgacagaacttctggtgaatatttagtgcacaacggcgttcgtacctttgcttgtagtgagactgtcaagtttggtcatgtcactttcttctggaatggaaatcgctctggttgtttcaaccctgagatggaggaatatgtggaaattccaagtgatgtcggaattacttttaatgtccaaccaaaaatgaaggcaaaggagattgctgaaaaggcgagggatgctatccttagccgcaaatttcaacaggttcgtgttaacctaccaaatggggacatggtgggtcatacaggagatattgaggccaccgttgtgggatgcaaggtcacagatgatgccgtcaaggtgatccttgatgcaatagagcaagttggtggcatatatgttgttactgccgatcatggaaatgcagaggacatggtgaagaggaataaatctgggcaacctcttcttgacaagaaaggaaagattcaagttctcacttcccacactctccagccggtgcccattgcaattggtggccctggattggcacctggtgtcagataccgcaaagatttaccaaatggtgggcttgccaacgtggctgccactgtgatgaacctccatggatttgaggcacctagtgactatgagccaactctcattgaagttgttgacaactagggtatccaccgtacaaaatggtggatgtaccttatatatgtcataaattttgattgccgtttgtgcaatgcaggacagcaagagttcctccactattttattttggggaaataaattaattataattctgctccggggatcatgagctctctctcattatgttggattaccgcttttggttgctttctgtcgcatgcggacagaacagtttgtgtaatgacatttttgtgtgttaattctgcctcttcctttttttttcccctttcgttcattgcgccatcctattatctgatttcattttaaagg

SEQ ID NO: 5261 - DNA, 1899 bp, Flaveria ramosissima
actgtgacggagaaaacgatggggagcaccggattctcatggaaactggcggatcatccaaagctaccgaagggaaagctggtggcgatggttgttttggacggttggggtgaagcttctcccgataagttcaactgcatccatgtcgccgagactcctaccatggattctctcaaaaacggcgcccctgataagtggaggctggtgagggctcatggcactgctgttgggcttcccactgaggatgacatgggaaacagtgaagttggacataatgctcttggtgctggaaggatctttgctcaaggtgcaaaactcgttgatcttgctcttgcctctggaaaaatattcgaagatgaaggctttaattacatcaaggaatcttttgcaaccaatacgttgcaccttattggattgatgagtgatggaggtgtgcactcacgccttgatcaattgcagttgttgcttagaggagctagtcagaatggcgccaagaggatacgtgttcatgtgcttaccgatggtcgtgatgttttagacggctcaagtgttggttttgctgaaacacttgaagcagaactttcagatctacgcggtaaaggcattgatgcacaggtggcatctggtggagggcgtatgtatgtcaccatggaccgttacgagaatgattgggaagttgtgaaacgtggttgggatgctcaggttcttggtgaagccccacacaaatttaagaatgtcgttgaggctatcaagacacttagagaggcccctggtgctaatgaccagtacttgcccccgtttgtcatagttgatgatagtggaaaggctgtgggtcccattgtggatggtgatgctgttgtgactttcaatttccgtgcagatcgtatgactatgcttgctcaagctcttgaatatgagaagtttgataaatttgacagagtgcgggtcccaaaaatccgttatgctggcatgcttcagtatgatggggagctcaagcttccaagtcattaccttgtatctcctccactgatagataggacttctggtgaatatttggtgtataacggggtccgtacttttgcttgcagtgagactgtcaaatttggccatgtcacattcttctggaatggaaaccgttctggatatttcaattcagagttggaagaatacgttgaaattccaagtgattctggaattaccttcaatgtccaacccaagatgaaagctttggagatcggtgagaaggcccgtgatgctatcctcagtggaaagtttgaccaggtacgtgtgaacataccaaatggagacatggttgggcatactggtgatgttgaggctactgttgtggcctgcaaagcagctgatgaagctgttaagatgattcttgatgccgtagagcaagtgggtggaatatatgtggtgaccgcagatcatggtaatgctgaagacatggtgaaaagaaacaaaaagggtgagcctcttcttaaagatggtgaggttcagatcctaacatcccacacccttcagccggtgccaattgcaattggcggacccgggttagcagcgggcgtgagattccgcaaggatgtgccaagtggcgggcttgcgaatgtagctgcaactgtgatgaatctgcatgggtttgtagctcctgatgactacgagacaactctcattgaagtcgttgattaaaagtattgaatggaggttttgaattttgttaccccatatttaaataattttgtggaaacagtaaacatttaacgatatgttttgttacaatttccagttttggtttatatgagtggggatctagttagctttatatttgagcaaactcatggttgtaaaaggaatggttgatttgaccaaagctgcaattacttgatagcttggatg

SEQ ID NO: 5262 - DNA, 1929 bp, Nuphar advena
gcagaagcaacagcagtcttcctcagcgatcggtcagatctgtgtaaatgggcagtcctgctttctcgtggaaattggcggatcatcctaagctcccaaaggggaagaccatagcgctcattgtcttggatgggtggggtgaatccaaacccgaccaatacaactgcatccatgtcgccgagacccccaccatggactccctgaaacagggtgcaccggaaaagtggaggttgattagagcacatggtatggcagtgggacttcctactgaagatgacatgggcaacagtgaagtcggtcataatgcactcggtgctgggcggatttttgctcaaggtgctaagttggttgactatgctcttgcctctggaaaaatttatgaaggggaagggttcaagtacatcaaggaatgctttgatattggaactttacatcttattgggttattgagtgatggaggagtccactcacgacttgatcagttgcagttgttactaaaaggtgctagtgagaacggtgctaaaaggatccgtgtgcatgtgctcactgatggtcgtgatgtgttggatgggtcaagtgtaggcttcgtagaaactcttgatagcgaccttgctaaattgcgtgagaaaggtgttgatgcacagattgcatctggtggtggtcgaatgtatgtcacaatggaccgttacgagaatgactggggtgttgttaaacgtggatgggatgcccaggttttgggtgaagcacctttcaagtttcggaatgctgtggaagctgtcaaaaagctcagggaaggtcctaaggccagtgaccagtacttgcctccgtttgtcattgttgacgagaatggaaaagctgttgggcccatagtggatggcgatgctgtggtaacatttaacttcagagcagatcgtatggtcatggttgcaaaagcttttgaatatgaagacttcgacaaatttgatcgtgttcgattccctaaagttcgttatgctggaatgcttcaatatgacggggagttgaaacttccaaactattatcttgtctcccctccagagatagagaggacatctggtgaatatctggtgcataatgacgtccgcacttttgcttgcagtgagactgtgaagtttggtcatgtcacatttttctggaatgggaaccggtcgggttattttaatgctgagttggaggaatatgtggaaattccgagtgatagtggaattacatttaatgtccagccaaagatgaaggctctggagatagctgagaaggctagggatgccatacttagtggaaagtttcaccaggttcgtgtcaacttaccgaatggtgacatggtgggtcacacaggtgatattgaggctacagttgtggcttgcaaggctgctgaccaagctgtcaagatgatgcttgatgctgtggagcaagttggtgggatctatgtaatcactgcagaccatggcaatgctgaggacatggtgaagagaaacaagagtggtcaaccatcgcttgataaaagtggaaatatccaaatcctgacctcccatactcttgctccagttcctattgctattggaggccctggcttgaaggaaggtgtgagattccggagtgatttgccagatggtgggctagctaatgttgctgctacagtgatgaaccttcacggtttcaaagcacccagcgattatgaacctacactcattgaggtcattgacaattaaagaggataaataaggaaacaggatttggttcatgcattggtaatgtagtattgctcaattttgtctttctttgggatacttgtgctggccttgagacttgaggctaaataattttgtcgtgcttgttcggccggtcaattgagttggtaatagttttcaccaacaaattttgcgaccatgatataatatgattactattttt

SEQ ID NO: 5263 - DNA, 1927 bp, Ambrosia trifida
ttcagaaatccacctaacctccatttcttttttataataataaccgtaaactagatcttgttcagaaagcgatggggagcacaggcgtttcattgaaattggcggaccatccaaagctaccgaaaggaaagctcgtagccatgattgttttggacggttggggtgaagcttctcctgataagtttaactgtatccatgttgctgagactcctaccatggattcgctcaaaaacggcgcccctgataaatggaggttggtgagggctcatggtactgctgttgggcttcccactgaggatgacatgggaaacagtgaagttggacataatgctcttggtgctggaaggatctttgctcaaggtgcaaaacttgttgatagtgctcttgcctctggaaaaatttatgaagatgaaggttttaactacatcaaggaatcttttgcaaccaacaccttgcaccttattggattgatgagtgatgggggtgtgcactcacgccttgatcagttacagttgttgctcagaggagctagccagcatggcgccaagaggatccgtgttcatgtgcttactgatggtcgtgatgttttagatggttcaagtgttggttttgctgaaacacttgaagcggaactttctgatctacgcagcaaaggcattgatgcacaggtggcgtcaggcggagggcgtatgtatgtcaccatggaccgttatgagaatgattgggaagttgtgaaacgtggctgggatgctcaggttcttggtgaagccccacacaaatttaagaatgttgttgaggctatcaagacgcttagagaggcacccggtgctaatgaccagtacttgcccccatttgtcatagttgatgatagtggaaaggctgtgggccccgttgtggacggtgatgcagttgtgactttcaatttccgcgcagatcgtatgactatgcttgctcaagctcttgaatatgagaagtttgataagttcgacagagtgcgggtcccgaaaatccgttatgccggtatgcttcagtatgatggggagctcaagcttccaagtcactacctagtatctcctccattaatagaaaggacctctggcgagtatttggtgaataatggggtccggacatttgcttgcagtgagactgtcaaattcggccatgtcacatttttctggaatggaaaccgttctggatacttcaattcagagttggaagaatatgttgaaattccaagtgatagtggaattaccttcaatgttcaacccaagatgaaagctttggagattggtgagaaggcccgggatgctatcctcagtggaaagtttgaccaggtacgtgtgaacataccaaatggagacatggttgggcacaccggtgatgttgaggctactgttgtggcttgcaaggctgctgatgaagctgttaagatgattcttgatgcagtagagcaagttggtggaatatatgtggtgactgcagatcatggtaatgctgaggacatggttaaaagaaacaagaagggcgagcctcttctcaaagatggcgaggttcagattctcacatcacacactcttcagccggtgccaattgcaattggcgggcccgggttagcagcaggtgtgaagttccgcaaggatgtgccaagtggcgggctagcaaacgtggctgcgactgtgatgaatttgcatgggtttgtagcacctgatgactacgagaccactcttattgaagtcgttgattgagtatgaaaggtgatttttacagttcttcaaccccgcgtttgaataatttcccggaaacagtaaacatataatatgttttgttacaatttccagttttggttatatgagtggggtttagctagctttatatttgagcaaactcacggttttaaaagtaatgatgtatttgattcaatttgcgc

SEQ ID NO: 5264 - DNA, 1741 bp, Amsonia hubrichtii
ggagcgttttcttagatctgtgaaatttgaagagaagaaggagaaggtatgggtagctcaggagtttcgtggaaattgaatgatcaccccaagcttcctaaggggaagattattgctatgattgttttagatgggtggggtgaagcaaaacccaatcagtacaattgcatccatgttgctgagactcctactatggactccttcaagaagggtgctcctgaaaagtggagattggtaagggctcacgggaaagccgttgggctgcctacagaggatgatatgggcaacagtgaggttggtcataatgctctcggtgctgggaggatctatgctcaaggtgcaaagcttgttgatctggctcttgagtccgggaaaatctatgaggatgaaggtttcaattacatcaaggaatgttttccaaatggaacattgcatcttattggattgctgagtgatggaggtgtccactcgagacttgaccagttgcagttgttgcttaaaggtgccagcgaacgtggtgccaaaagaatccgtgtccatgctcttactgatggacgtgatgttttggatggttcaagtgtcggcttcatggaaactcttgagaatgatcttgcaaaattgcgggaaaaaggaattgatgcacaagttgcatcaggtggtggtcgtatgtatgttacaatggaccgttatgagaatgactgggaagttgtaaagcgaggttgggatgctcaagttcttggtgaagctccacacaagtttaggaatggtgttgaagctatcaagaaactaagggaaacaccaaattccaatgatcagtacttgcctccctttgttattgttgatgaaaacgggaagcctgttgggcctattgtggatggtgatgctgttgtgactttcaacttccgagcggatcgcatggttatgttagccaaggcccttgagtacgcagattttgataaatttgatagagttcgagtccccaaaattcgatatgctggcatgctccaatatgatggagaattgaagcttcctagtcattaccttgtttctcctccattgattgaaagaacatctggtgaatatcttgttcataatggagttcgtacttttgcttgcagtgagacagttaaatttggtcacgtcacctttttctggaatgggaatcgctctgggtacttcaaccaagaaatggaggaatatgttgaaattccaagtgatagtgggattacctttaatgtgcagccaaagatgaaggctttggaaattggggagaaggctagagatgctatccttggtcgcaaattccaccaggtacgagttaacataccaaatggtgacatggtggggcacacaggtgatattgaagcaacggttgtggcttgcaaagcagctgatgaggctgtgaagatgatcattgatgcaatagagcaagtgggtgggatatatgttgttactgctgatcatggaaatgctgaggatatggtgaagagaaacaagaagggagagcctcttttagacaagaatggcaaaattcaaatacttacttctcacactcttgaaccagttcctattgcaattggtggacctgggctggcacctggagtcagattccgtcaagatcttcccggtggtggactagctaatgtggctgcaaccgttatgaatttacatggttttgaggcacctagcgattatgagccaaccctgattgaggttgatgacaaatagaggctataggatt

SEQ ID NO: 5265 - DNA, 2484 bp, Ricinus communis
cgaagcacgacgtgtaccagttacacattaaaaggttcaaagccaaacagccaagtgtacccttaaccctaaagtagtaataacaacggcaaaaagcagcgaatagcaagtggtatttaaatccaacggcgagaaaccgctcatttctgatctcgaacttcaatatccacggtccacacattctcatataaaccaacgcatgcaacctactatgtactcgctctatctcactctgtagatttgcagagaacccgatttatcataacccaagaaccctgatttaatctcttttgtttgtcttcaccagtcgattttcagataaaactttttcggtttggttcgatttgatagagaaagaaagagagatgggaagctcaggtgaatttacatggaaattggcggatcatccaaagttaccaaaaggaaagacaatagcaatggttgttttggatggttggggtgaggctaaacctgatcagtataattgtatccacgttgccgagactcccaccatggattccttcaaaaagactgcacctgagagatggaggctgattaaagctcatggaacagcggtgggacttccaactgaagatgatatgggcaacagtgaagttggtcacaacgcgctcggtgctggacgcatttatgctcaaggtgcaaagcttgttgatcttgctcttgcctctggaaaaatctatgaaggagagggatttaagtatgtaaaggaatgttttgacaaaggcactttgcatctcattgggttactgagtgacggtggagttcattccaggctggatcaattgcagttgttgctaaaaggtgctgctgaacatggtgctaaaagaatccgagttcatgttcttactgatggacgtgatgttatagatggtacaagtgttggctttgctgaaactcttgagaaagacctggaaaatttgcgagagaaaggtgttgatgcacaggttgcatctggtgggggtcgcatgtatgttacaatggatcgttatgagaatgactggaatgttgtgaaaagaggatgggacgctcaggttcttggtgaagccccatacaagtttaagagtgctgttgaagccatcaagaaactaagggaagagcccaaagccaatgaccagtacttacccccttttgtcattgttgatgagaacgggaagcccgtaggcccaattgtggatggcgatgctgttgtcacgatcaattttcgtgcagatcgtatggttatgcttgctaaggcgcttgaatacgaaaattttgacacatttgatagagttcgattccctaagatccattatgctggaatgcttcagtatgatggcgagctcaagcttccaagccattacctcgtatctcctccagagatagaaagaacatctggtgaatatttagtgcataatggtgttcatacgtttgcttgcagtgagactgtcaaatttggtcacgtcactttcttttggaacggaaatcgctctggttatttcaacccagaaatggaggaatatgtcgaaatacctagtgatgtgggaattacattcaatgtccagccaaagatgaaggcaatagagattgcagagaaggcaagggatgctatcctcagtggcaaattccagcaggttcgtgttaacataccaaatggtgacatggttggacatacaggagatgttgaagccacagttgtggcttgcaaggctgctgacgaagctgtgaagatgatcattgatgctatagagcaagtcggtggaatatatgttgttactgcagatcacggcaatgcagaagacatggtaaagagggacaagtctgggaaacctatggctgataagagtggcaagattcagattctcacatctcacactctgcagcctgtgcctattgccataggaggtcctggattgacacctggagtgaggttccgcagcgatattcctactggcggacttgccaatgtggctgcaactgtgatgaatcttcatggatttgaggctcctagtgattatgagcctacactcattgaggctgttgataactaggattgacaggagggagaaacccaaaaaagttataaaaaagtttaggtttgcataaattttgattagaaactgtgcaatgcggaagccagtgatacacagcaagttatcttgttaaataagttattttaatcatcctcggccgggtttttttctttttaatcctatcatggatctggatatccatctgtttatgatcgaaagtttactggaaaactgtattttaaatgtacttttgctatttatctgaattggcccttttgaatcacttattcttgttcacttcgccttcaattttttaactggtttgaagctgaagggaaagaagtgttgttctatatcccgttgtttcatgatccttccttcaactaatgcaatgggccaagtatttacaagcaacagttaaagttgtgaatatatgagccaatagaattataac

SEQ ID NO: 5266 - DNA, 2080 bp, Cephalotaxus harringtonia
ggaatatgggcagcacgggctggaagttggccgatcatccgaagcttccaaaggggaagcagttggctgtgattgttttggacggatggggggaagagaagcccgatcagtacaattgcattcatgttgccgatacacctaccatggattccctcaagcagggggctccagagaaatggatgctggtcaaagcgcatggacctgcagttggactccctacagaagatgatatgggaaacagtgaagtgggccataatgctcttggagctgggagaatatttgctcaaggggctaaattagtagatctggctcttgaatcgggcaaaatctacgatggcgaagggtttaagtacattaaggaatgttttgaaacaggcacacttcatttcgttggccttttgagcgacggcggtgttcattcacgactagatcagttgcagttgcttttgaaaggttctgccaagaatggtgccaaaagaatccgagtgcatatcctcaccgatggtcgtgattgtcttgatgggtctagcattggttttgttgagacattagagaaagatcttgcagagttacgtaaacagggtattgatgcacagattgcatctggtggtggtcgcatgtatgtcacaatggatcgctatgagaatgattggggtgtggtcaagcgaggctgggatgcacaggttttgggagaggcaccctataaattcaggagtgctgtggaagcagtcaaaaaactcagggaggatcttaaggtctctgatcagtacctgcctccctttgtcatagttgatgaaaatgagaaagcggttggacccattcttgatggagatgcagtagtaaccttcaattttcgagcagatcgtatggttatgattgccaaagcattagaatatgaaaatttcaacatgtttgatagagttcgataccccaaaattcattatgcaggaatgcttcagtatgacggagaattaaagcttccaagtcattatcttgttacaccaccagaaattgacagaacatcaggagaatattttgtccataacggtatccgaacatttgcatgcagtgaaactgtgaagtttggtcatgttacatttttttggaatggcaaccggtcaggatattttaacaaggaccttgaagaatatgtagaaatcccaagtgattcagggattacattcaatgaaaagccaaaaatgaaagctttagaaattgctgagaaggcaagagatgctattttaagtggcaagtttgatcaggttcgtgtaaatttacctaatggtgacatggttggacacactggcgatattgaggcaacggttgttgcatgtaaagttgctgatgaggctgtaaaggtgattcttgatgcagtagaacaagctggtggcatctaccttgttactgctgatcatggaaatgctgaggatatggtgaaaagaaacaccaaaacaggaaagccacagctggataaagatggaaaaatccaaattcttacttctcatactttatctccggtaccaatcgccataggaggtcctggactgaaggatggtgtaaggttccgaaatgatttgaaacagccggggcttacaaatgtggcagctactatgatgaatcttttgggatttgaggctcccagtcagtatgaaccaacattgattgaagttgtggacaactgatctctaaatcaaacctggatgacacaaggctaataaaaaagtcaagtttttgatggttaggaagacgattgctaaccaagagtatctacattttgattggatggctctggtttctttttgtagacttctattgttaaagtcgaagcaatgcatacttaagaaataattcatcaagatactatttatgatgtcaatttagatgttgtatttaatttgatgagaggtatgtatatggtggggatgttgcattgtttgagaatgtctaaataagatttgatcctaaatttacaaaacagggtccagtagaccaaaatatgagagttgttccgcaagaaaagtcttgttattgacagggtctcacacaagttatattgttccatgttaggctaggttcattc

SEQ ID NO: 5267 - DNA, 2053 bp, Euonymus alatus
agctttggtagtcacatccacttgtctcttcctcctttgaagttcagttgcaggtgagagagagagagattgacgaggatggggagcgcaggcgaagttaactggaaactggcggatcatccgaagctgccgaaagataagatcgtggcgatggtggttttggatgggtggggtgaagctaatcccgatcagtataactgcatccacgtcgccgatactcccaccatggactccctcaggaagggtgctcccgagaagtggagattagttagggctcatggtaaggctgtgggccttccaactgaggatgacatgggcaacagtgaagttggtcacaatgcactgggcgctggccgcatttttgctcaaggagcaaagcttgtagaccttgctcttgcttctgggaaaatctatgaaggagaagggtttaactacataaaggagtgctttgaaaccggtacattgcacttgattgggttattgagtgatggaggagtgcactccaggcttgatcagttgcagttgttgctaaaaggagctgcccaacatggtgctatgagaattcgtgttcatatacttactgatgggcgtgatgtcctggacggttcaagtgtaggattcgtggaaactcttgagaaagatattgaagaactacgtgcaaagggggttgatgcatatatagcatctggtggcgggcgcatgtatgtgactatggatcgctatgagaatgactggaatgtggtgaaacgtggatgggatgcccaagttcttggtgaagcaccacacaaatttagaaatgctgttgaagctgtcaagaaattgagggaagatccaaaagccaatgatcagtacttacctccttttgttattgtcgatgagaatgggaagcctgttggccccataaatgatggtgatgctgttgtcacgttcaacttccgagcagatcgtatgactatgcttgccaaggctcttgagtacgaagattttgacaagttcgatcgtgttcgatttcctaaaatccattatgctggaatgcttcaatatgatggtgagttgaagcttcccagccattaccttgtttctccaccagagattgacagaacttctggtgaatatttagtgcacaatggcgttcgtacctttgcttgcagtgagactgtcaagtttggtcatgtcactttcttctggaatggaaatcgctctggttgtttcaatcctgagatggaagaatatgtggaaattccaagtgatattggaattacttttaatgtccaaccaaaaatgaaggcaaaggagattgctgaaaaggcgagggatgctatccttagccgcaaatttcatcaggttcgtgttaatctaccaaatggtgacatggtgggtcatacaggagatattcaggccaccgttgtgggatgcaaggtcacagacgatgctgtcaaggtgatccttgatgcgatagagcaagttggtggcatatatgttgttactgccgatcatggaaatgcagaggacatggtgaagaggaataaatctgggcaacctcaacttgacaagaaaggaaagattcaagttctcacttcccacactctccagccggtgcccattgcaattggtggccctggattggcacctggtgtcagataccgcaaagatttaccaaatggtgggcttgccaacgtggccgccactgtgatgaacctccatggatttgaggcacctagtgactatgagccaactctcattgaagttattgacaactagggtatccaccatacaaaatggtggatgtaccttatatatatgtcataaattttgattgccgtttgtgcaatgcaggacagcaggagttcctccactattttattttggggaaataaattaattataattctgctccggggatcatgagctctctctcattatgttggattaccgtttttggttgctttctatcgcatgaggacagaacagtttgtgtaatgacatttttgtgtgttaattctgcctcttctttttttttcctcctttcgttcattgcgccatcctattatct

SEQ ID NO: 5268 - DNA, 1908 bp, Fagopyrum esculentum
actgatttttcatggaagttgcccgatcatcctaagcttcccaaggggaagacgattgccatgattgttttggatggatggggtgaggctgctcttgatgattataattgtatccacaaagctggtaccactaccatggattctcttaagcagggtgcccctgaaaaatggaggctgatcaaagctcatggtactgctgttgggttaccttctgaggatgacatgggcaacagtgaagttggccataatgctcttggtgctggtcgggtatttgctcaaggtgctaagcttgttgacaatgcacttgctactggaaaaatttatgacggtgaaggctttaaatacatcaaggaatcttttgagagtggtacactacatcttattggtctcttgagtgatggaggtgtgcactctaggcttgatcaggttcagcttttgctgaagggtgccgctgaacatggtgccaagagaatccgtgttcatttcctcactgatggacgtgatgttttggatggctcaagtgtgggttttgtcgaaactcttgaggctgacctagcaaagctgcgtgaacaaggtgttgatgctagagttgcatctggtggtggtcgtatgtatgtcacaatggaccgttatgagaatgactgggaggttgtaaaacgtggatgggatgcccaagttcttggtgaagctccatacaaatttaccagtgctgtggaagctgtcaagacactaaggcaggagcccggttccaatgaccagtacttgaaaccatttgtttgcgttgatgaaagtgggaaagctgttggaccaatagtggatggggatgctgtggtaacattcaacttccgtgcagatcgtatgactatgcttgccaaggcacttgagtacgaagattttaataattttgacagagttcgattccctaagatccgctatgcgggtatgctccaatatgacggtgaattgaagcttcctgccaagtatcttgtatctcccccagaaatcgagaggacatctggagaatatttagtgcataatggagtccgtacttttgcttgcagtgaaactgtcaagtttggccatgttacctttttctggaatggtaaccgttcaggctacttcaatgctcaaatggaagaatatgtagaaatccccagtgacagtggtatcagtttcaatgtccagcctaagatgaaggctgtggaaattgccgagaaggcaagggatgccatccttagtggcaaattcgaccaggtgcgtgtcaacataccaaatggagatatggttggtcatactggtgacattgaggccaccgttgtagcttgcaaagctgctgatgaaggcgtcaagataatccttgatgcaattgagcaagttggtggcatattcgtcgtcacagctgaccacggaaatgccgaagatatggtgaagagagacaagaagggtaagccacttttggacaagaatggcaagcttcaaatcttaacatctcacacccttcagccggttccaattgcaattggtggccctggactcgcacccggtactagattccgcacagacgttcccaccggtggccttgctaacgtagctgcaacggtgatgaacctccatggactagtcgccccagatgactatgagacaacattgattgaggtcgtcgaaaactaggtttccaaagcgagcaaggtccttaagttaaacacattttagctgctggaagttttgaattggtgatggtatttttgaggatgcttttttaataattacaactcgggcttgtatttgatccggcctcttgcgagagaaacaattctgaatgccattgtcttgcgttcctaaccccaataactttacttgctcggagtgttttgaacattaaaagtatcaatttgaactcttacttct

SEQ ID NO: 5269 - DNA, 1940 bp, Flaveria ramosissima
ggttctgcaatccacctacttcattttacatcatttccaaaggcaaacgagatctagaagaagaagaagaagaaactgtgacggagaaaacgatggggagcaccggattttcatggaaactggcggatcatccaaagctgccgaagggaaagctggtggcgatggttgttttggacggttggggtgaagcttctcccgataagttcaactgcatccatgtcgctgaaactcctaccatggattctctcaaaaacggcgctcctgataaatggaggctggtgagggctcatggcactgctgttggacttcctactgaggatgacatgggtaacagtgaagttgggcataatgctcttggtgctggaaggatctttgctcaaggggcaaaactcgttgatcttgctcttgcctctggaaaaatatttgaagatgaaggttttaattacatcaaggaatgttttgcaaccaacaccttgcaccttattggattgatgagtgatggaggtgtgcactctcgccttgatcaattgcagttgttgcttagaggagctagccagcatggcgccaagaggatacgtgttcatgtgcttactgatggtcgtgatgttttagatggttcaagtgttggttttgctgaaatacttgaagcagaactttcagaacttcgcagtaaaggcattgatgcacaagtggcatctggtggagggcgtatgtatgtcaccatggaccgttatgagaatgattgggaagttgtgaaacgtggttgggatgctcaggttcttggtgaagccccacacaaatttaagaatgctgttgaggctatcaagacacttagagaggctcctggtgctaatgaccagtacttgcccccatttgtcatagttgatgatagtggaaaggccgtgggtcccattgtggatggtgatgctgttgtgactttcaatttccgtgcagatcgtatgactatgcttgctcaagctcttgaatatgagaagtttgataaattcgacagagtgcgggtcccaaaaatccgttatgctggcatgcttcagtatgatggggagctcaagcttccaagtcattaccttgtatctcctccattgatagataggacttctggtgaatatttggtgcataacggggtccgtacttttgcttgcagtgagaccgtcaaatttggtcatgtcacatttttctggaatggaaaccgttctggatatttcaattcagagttggaagaatatgttgaaattccaagtgatactggaattaccttcaacgtccaacccaagatgaaagctttggagattggtgagaaagcccgagatgctatccttagtggaaagtttgaccaggtacgcgtgaacataccaaatggagacatggttgggcatacaggcgatgttgaggctactgttgtggcctgcaaggcagctgatgaagctgttaagatgattcttgatgctgtagaacaagtgggtggaatatatgtcgtgactgcagatcatggtaatgctgaagacatggtgaaaagaaacaagaagggtgagcctcttctcaaagatggcaaagttcagatcctaacatcacacacccttcagccggtgccaattgcaattggcgggcccgggttagcagagggtgtgagattccgcaaggatgtgccgagtggtggtttagcaaacgtagctgcaactgtgatgaatctgcatgggtttgtagcacctgatgactacgagacaactctcattgaagtcgttgattaagtatgaatggaggttttgtatttccttcccccatatttaaataatttgtggaaagagtaaacatttaactatatgttttgttaaaatttccagttttggttacatgtgtgggggggtttagttagctttatatttgagcaaactaatggttgtaaaaggaatggttgatttgac

SEQ ID NO: 5270 - DNA, 2021 bp, Silene vulgaris
tataccctatttctccgctattcattcctttacacttcccctctcgtttaaaaaaaaactagagaaaataaaagatgggaagcacagatttatcatggaagttagcagatcatccaaaacttggaaagataaaataattgcaatgattgtgctagatggttggggtgaagctaatgctaatcagtacaattgtattcatgttgctgatacacctaccatggattcccttaaacatggtgctccagataaatggaggttgattagggctcatggaaaagctgtggggctaccaactgaggacgacatgggaaacagtgaagttggccacaatgctcttggtgccggccgaatctttgctcaaggagcaaagttggtggatcttgcccttgcctcgggaaaaatttatgatggtgaaggttttaattatataaaggagtgttttgagactaacactttgcaccttattgggctcttgagtgacggtggtgtccattctcgtcttgatcagttacagttgttgttgaaaggaactgcggaacgtggtgccaagaggatccgagttcatattcttactgatggccgtgatgttttggatggctcaagtgttgggtttgtggaaactcttgagaaggatctttcagagctacgttctaagggtattgatgcgcagattgcatctggtggtggtcgcatgtacgtcactatggatcgctatgagaatgattgggaagttgtgaaacgaggctgggatgctcaggtacttggtgaagccccatacaagttcaagagtgcagttgaggctgtcaagacattgagagcagaaccaaaggctaatgatcaatacttgcccccttttgtcattgttgatgacaatgacaaggctgttggtccaatagtcgatggtgatgctgttgtaacaattaacttccgtgctgatcgtatgactatgattgcaaaggcccttgaatatgagaattttgataagtttgacagagttcgcgttcctaaaatccgttatgctggcatgcttcaatatgatggtgaattgaagcttccgagccactatcttgtttctcctccagaaatcgatagaacttctggggaatatctaacttacaacggtgtgcacacttttgcctgcagtgaaacagtcaagtttggtcatgttaccttcttctggaatggaaatcgctccggatacttcaactcagaaatggaagagtatgtggaaattcctagtgatagtggcattactttcaatgttaaacctaaaatgaaggctgtggagattgctgaaaaggctagggatgctattttgagccgcaaattccaacaggttcgtgtcaatctacctaatggtgacatggtgggccataccggtgatatagaagccacagttgtggcttgcaaagctgctgatgaggctgtaaagatcatccttgatgcaattgagcaagttggtgggatatatgttgtaactgctgatcatggaaatgccgaagacatggtaaagagggacaagaaggggcagccacagcttgacaaggctggaaacattcagattcttacgtctcacacactagaacctgtgcctatcgcgattggaggacctggacttgctcagggagtaagattccgcaaggatgttcccacaggtggtctggctaatgtagcggccacagtgatgaatctacatggattcgaagctcctagtgattacgagccaacccttatcgaggttgtggacaactagatgagctactactatttttctggagacagatctatatttaatttttgactgggattgtgccatattgatatgggatgcctctttcttaacagaggtcaataacgtcccttcattttgtgtgcaacttacaattttaattagatgaggatgagatactcctgtgacttctgtttccataaagttagtgtgttcagaatttcagattaccttaggctcaattaataattaagaaaaagtgatttgcatgttcaaaataagccttgttttt

SEQ ID NO: 5271 - DNA, 1900 bp, Helianthus annuus
actacattttagaaagcgcaaacgagatctgagactgagaaaacgatggggagcacaggattttcatggaaactggcggatcatccaaagctaccgaaaggaaagctagtggccatgattgttcttgacggttggggtgaagcttctcccgataagttcaactgcattcatgttgctgaaactcctactatggattctctcaaaaacggcgcccctgataaatggaggttggtgagggctcatggtactgctgttgggcttcccaccgaggacgacatgggaaacagtgaagttggacataatgctcttggtgctggaagaatctttgctcaaggtgcaaagcttgttgatcttgctcttgcctccggaaaaatttatgaagatgaaggctttaattacatcaaggaatgttttgcaaccaacaccttgcaccttatcggactgatgagtgatgggggtgtgcactcacgtcttgatcagttgcagcttttgctaaggggagctagccagcatggcgctaagaggatccgtgtccatgtgcttactgatggtcgtgatgttttagatggttcaagtgttggttttgctgagacacttgaagcagaactttcagatctccgcagcaaaggcattgatgcacaggtggcatctggtggagggcgtatgtatgtcaccatggaccgttatgagaatgattgggaagttgtaaaacgtggttgggatgctcaggttctcggtgaagccccacacaaatttaagaacgttgttgaggctatcaagacacttagagaggcacccggtgctaacgaccagtacttgcccccatttgtcatagttgatgatagtggaaaggctgtgggccctgttgtggacggtgatgccgttgtgactttcaatttccgtgcagatcgtatgactatgcttgctcaagctcttgaatatgagaagtttgataaattcgacagagtgcggttcccgaagattcgttatgctggcatgcttcagtatgatggggaactcaagcttccaaatcattaccttgtatctcctccattgattgagaggacttctggcgagtatttggtgaaaaatggggtccggacatttgcttgcagtgagactgtcaaattcggccatgtcacatttttctggaatggaaaccgttctggatatttcaattcagagttggaagaatatgttgaaattccaagtgacagtggaattacctttaatgttcaacccaagatgaaagctttggagatcggtgagaaggcccgtgatgctatcctcagtggaaagtttgaccaggtacgtgtgaacattccaaatggagacatggttgggcatactggtgatgttgaggctactgttgtggcctgcaaggctgctgatgaagctgttaagatgattcttgatgcggtagagcaagtgggtggaatatatgtggtgactgcagatcatggtaatgctgaagacatggttaaaagaaacaagaagggcgagcctcttctcaaagacggcgaggttcagattttaacatcacacacccttcagccggtgccaattgcaattggtgggcccgggttagcagcaggtgtgaagttccgcaaggatgtgccaagtggggggctcgcaaatgtggctgcgactgtgatgaatttgcatgggtttgtagcacctgatgactacgagactactcttattgaagttgttgattgagcatggaaggtgattttgacatttctttgaccccatatttaaataatttcccggaaacagtaaacatatgacaatatgttttgttacaatttcaagttttggctatatgagtggggtttagctagctttatatttgagcaaactcatggttgtaaaagcaactgcaacttgaatcaaatca

SEQ ID NO: 5272 - DNA, 1983 bp, Thellungiella halophila
  misc_feature (1804)..(1804): n is a, c, g, or t
  misc_feature (1806)..(1806): n is a, c, g, or t
  misc_feature (1813)..(1813): n is a, c, g, or t
gaacctaccatacctcaccacatcaccctcacgtctctgcgaatctccatacgactctttgagctttctctctgtttctccgctgctatgggtagctccggcgacgttaactggaaacttgaggaccatcccaagctccccaagggtaaaaccattggcttaattgttctcgatggatggggtgaatccgaacctgatcaatacaattgcatccacaaagctccaactcctgccatggattcccttaaaaacggaaagcctgatacatggaggctgatcaaagcccatggcacagcggttggtctccccagcgaagatgacatgggaaacagtgaagttgggcacaatgctctcggagccggtcgaatctacgctcaaggtgctaagcttgtcgatctagctcttgagtcagggaaaatctacgaggatgaaggtttcaaatacatttctgaatctttcgagaaaggcactgtgcaccttatcggacttttaagcgacggtggagtccactcccgcctcgatcaagtgcagctgctgttaaagggtttcgcagaacgtggcgcgaaaagaatccgtgtccatgttcttactgatggtcgtgatgttttggatggctctagtgtcggctttgtggaaactcttgaagctgacctcgctgacttacgttccaaaggtgttgatgctcagattgcctctggtggaggtcgtatgaatgtcacaatggatcgttacgagaatgactggaatgttgtgaaacgagggtgggatgctcaagtccttggagaagctccccacaaattcaaaagtggtcttgaagcaattaagacactgagggccgagcctggtgccaatgaccagtatttgcctccctttgtcattgttgatgacagcggaaaggctgtgggtccaattgttgatggtgacgcagttgtcactttcaatttccgtgctgatcgaatggtcatgcatgcaaaggccctcgaatatgaagattttgataagtttgatcgcgttagaggcccaaagatacgttatgcaggaatgctccaatatgatggagagctaaagcttccaagccattaccttgtttctccaccactgattgataggacttctggtgaatatcttgcacacaatggcatccgcacttttgcttgcagtgagactgttaagtttggccatgtaaccttcttctggaatggaaaccgctctggatattttaacgaaaagctggaaaagtacgttgagattccaagtgatagtggaatatcattcaatgtccagccaaagatgaaagcgctggagattgccgagaaagcaagggatgctatcctcagtggcaagtttgaccaggtgcgtgttaacctgccaaatggagacatggtgggtcatacgggtgatattaaagcaactgttgttgcctgtgaagctgctgatgttgctgtgaggataatcctcgatgccatagaacaggtgggagggatatatgttgtgactgcagatcacggaaatgctgaggacatggttaaaagggacaaagctggtaagcccgctctggacaaggaaggaaaccttcagattctcacctctcacaccctgaaaccggtgccaattgcgataggaggacctggtttgtcagcaggagttaagttcagacaggatttggagacacctgggcttgcgaatgtagctgccacagtgatgaacctgcatggatttgtggcccctggcgactatgagccgagtttgattgaagtagtcgacaagtaatgatatggtgtggatgttattccctgcaaaagtncnacctgancctctctaaactattgttctgttcaagttacgtatttctcgtgctctttaataaggcccgtgatttttaaccttttagttactcgccaccctcacgatgtgggtcgagcaagttctccttttttttgaacaatgtgggtcaagcaagttaaagactacttttgatgtttt

SEQ ID NO: 5273 - DNA, 1854 bp, Vinca minor
taaactgagaagagaaccctgttgcctgttgttttgtcttgcatacttacattcattccagatttagagattctaagaagaaatgggcagctcaggattttcatggaaattgaatgatcatccaaaacttccaaaggataagattattggtttgattgttttagatggctggggtgaagctcatcccaatcagtataattgcatttctgttgctgagactcccactatggattctttcaagaagggtgctcctgaaaggtggagattggtgagggctcacggcaaagcagtgggtctgcctactgaggatgatatgggcaacagtgaagttggtcacaacgctcttggtgctggcaggatctatgctcaaggggcaaaacttgttgatctggcccttgagtctggaaagatctatgaggatgaaggttttaactacatcaaagaatgttttggaactggaacattacatctcattggattgctgagtgatggaggtgtccactcaagactcgaccagttgcagttgttgcttaaaggtgccagtgagcgtggtgccaaaagaatccgtgtccatgctctcactgatggacgtgatgttttggatggttcgagtgttggcttcatggaaacacttgagaacgatcttgtgaaattgcgagagaagggaattgatgcacaagttgcatcaggtggtggacgtatgtacgttacaatggatcgttacgagaatgattgggatgtaataaagcgaggttgggatgctcaagttcttggtgaagcaccacacaagtttaagaatccagttgaagctgtcaagaaactaagggaggaaccgaaatccaacgaccagtacttacctccatttgttattgttgatgacaacgggaagcccgttggacctattgtggatggtgatgctgttgtcactttcaatttccgggcagatcgcatggttatgttagccaaggcgcttgagtacgcagattttgataagttcgatagggttcgggttcccaaaattcgttatgctggaatgctccaatacgatggagaattgaagcttcctaatcattacctagtttctcctccgttgattgaaagaacatccggtgaatatcttgtgaataatggagttcgtacgtttgcttgcagtgaaacagttaagtttggtcatgtcaccttcttctggaacggaaatcgctcggggtactttaatcaagaaatggaggagtatgttgaaattccaagtgatagtgggattaccttcaatgttaagccaaagatgaaggctttgcagatcgctgagaaggctagagatgctatccttagtcgcaagttccagcaggtacgagttaacctgccgaacagtgacatggtggggcatacaggtgacattgaagcaacagttgtggcttgcaaggcagctgatgaggctgtgaagatgatcattgatgcaatagagcaagtgggcgggatctatgttgtcactgctgatcacggaaatgctgaggatatggtcaagagaaacaagaaaggggagcctcttcttgacaaaaatggcaaaattcaaatactcacatctcacacactcgaaccggttcccttagcaattggtggacctgggctggcacctggagttagattccgtgaagatgttcccaacggaggacttgctaacgttgctgcaactgttatgaatttacacggtcttgaggcacctagcgattacgagacaaccttgatagaggttgttgataaatagggtatagattttgaatcccaaagtttaaacaatctggggcatgaaataccggagatagcaatgggaatggaggaccaatatccattagattt

SEQ ID NO: 5274 - DNA, 2009 bp, Gossypium hirsutum
tataatcaactacctaatcctctcgctctctcaaccacaagctaactagcaaacacacacacatactaacatctatggggagttcagggcagcaagtctcctggaaattggcggatcacccaacacttccaaaggggaagacccttgctctcatcgttctcgatggctggggcgaggacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcggtgcaggtcgcattttcgctcaaggggctaagcttgttgatattgctcttgcctctggaaaaatctatgaaggagaaggattcaagtacataagcgaatgctttgaaaagggaactttgcacctgattggattacttagtgatggtggcgtccattcacgacttgatcaattgcagttgttgctgaagggagctagtgagcgtggtgctaaaagaattcgtgttcatattctcaccgatggtcgtgatgtattggatggttcaagtgtaggctttgtggagactcttgagagtgaccttgcaaaattacgtgagaatggtgttgatgcccagattgcatctggtggaggccgcatgtatgtcacaatggaccgttatgagaatgattgggacgttgtgaaacgaggatgggatgctcaggttcgtggtgaagcccctcacaagtttacaaatgctgttgaagctgtaaagaaattaagggaaaacgccaatgaccagtacttacctccctttgttattgttgatgagaatgagaaagctgtgggtccaatagaagatggtgatgctgttgttacttttaacttccgagcagatcgaatggttatgctcgcaaaggcactcgagtatcaagatttcgacaaatttgatcgcgtaaaggttcctaaaattcgttatgctggaatgctccaatatgatggtgagttgaagcttccaggccgctaccttgtttctccccccgagattgacagaacatccggcgaatatttggtgcacaatggtgtacgtacttttgcgtgcagtgagacagttaaatttggccatgtcacattcttctggaatggaaatcgctccggctatttcaaccctgaaatggaagaatatgtggaaatcccaagtgacgttggcattacattcaatgttcaaccgaaaatgaaggcactggagattggtgaaaaggctagggatgcaattctgagccgcaaattcgaccaggtgcgtgtgaacattccgaatggtgatatggttggtcatactggagatatccaggctactgttgtggcatgcaaggccgctgatgaagctgtcaagatgatcattgatgccatagagcaagttggtggaatatatgttgtgaccgctgaccatggcaatgctgaggacatggtgaagaggaataagtccgggcaacctctttatgacaagagtggcaagctccaaatcctcacttcccacacttgtcagcctgtgcctattgcaatcggaggtccaggattggcagcaggcgttagattcaggaatgatgttccggatggcggacttgcgaatgtggctgcaactgtcatgaacctccatggttatgtagctccaaatgactatgagccaacactcattgaagtagtgagcaattagaggcatatgttgcggtcgctgaatgggctaaacgagtttagaataaggatatatttggttcaaaaaaaagttagtattttggtagacatatgtggtattgagtatatttccccaatgtgttgggaaaatatttgggcttcattgccccaattttaagaaaatgggatcgaatgttgaactgatttgcactatgaggtctttttatgattgtttgaaatttttaatgcccaaagattggattattttcatcaacta

SEQ ID NO: 5275 - DNA, 2310 bp, Gossypium raimondii
cacgtggtgatgcactcacccacgggttcgctacgcactcagtcttcacgccatctgttttatatatattattgttattatttaagtcaaaacccgaaagctgcaacgcttcgccattcacgccgttcacccctttttttttcattttgcctgatttttcgagttttagatttcttatataatcaactacctaatcctctcgctctctcaaccacaagctaactagcaaacacacacacatactaacatctatggggagttcagggcagcaagtctcctggaaattggcggatcacccaacacttccaaaggggaagacccttgctctcatcgttctcgatggctggggcgaggacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcggtgcaggtcgcattttcgctcaaggggctaagcttgttgatattgctcttgcctctggaaaaatctatgaaggagaaggattcaagtacataagcgaatgctttgaaaagggaactttgcacctgattggattacttagtgatggtggcgtccattcacgacttgatcaattgcagttgttgctgaagggagctagtgagcgtggtgctaaaagaattcgtgttcatattctcaccgatggtcgtgatgtattggatggttcaagtgtaggctttgtggagactcttgagagtgaccttgcaaaattacgtgagaatggtgttgatgcccagattgcatctggtggaggccgcatgtatgtcacaatggaccgttatgagaatgattgggacgttgtgaaacgaggatgggatgctcaggttcgtggtgaagcccctcacaagtttgcaaatgctgttgaagctgtaaagaaattaagggaaaatgccaatgaccagtacttacctccctttgttattgttgatgagaatgagaaagctgtgggtccaatagaagatggtgatgctgttgttacttttaacttccgagcagatcgaatggttatgctcgcaaaggcactcgagtatcaagatttcgacaaatttgatcgcgtaaaggttcctaaaattcgttatgctggaatgcttcaatatgatggtgagttgaagcttccaggccgctaccttgtttctccccccgagattgacagaacatccggcgaatatttggtgcacaatggtgtacgtacttttgcgtgcagtgagacagttaaatttggccatgtcacattcttctggaatggaaatcgctccggctatttcaaccctgaaatggaagaatatgtggaaatcccaagtgacgttggcattacattcaatgttcaaccgaaaatgaaggcactggagattggtgaaaaggctagggatgcaattctgagccgcaaattcgaccaggtgcgtgtgaacattccgaatggtgatatggttggtcatactggagatatccaggctactgttgtggcatgcaaggccgctgatgaagctgtcaagatgatcattgatgccatagagcaagttggtggaatatatgttgtgaccgctgaccatggcaatgctgaggacatggtgaagaggaataagtccgggcaacctctttatgacaagagtggcaagctccaaatcctcacttcccacacttgtcagcctgtgcctattgcaatcggaggtccaggattggcagcaggcgttagattcaggaatgatgttccggatggcggacttgcgaatgtggctgcaactgtcatgaacctccatggttatgtagctccaaatgactatgagccaacactcattgaagtagtgaacaattaggcatatgttgcggtcgctgaatgggctaaacgagtttagaataaggatatatttggttccaaaaataggtagtattttggtagacatatgtggtattgagtatatttccccaatgtgttgggaaaatttttgggcttcattgccccaattttaagaaaacgggatcgaatgttgaactgatttgcactatgaggtctttttatgattgtttgaaatttttaatgcccaaagcttggattattttcgtcaaccatttctcgttgccccttgtctatttttgcagcttattctttatttttcgttcgcatgtacttctatactcttaacatattattaaattttaaattaagatttagattatggcatactttagttgaaa

SEQ ID NO: 5276 - DNA, 2166 bp, Gossypium hirsutum
caacgcttcgccattcactccgttcaccctttttttttcattttgcctgatttttcgagttttagatttcttatataatcaactacctaatcctctcgctctctcaaccacaagctaactagcaaacacccacacatactaacatctatggggagttcagggcagcaagtctcctggaaattggcggatcacccaacacttccaaaggggaagacccttgctctcatcgttctcgatggctggggcgagtacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcggtgcaggtcgcattttcgctcaaggggctaagcttgttgatattgctcttgcctctggaaaaatctatgaaggagaaggattcaagtacataagcgaatgctttgaaaagggaactttgcacctgattggattacttagtgatggtggcgtccattcacgacttgatcaattgcagttgttgctgaagggagctagtgagcgtggtgctaaaagaattcgtgttcatattctcaccgatggtcgtgatgtattggatggttcaagtgtaggctttgtggagactcttgagagtgaccttgcaaaattacgtgagaatggtgttgatgcccagattgcatctggtggaggccgcatgtatgtcacaatggaccgttatgagaatgattgggacgttgtgaaacgaggatgggatgctcaggttcgtggtgaagcccctcacaagtttacaaatgctgttgaagctgtaaagaaattaagggaaaacgccaatgaccagtacttacctccctttgttattgttgatgagaatgagaaagctgtgggtccaatagaagatggtgatgctgttgttacttttaacttccgagcagatcgaatggttatgctcgcaaaggcactcgagtatcaagatttcgacaaatttgatcgcgtaaaggttcctaaaattcgttatgctggaatgcttcaatatgatggtgagttgaagcttccaggccgctaccttgtttctccccccgagattgacagaacatccggcgaatatttggtgcacaatggtgtacgtacttttgcgtgcagtgagacagttaaatttggccatgtcacattcttctggaatggaaatcgctccggctatttcaaccctgaaatggaagaatatgtggaaatcccaagtgacgttggcattacattcaatgttcaaccgaaaatgaaggcactggagattggtgaaaaggctagggatgcaattctgagccgcaaattcgaccaggtgcgtgtgaacattccgaatggtgatatggttggtcatactggagatatccaggctactgttgtggcatgcaaggccgctgatgaagctgtcaagatgatcattgatgccatagagcaagttggtggaatatatgttgtgaccgctgaccatggcaatgctgaggacatggtgaagaggaataagtccgggcaacctctttatgacaagagtggcaagctccaaatcctcacttcccacacttgtcagcctgtgcctattgcaatcggaggtccaggattggcagcaggcgttagattcaggaatgatgttccggatggcggacttgcgaatgtggctgcaactgtcatgaacctccatggttatgtagctccaaatgactatgagccaacactcattgaagtagtgaacaattaggcatatgttgcagtcgctgaatgggctaaacgagtttagaataaggatatatttggttccaaaaataggttgtattttggtagacatatgtggttttgagtatatttccccaatgtgttgggaaaatttttgggcttcattgcgccgattttaagaaaaccggatcgaatgttgaaatgatttgcactatgaggtctttttatgattgttcgaaatttttaatgcccaaagcttggattattttcgtcaaccatttctcgttgccccttctctattctttatttttcgttcgcatgtacttctatactcttaacatattattaaatttaaattaagatt

SEQ ID NO: 5277 - DNA, 1871 bp, Helianthus annuus
aacgagatctgagactgagaaaacgatggggagcacaggattttcatggaaactggcggatcatccaaagctaccgaaaggaaagctgctcgccatgattgttcttgacggttggggtgaagcttctcccgataagttcaactgcattcatgttgctgaaactcctactatggattctctcaaaaacggcgcccctgataaatggaggttggtgagggctcatggtactgctgttgggcttcccaccgaggacgacatgggaaacagtgaagttggacataatgctcttggtgctggaagaatctttgctcaaggtgcaaaacttgttgatcttgctcttgcctccggaaaaatttatgaagatgaaggctttaattacatcaaggaatgttttgcaaccaacaccttgcaccttatcggactgatgagtgatgggggtgtgcactcacgtcttgatcagttgcagctgttgctaaggggagctagccagcatggcgctaagaggatccgtgttcatgtgcttactgatggtcgtgatgttttagatggttcaagtgttggttttgctgagacacttgaagcagaactttcagatctccgcagcaaaggcattgatgcacaggtggcatctggtggagggcgtatgtatgtcaccatggaccgttatgagaatgattgggaagttgtgaaacgtggttgggatgctcaggttctcggtgaagccccacacaaatttaagaacgttgttgaggctatcaagacacttagagaggcacccggtgctaacgaccagtacttgcccccatttgtcatagttgatgatagtggaaaggctgtgggccctgttgtggacggtgatgccgttgtgactttcaatttccgtgcagatcgtatgactatgcttgctcaagctcttgaatatgagaagtttgataaattcgacagagtgcggttcccgaagattcgttatgctggcatgcttcagtatgatggggaactcaagcttccaaatcattaccttgtatctcctccattgattgagaggacttctggcgagtatttggtgaaaaatggggtccggacatttgcttgcagtgagactgtcaaattcggtcatgtcacatttttctggaatggaaaccgttctggatatttcaattcagagttggaagaatatgttgaaattccaagtgacagtggaattacctttaatgttcaacccaagatgaaagctttggagatcggtgagaaggcccgtgatgctatcctcagtggaaagtttgaccaggtacgtgtgaacattccaaatggagacatggttgggcatactggtgatgttgaggctactgttgtggcctgcaaggctgctgatgaagctgttaagatgattcttgatgcggtagagcaagtgggtggaatatatgtggtgactgcagatcatggtaatgctgaagacatggttaaaagaaacaagaagggcgagcctcttctcaaagacggcgaggttcagattttaacatcacacacccttcagccggtgccaattgcaattggtgggcccgggttagcagcaggtgtgaagttccgcaaggatgtgccaagtggggggctcgcaaatgtggctgcgactgtgatgaatttgcatgggtttgtagcacctgatgactacgagactactcttattgaagttgttgattgagcatggaaggtgattttgacatttctttgaccccatatttaaataatttcccggaaacagtaaacatatgacaatatgttttgttacaatttccagttttggctatatgagtggggtttagctagctttatatttgagcaaactcatggttgtaaaagtaatggttgatttg

SEQ ID NO: 5278 - DNA, 1700 bp, Flaveria ramosissima
tgtgacggagaaagcgatggggagcaccggattctcatggaaactggcggatcatccgaagctaccgaagggaaagctggtggcgatggttgttttggacggttggggtgaagcttctcccgataagttcaactgcatccatgttgctgaaactcctaccatggattctctaaaaaacggcgctcctgataaatggaggctggtgagggctcatggcactgctgttggacttcctactgaggatgacatgggtaacagtgaagttggacataacgctcttggtgctggaaggatctttgctcaaggggcaaaactcgtcgatcttgctcttgcctctggaaaaatattcgaagatgaaggttttaattacatcaaggaatgttttgcaaccaacactttgcaccttattgggttaatgagtgatggaggtgtgcactctcgacttgatcaattgcagttgttgcttagaggagctagccagcatggcgccaagaggatacgtgtacatgtgcttactgatggtcgtgatgttttagatggttcaagtgttggttttgctgaaatacttgaagcagaactttcagaacttcgcagtaaaggcattgatgcacaggtggcatctggtggagggcgtatgtatgtcaccatggaccgttatgagaatgattgggaagttgtgaaacgtggttgggatgctcaggttcttggtgaagccccacacaaatttaagaatgttgttgaggctatcaagacacttagagaggctcctggtgctaatgaccagtacttgcccccatttgtcatagttgatgatagtggaaaggctgtgggtccaattgtggatggtgatgctgttgtgactttcaatttccgtgcagatcgtatgactatgcttgctcaagctcttgaatacgagaagtttgataaatttgacagagtgcgggtcccaaaaatccgttatgctggcatgcttcagtatgatggggagctcaagcttccaagtcattaccttgtatctcctccattaatagataggacttctggtgaatatttggtgcacaacggggtccgtacttttgcttgcagtgagactgtcaaatttggtcatgtcacatttttctggaatggaaaccgttctggatatttcaattcagagttggaagaatatgttgaaattccaagtgatactggaattacctttaacgtccaacccaagatgaaagctttggagattggtgagaaagcccgagatgctatcctcagtggaaagtttgaccaggtacgtgtgaacataccaaatggagacatggttgggcatacgggcgatgttgaggctactgttgtggcctgcaaagcagctgatgaagctgtcaagatgattcttgatgccgtagaacaagtgggtggaatatatgttgtgactgcagatcatggtaatgctgaagacatggtgaaaagaaacaagaagggtgagcctcttctcaaagatggtgaagttcagatcctaacatcacacacccttcagccggtgccaattgcaattggcggaccggggttagcagcgggcgtgagattccgcaaggatgtgccaagtggcgggctcgcgaatgtagctgcaactgtgatgaatctgcatgggtttgtagctcctgatgactacgagacaactctcattgaagtcgttgattaagtattgaatg

SEQ ID NO: 5279 - DNA, 2045 bp, Lactuca sativa
cgcgggggcagacatctacctactctttcgcttcattatcgaacccaaacgaagatctagagagaaaagactgagattgaaagacagcgagagatggggagcactggattttcatggaaattggccgatcacccgaagctaccaaaggggaagctggtagccatgattgttttggatggatggggtgaagcttctcccgataagttcaactgcatccatgtagcagaaaccccaaccatggattctctaaaaaacggtgcccctgataaatggagattggtgagggctcatggtactgctgtaggacttcccactgaagatgacatgggaaacagtgaagtcggacataatgctcttggtgctggaagaatctatgcccaaggtgcaaaactcgtggatgcagctcttgaatctggaaaaatttatgaagatgaaggtttcaactacatcaaggaatcttttgcaaacaacaccttgcatcttattggactaatgagtgatgggggtgtgcattcacgccttgatcaagtacagttgttgctcaaaggagccagtgaacgtggtgccaagaagattcgtctccatgtgctcactgatgggcgtgatgttcttgatggatcaagtatcggttttgctgaaacacttgaaaaagaactttcagacttacgcaaaaaaggcattgatgcacaagttgcttctggtgggggccgcatgtatgtcaccatggatcgttatgagaatgattgggaagttgtgaaaaggggatgggatgcacaggttcttggtgaagctccacacaagtttaagaatgtagttgaagctgtaaagacactaagacaagttcctggttctaatgaccaatacttacctccatttgtgattgttgatgaaagtggaagccctgtgggccccattgttgacggggatgctgttgtcaccttcaacttccgtgcagatcgtatgaccatgcttgcacaagctcttgaatatgaaaagtttgataaatttgacagagtgcgggtcccgaaaatcagatatgcaggtatgcttcagtatgatggagaattgaagcttccaaattactaccttgtatctcctccattgatcgataggacatctggcgaatacttggttcataatggggtccgcactttcgcttgcagtgagacagtgaaatttggacatgtgacatttttctggaatggaaaccggtctggatatttcaatgctgagctggaggaatatgttgagattccaagtgatagtggaattacttttaatgttcaaccaaagatgaaagctttggagattggtgaaaaggcacgtgatgctatccttagtggaagattcgatcaggtgcgtgtgaacataccaaatggtgacatggttgggcatactggtgatgttgaggctactgttgtagcatgtaaggctgctgatgaagctgttaagatgatattggatgcagtagagcaagtaggtggaatatttgtggtgactgctgatcatggtaatgctgaggacatggtgaagagaaacaaaaagggagagcctgctcttgataaagaaggaaatgttcaaattttaacctctcacactcttcagcctgtgccaattgcgattggaggacctgggttagcagagggggtgaagttcaggaaggacgtgccgagtggaggattagcgaatgttgcagcaacagtgatgaatcttcatgggtttgtggctcctgatgattatgagacaactcttattgaagttgttgattgattgagtaattaaagtggtaaagatgaaaaaaggtgattttggagtttggaacattttcgtttgaataatttgatggaaacagtaaaaatgtaaaacatatgacaccaatatgtttagttaccattttccgattttggtcgcatcaccacggttgagtcagtgggttttacttttacttttacttttacttttagccttaggcttttttatgtttatgcaacaaaatgatactggtaaaacgaacggtttgtttgatttaaaagtaaaagttgtgg

SEQ ID NO: 5280 - DNA, 2431 bp, Lactuca sativa
atcgccgcagacatctacctactctttcgcttcattatcgaacccaaacgaagatctagagagaaaagactgagattgaaagacagcgagagatggggagcactggattttcatggaaattggccgatcacccgaagctaccaaaggggaagctggtagccatgattgttttggatggatggggtgaagcttctcccgataagttcaactgcatccatgtagcagaaaccccaaccatggattctctaaaaaacggtgcccctgataaatggagattggtgagggctcatggtactgctgtaggacttcccactgaagatgacatgggaaacagtgaagtcggacataatgctcttggtgctggaagaatctatgcccaaggtgcaaaactcgtggatgcagctcttgaatctggaaaaatttatgaagatgaaggtttcaactacatcaaggaatcttttgcaaacaacaccttgcatcttattggactaatgagtgatgggggtgtgcattcacgccttgatcaagtacagttgttgctcaaaggagccagtgaacgtggtgccaagaagattcgtctccatgtgctcactgatgggcgtgatgttcttgatggatcaagtatcggttttgctgaaacactagaaaaagaactttcagacttacgcaaaaaaggcattgatgcacaagttgcttctggtgggggccgcatgtatgtcaccatggatcgttatgagaatgattgggaagttgtgaaaaggggatgggatgcacaggttcttggtgaagctccacacaagtttaagaatgtagttgaagctgtaaagacactaagacaagttcctggttctaatgaccaatacttacctccatttgtgattgttgatgaaagtggaagccctgtgggccccattgttgacggggatgctgttgtcaccttcaacttccgtgcagatcgtatgaccatgcttgcacaagctcttgaatatgaaaagtttgataaatttgacagagtgcgggtcccgaaaatcagatatgcaggtatgcttcagtatgatggagaattgaagcttccaaattactaccttgtatctcctccattgatcgataggacatctggcgaatacttggttcataatggggtccgcactttcgcttgcagtgagacagtgaaatttggacatgtgacatttttctggaatggaaaccggtctggatatttcaatgctgagctggaggaatatgttgagattccaagtgatagtggaattacttttaatgttcaaccaaagatgaaagctttggagattggtgaaaaggcacgtgatgctatccttagtggaagattcgatcaggtgcgtgtgaacataccaaatggtgacatggttgggcatactggtgatgttgaggctactgttgtagcatgtaaggctgctgatgaagctgttaagatgatattggatgcagtagagcaagtaggtggaatatttgtggtgactgctgatcatggtaatgctgaggacatggtgaagagaaacaaaaagggagagcctgctcttgataaagaaggaaatgttcaaattttaacctctcacactcttcagcctgtgccaattgcgattggaggacctgggttagcagagggggtgaagttcaggaaggacgtgccgagtggaggattagcgaatgttgcagcaacagtgatgaatcttcatgggtttgtggctcctgatgattatgagacaactcttattgaagttgttgattgattgagtaattaaagtggtaaagatgaaaaaaggtgattttggagtttggaacattttcgtttgaataatttgatggaaacagtaaaaatgtaaaacatatgacaccaatatgtttagttaccattttccgattttggtcgcatcaccacggttgagtcagtgggttttacttttacttttacttttacttttagccttaggcttttttatgtttatgcaacaaaatgatactggtaaaacgaacggtttgtttgatttaaaagtaaaagttgtggttacatagttgtttttttttgcattatgggttttaaaatattctgtcaagttgttgttcttgcttatatttttttggtaattttgtttgacgcaagccttagatccattttgttctgtatttgttattggtttgttgacaatcatcgttgggtggcattgaagtgttggatttcatttgatgaacaaaatgctgttcagccaaacacctcattctgaatatgttcctttcactctcacttgaagcatatccttcagctgtggaatttgaagagtgtatacggtatactcaacacattgtgtgactggtaatagaagaccatgtcattttggaaaatgtcagtaggaacacaagtggaacttgttcgcctatggaatcacgttctttt

SEQ ID NO: 5281 - DNA, 1892 bp, Sequoia sempervirens
ggaatggccagcatggattggaagttagcagatcattcaaagcttggcaaggggaagcccttggctgtcattattttggacggatggggcgaagagaagcccgatcaatacaactgcattcatgttgcggagacacctacaatggattcgctcaagaagggagctccggagaaatggacgctggtcaaagcacatggacctgcagttggacttcctacagaagatgacatgggcaacagtgaagtggggcacaatgctcttggagctgggaggatatttgctcaaggggctaaactagtagattatgctcttgaatcgggaaaactctacaatggggaagggttcaagtacatcaaggaatgctttgaaacaggcacacttcatttcattggccttttgagtgatggcggtgttcattcacgactagatcagttgcagttgcttttgaaagggtctgccaggaatggtgccaaaagaatccgggtgcatatcctcactgatggtcgtgattgtcttgatggatctagtgttggttttgttgagacattagagaaagatcttgctgagttatgtaaagagggtgttgatgcacagattgcctctggtggtggtcgcatgtatgtcacaatggatcgttatgagaatgattggggtgtagtcaagcgaggctgggatgcacaggttttgggagaggcaccctataaattcaagagtgcagtagaagcagtcaaaaaactcagagaagagcctaaggctagtgatcaatacctgcctccctttgttatagttgatgaaaataataaagcagttgggcccattcttgatggagatgcagtagtaaccatcaattttcgagcagatcgtatggttatggttgctaaagcatttgaatatgaaaatttcgacatgtttgatcgagttcgataccccaaagttcattatgcaggaatgcttcagtatgatggagaattaaagcttccaagtcattatcttgtaaacccaccagatattgacagaacatctggagaatatttagtccataatggtgtacgaacatttgtatgcagtgaaactgtaaagtttggtcatgttacgtttttctggaatggtaatcggtcaggatattttaacaaggaccttgaagaatatgtagaagtaccaagtgattcagggattacattcaatgtaaagccaaagatgaaagctttagaaattgctgagaaggcaagagatgctattttgagcggcaagtttgatcaggttcgtgtaaacctacccaatggtgacatggtgggacatactggtgatattgaggcaacagttgttgcatgtaaagctgctgatgaggctgtaaagatgattcttgatgcagtagaacaagttggtggaatctaccttgttactgcagatcatggaaatgctgaggatatggtgaaaagaaacaccaaaacagggaaaccacagctggataaaaatggaaatatccaaattcttacttctcatactttatctcctgtaccaattgctattggaggtcctggactgaaggaaggagttaggttccgaaatgatttgaaacagcctgggcttgcaaatgtggcagccactatgattaatcttatgggatttgaggctcccagtgattatgaaccaacattgattgaagttgttgaaaactgatttctgattcaaaattgtgggcacaattttaataaaaaatggtcattttttgatggttcagaagacaattgctcaccaagagtatctatgttgattggattactctggtttctttttgtagctttttattgctaaaatcaaagcaattatttaagcaataagccataaagatgttttttgatgtcaattaatatgaagcgattatacatttg

SEQ ID NO: 5282 - DNA, 2335 bp, Pinus pinaster
aaatttattcaccgaaccgtcttggcacatgctggaacattcctctacccataattccaagtggagaaatctcgaccaccagcttcgtccgcggacggcctaagctaagtttttggcatcaaaatttacatacaagaaggtcaataggcggtgcagaagatttgttatactattcgtcaatatttaccacttgagttcacaatttgggtccgccggtttttgaagggcggacaccagtaaagcatattccaggatccacggtatcgatacaacgccgaaggattttgtttaaacagctccctatataaatcaacatacaaatataaacaaactacgaaagcattgaatacttctcgcttgcttcctctgcgtaatttcactgcattgctcgagcttcaaacattcagaaaatgagtagcaccaatttctcattcaagttggctgatcatcctaagcttccaaaggggaagcagttggctgtggtagttttggacggttggggcgaggaaaaaccggatcagtacaactgtattcatgttgccgagactcccgccatggattctcttaagaagggggctccagagaaatggacactgatcaaagcacatggacctgcagttggactccctactgaagatgatatgggtaacagtgaagtaggtcacaatgctctcggagctgggagaatatttgctcaaggagcaaaattagtggattacgctcttgcctctggcaaaatctatcagggagaagggtttacatacattaaggagtgctttgaaaatggcacacttcatctcattggccttttgagtgatggtggtgtccactcacgtttagatcagttgcagttgcttttgaaaggtgttccacaatatggtgcaaaaaggatccgagtgcatattctcactgatggtcgtgattgtctggatgggtcaagtattggctatgtagagacactagagaatgatcttgctgagttacggaaacaaggtgttgatgctttaattgcctctggtggaggtcgcatgtatgtgacaatggatcgctatgagaatgattggggtgtggtcaaacgaggctgggatgcccaggttttgggaaaagcaccttataaatttagaaatgctgtggaagcagtcaagaagcttcgggaagctccaaaagctagtgatcaatatttacctccatttgtcattgtcgatgaaaatgacaaggccgttggacctattcttgatggagatgcagtggtgaccattaatttccgagcagatcgtatgactatggttgctaaagcattcgaatatgagaattttagtgcatttgatcgagttcggtatcctaaaattcgatatgcaggaatgcttcagtatgatggagagttaaagcttccggctcattatcttgtttccccaccagatatcgatagaacatcaggagaatatcttgtacacaatgggatacggacatttgcatgcagtgaaactgtaaaattcggccacgttacatttttctggaacggcaaccggtccggatattttaacgaggaactggaggaatatgtggaaatcccaagtgattcaggaatcacattcaatgtccaaccaaaaatgaaggccttggaaattgctgaaagaaccagagatgccatattgagtggccgttatgatcaggttcgtgtgaatctgccaaatggtgatatggtagggcacactggcgatatagaggcaacggttgttgcgtgtaaggctgctgatgaggctgtaaagattattcttgatgcaatagaacaagttggcggcatctaccttgttacggcagatcatggaaatgccgaggatatggtgaaaagaaacaaaacaggtcaaccggcgaaggataaagatggaaaaattcaaattctgacttctcatacttgttccccagtgccaattgctataggaggtcctggacttacgaaaggagtgaggtttcgtactgatttgaaacagcccgggcttgcaaatgttgcctccaccataattaatctcttgggattcgaggctccaagtgattatgagccaactttgattgaagttgccagcaattgatctatgagtcaaatatggcaatttttggaagccaagtttagtaggtcatttcttaaatttgtcataattgttctgttgtttcagaatgcaccctgagaatagaatctagatacagtaattggttagttctgcggctttttgcgaataaatttatgttgtgagtagcatacttattcaaatgatactaatttatcaagatgcttgtgatatttcctttttaagaggaaatttaataatgctaaagg

SEQ ID NO: 5283 - DNA, 1817 bp, Helianthus annuus
actactttctgcatcattttcaaacccccaaacggagatctagaacaaaaaacggttacagctatggggagcactggattctcatggaaacttgccgatcatcctaagctaccgaagggaaagctggtggcgatgattgttctagacggttggggtgaagcttctcctgataagtacaattgcattcatgttgccgagactccgactatggattccctcaaaaacggtgcccctgataaatggagattggtgagggctcatggtactgctgttgggcttcccactgaagatgacatgggaaacagtgaagttggacataatgctcttggtgctggaaggatatatgctcaaggtgcaaagctcgtggatcttgctcttgcatctggaaaaatatatgaagatgaaggatttaattacatcaaggaatcttttgcaacaaacaccttgcaccttattggattgatgagtgacgggggtgtgcattcacgccttgatcagttacagttgttgctcaaaggagctagccagcgtggcgccaagaggattcgtgttcacgtgcttactgatgggcgtgatgttttagatggttcaagtgttggttttgctgaaatacttgaggcagaactttcagatctacgaagcaaaggcattgacgcccaggtggcttctggtggtggacgcatgtatgtcaccatggatcgttatgagaacgattgggaagttgtgaaacgtggttgggatgctcaagttcttggtgaagccccacacaagtttaagaatgttgttgaggctatcaagacacttagatcggcccctggtgctaatgaccaatacctgcccccttttgtcatagttgatgatagcggaaagtctgtgggtcccattgtggatggtgacgctgttgtcactttcaatttccgtgcagaccgtatgactatgcttgcccaagctcttgaatacgagaaattcgataagtttgaccgagtgcgggtcccaaaaatccggtatgccggtatgcttcagtatgatggggagttgaagcttccaagtcactaccttgtatctcctccactgatagaaagaacatctggcgagtatttggtacataacggggtccgcacatttgcttgcagtgaaaccgtcaaattcggtcacgtcacatttttctggaacggaaaccgttctggatatttcaatgctgagttggaagagtatgttgaaattccaagtgatagtggaattaccttcaatgttcaaccaaaaatgaaagctttggagattggtgagaaaacccgtgatgccatcctcagtggaagatttgaccaagtacgtgtgaacataccaaatggtgatatggttgggcatactggtgacgttgaggctactgttgtggcctgtaaagcagctgatgaagctgttaagatgattattgatgcagtagaacaagtgggtggaatatatgtggttactgctgatcacggtaatgcggaagacatggttaaaagaaataaaaagggtgagcctattctcaaggatggtgaggttcagatcctaacgtcacacactcttcagccggtgccaattgcaattggcgggcccgggttagcagcgggtgtgaaattccgcaaggacgtgccaagtggtgggctagcaaacgtagcagcaaccgtgatgaatctgcatgggtttgttgcacctgacgattatgagacgactcttattgaagttgttgattgattatgagtatgaaaaaggtggtttttatttttgtttgacccaataatttgacggaaatagtaaacgtatgactgttttgt

SEQ ID NO: 5284 - DNA, 1821 bp, Helianthus annuus
aacggagatctagaacaaaaaacggttacagctatggggagcactggattctcatggaaacttgccgatcatccgaagctaccgaagggaaagctggtggcgatgattgttctagacggttggggtgaagcttctcctgataagtacaattgcattcatgttgccgagactccgactatggattccctcaaaaacggtgcccctgataaatggagattggtgagggctcatggtactgctgttgggcttcccactgaagatgacatgggaaacagtgaagttggacataatgctcttggtgctggaaggatatatgctcaaggtgcaaagctcgtggatcttgctcttgcatctggaaaaatatatgaagatgaaggatttaattacatcaaggaatcttttgcaacaaacaccttgcaccttattggattgatgagtgacgggggtgtgcattcacgccttgatcagttacagttgttgctcaaaggagctagccagcgtggcgccaagaggattcgtgttcacgtgcttactgatgggcgtgatgttttagatggttcaagtgttggttttgctgaaatacttgaggcagaactttcagatctacgaagcaaaggcattgacgcccaggtggcttctggtggtggacgcatgtatgtcaccatggatcgttatgagaacgattgggaagttgtgaaacgtggttgggatgctcaagttcttggtgaagccccacacaagtttaagaatgttgttgaggctatcaagacacttagatcggcccctggtgctaatgaccagtacctgcccccttttgtcatagttgatgatagcggaaagtctgtgggtcccattgtggatggtgacgctgttgtcactttcaatttccgtgcagaccgtatgactatgcttgcccaagctcttgaatacgagaaattcgataagtttgaccgagtgcgggtcccaaaaatccggtatgccggtatgcttcagtacgatggggagttgaagcttccaagtcactaccttgtatctcctccattgatagaaagaacatctggcgagtatttggtacataacggggtccgcacatttgcttgcagtgaaaccgtcaaattcggtcacgtcacatttttctggaacggaaaccgttctggatatttcaatgctgagttggaagagtatgttgaaattccaagtgatagtggaattaccttcaatgttcaaccaaaaatgaaagctttggagattggtgagaaaacccgtgatgccatcctcagtggaagatttgaccaagtacgtgtgaacataccaaatggtgatatggttgggcatactggtgacgttgaggctactgttgtggcctgcaaagcagctgatgaagctgttaagatgattattgatgcagtagaacaagtgggtggaatatatgtggttactgctgatcacggtaatgcggaagacatggttaaaagaaataaaaagggtgagcctattctcaaggatggtgaggttcagatcctaacgtcacacactcttcagccggtgccaattgcaattggcgggcccgggttagcagcgggtgtgaaattccgcaaggacgtgccaagtggtgggctagcaaacgtagcagcaaccgtgatgaatctgcatgggtttgttgcacctgaagattatgagacgactcttattgaagttgttgattgattatgagtatgaaaaaggtggtttttatttttgtttgacccaataatttgacggaaatagtaaacatatgactgttttgttaaattttcctgaaaacatttgtttgggtttgag

SEQ ID NO: 5285 - DNA, 2138 bp, Nicotiana tabacum
ggcgcgggggatacacaccttttggtctctcttctcctctactatatcgcttcctataactcctcctctgtattaagaaaattttaagatctgagatatgggaagttcaggagatgcatggaaattgaaggaccaccctaaacttccaaagggaaagacagtagctgtgattgttttggatggttggggtgaggctaaacctaatgagtttaatgctatccatgttgctgaaactcctgttatggactccctcaagaatggtgctcctgaaaaatggagattgattaaggcacatggtaatgcagtgggactgcccacagaggatgatatgggtaacagtgaggttggtcacaatgctcttggtgctggaaggatctttgctcaaggtgcaaagcttgttgatctggcccttgcctctggtaaaatctatgagggagaaggtttcaagtacgttaaagaatgttttgaaaaaggaactttgcacctcattggactcttgagtgatgggggtgtccactccaggcttgatcaagtgcagttgttgctgaaaggtgctgctgagcatggtgccaaaagaattcgtgtccacgccctcactgatgggcgtgatgttctagatggttctagtgtgggcttcatggagactcttgagaattctcttgcacaattacgtgaaaaaggtattgatgcccaggttgcatctggtggaggtcgcatgtatgttaccatggatcgatatgagaatgactgggatgtcgttaaaagaggttgggatgctcaagttcttggtgaggctccacacaagttcaaggatcctgttgaagcagttaaaaagttgaggcaggaacccaacgccaatgaccagtacttagccccttttgttattgttgacgataatggaaagcccgttgcggctattttagacggtgatgctgttgtgactttcaacttcagagcagatcgtatggtcatgcttgcaaaggcccttgaatacgagaactttgataaatttgatcgtgtacgagtccctaaaatccgttatgctggtatgctccaatatgatggtgagttgcagcttccaagccactacctcgtttctcctccagaaattgacaggacatctggggagtatctagtgcgcaatggtgttcggacttttgcttgcagtgagactgttaaatttggtcatgtcaccttcttttggaatggaaaccgctccgggtattttaacgagaaattggaagagtacgtggaaattccaagtgacagtggaattacatttaacgttaagccaaaaatgaaggcgctggagattgctgaaaggactagagatgccatccttagcgggaaatttgaccaggtacgtgtgaacctacctaacggtgatatggttggacatactggtgatataaaagcaactattgaagcttgcaagtctgctgatgaggctgtcaagatgatccttgaagctattgaacaagttggtggaatatatctagttactgccgaccatggaaatgctgaagatatggttaagagaaataagaagggggagccagctcttgacaagaatgggaatattcagatactcacttctcacacttgcgaacctgttcctattgcaattggtggtcctggactggcacccggtgtgagattccgccaagatctccctaccggtgggcttgctaacgtcgctgcaacctttatgaatctgcatggctacgaggcaccaagcgattacgagccaagcttgattgaggttgttgacaactagatatctcagagaatttaggagggttgaaattttggcgcaagttggaaagtgataatgactacattctatactctttccagtttatttgaataagacatttttttgagcttatattaacagaagttgacattctaccacatggcctttgttaagctatgatggaagaatgcagtatactgttcatgttaaaccctgtaatctttcaaggcatctcaaagtgtcatatcatgagattaagttttcgtttggtggctaaaaattcttaatcctttactatatgtagcaagaaatgcataatctgtttcttctttttccctgtatttttccgtatgttgttgatataaattcgataaatttctgt

SEQ ID NO: 5286 - DNA, 1785 bp, Taraxacum officinale
cgggggcgcagacatctacctactctttcgctcccattatcgaacccaaacgaagatctagagaaagttttgagagtgaaagacagagaaacatgggtagcactggattttcatggaaattggccgatcatcccaagctacccaaggggaagctcgtagccatgattgttttggatggttggggtgaagcgtctcccgataagtacaactgcatccatgttgctgaaaccccaaccatggattctctaaaaaacggagcccctgatcactggagattggtgcgggctcatggtactgctgttggacttcccactgaagatgatatgggaaacagtgaagtcgggcataatgctcttggtgctggaagaatctatgcccaaggtgcaaaactcgtggacgcagctctcgaatctggaaaaatctatgaagacgaaggcttcaattacatcaaggaatcattcccaaacaacaccttacatctcatcggactaatgagtgacggaggtgtccactcacgtctcgatcaagtccagctgttgctgaaaggagcaagtgaacgtggcgccaagaagatccgccttcacgtcctcaccgatggacgtgatgttctggatggctccagcgtcggtttcgcagaaaccctagaaaaagaactttcagatctacgcaaaaaaggaatcgacgctcaagttgcctccggtggaggccgcatgtacgtcaccatggatcgctatgagaacgactgggaagtcgtgaaaaggggatgggacgcacaagtactaggtgaagccccccacaaattcaaaaacgtagtcgaggctgtaaaaaccctaagacaagcacccggttccaacgaccagtacttacccccatttgtgatagtcgacgaaagcggaacccccgtgggccccatagtcgacggggacgctgtcgtcaccttcaacttcagagcagaccgcatgaccatgctcgcacaagccctcgaatacgagaaattcgacaaatttgaccgggtccgggtccccaaaatccggtacgccggcatgctccaatatgacggtgaactaaagctcccaaaccactaccttgtatctcctccattaatcgacaggacatctggcgaatatctagtccacaatggggtccgcacttttgcttgcagtgagactgtgaagtttggtcacgtgacgtttttctggaatgggaaccggtctgggtattttaatgctgagctggaagagtacgtggagattccgagtgatagtgggattacgtttaatgttcaaccgaagatgaaggctttggagattggtgagaaggctcgtgatgctattcttagtgggagatttgaccaggtacgtgtgaatataccaaatggtgacatggttgggcatactggtgacgtggaggctactgttgtggcatgcaaagctgctgatgaagctgttaagatgattttggatgcagtaaagcaagtgggtgggatatatgtggtgacagctgaccatggtaatgctgaggatatggtgaagagaaacaaaaagggggagcctgctcttgataaggaggggaatgttcagatcttaacttcccacactcttcagccagtgccaattgctattggaggaccggggttgacagctggagtgaagttcaggaaggatgtgccaagtggagggctagcgaatgtggcagcgactgtgatgaatttgcatgggtttgtggctcctgatgactatgagaccactcttattgaggttgttgagtagatgattgatttgagta

SEQ ID NO: 5287 - DNA, 2043 bp, Podocarpus macrophillus
aggctggtacataaaggatgctgaatcgaggaaagcatactcccgtgacaagcgcaaaccctagcaatcgtgagagaggggaagatgggtttgacatggaagctggaagatcatccgaagctgccgaaggggaagcagcttgctgttgttgtgttggatggatggggcgaggagaaacccgatcaatacaattgcattcatgtcgctcccacacccaccatggactccctcaaaaagggagctccagaaagatggagacttgtcaaagcacatggacctgctgttggactccccacagaagatgatatgggtaacagcgaagtaggtcacaatgctcttggagctgggagaatacttgctcaaggggctaaactagtagatatcgctcttgaatcgggcaaaatttatgatggagaagggtttaggtatgtcaaggagtgctttgaaactggcacacttcatcttattggtcttttgagtgatggtggcgttcattcaagattggatcagttacagttacttctgaaaggatctgcgaaaatgggtgcaaaacgaattcgagtgcatatccttaccgatggtcgcgattgtcttgatgggtctagtgtcagttttgtcgagactttagagaatgatcttgctgagttatgtaaacaaggtgttgatgcacggattgcctctggtggtggtcgaatgtatgtcacaatggatcgttatgagaatgactggggagtggtcaagcgaggctgggatgcacaagttttaggtgaagcaccacataaattcaggagtgccttggaagcagtgaaaaagctcagggaagctcctaaggctagcgatcaatacctgcctccctttgttattgttgatgaaaatgaaaaagcagttggacctatagtagatggcgatgcagtagtgaccattaattatcgcgctgatcgtatggttatggttgctaaggcatttgaatatgaaaatttcagtgcatttgatcgtgttcgatttcccaaaattcattatgcaggaatgctacagtatgacggagaacttaagcttccaagtcattttcttgtttccccaccagatattgatagaacatcaggagaatattttgtccataatggtatccggacttttgcatgcagtgaaacggtgaagtttggccatgttacctttttctggaatggcaaccgttcaggatattttgatgcagatcttgaagagtatgtagaaatccctagtgattcaggaattacatttaatgtaaagcccaagatgaaagctttagaaattgctgagaaggcaagagatgctattctaagtcgaaagtttgatcaggttcgtgttaatctgcctaatggtgacatggttggacatactggtgatattgaggcgactattgttggatgcaaagttgctgatgaggcggtaaagatgattcttgatgcagtagaacaagctggtggcatctatcttgtcactgcagaccatggaaatgctgaggatatggtgaagagaaacaaaactggtcagccacagctcgataaagatggaaagcttcaaattctcacatctcatacttgttctccggtaccgattgccataggaggtcctggactgaaggaaggagtaaggttccgaaatgatttgcaacaacctgggcttgcaaacgttgcagctactatgatgaatcttttggggtttgaggctccaagtgattatgaacaaactctaattgaagttgtggataactgattttttgcatctagctagcacaaaattaataaatccgtggcatttttcatgttcaaagccatggttaagaagaaaatctcagtcacgaaatattttcaatctttgaaatggtttaatttgtagtctttttgcttagtcaaagcaatgcttatgtaagtcatcaagagacaactgaagatgacaaataaattgtctagaagactcgcttaaaagagaatgggattcaatgtaacctttttgctctatttaagtcagtaaaaaatctgaaactttcgttatttaatagct

SEQ ID NO: 5288 - DNA, 2159 bp, Picea glauca
gatcaaagctttgcatccttctcgtttgcttcctctgcttaactacattgctttgctcgagctctagccattcagaagatgggcagcaccgatttctcatttaagttggccgatcatcccaagattccaaaggggaagcagttggctgtgataattttggacggttggggcgaggagaaacctgatcagtacaactgtatttatgttgctgagactcccaccatggattctctcaagaagggggctccagagaaatggacactgatcaaagcacatggacctgcagttggactccctacagaagatgatatgggtaacagtgaagtaggtcacaatgctcttggagctgggagaatatttgctcaaggagcaaaactagtggattatgctcttgcctctggcaagatatatgagggagcagggtttaaatacataaaggaatcctttgaaaatggtactcttcatctcattggccttttgagtgatggtggtgttcactcacgattagatcagttgcagttgcttttgaaaggtgctgcacaaaatggtgcaaaaagaatccgagtgcatatcctcacagatggtcgtgattgtcttgatgggtcaagtattgggtatgtagagacactagagaatgatcttgtcgagttacagaaacagggtgttgatgcacagattgcttctggtggaggtcgcatgtatgtgacaatggaccgctatgagaatgattggggtgtggtcaaacgaggctgggatgcacaggttttgggaaaagcacctcataaatttagaagtgctttggaagcagttaaaaaacttagggaggatcccaaagctagtgatcagtacttgcctccttttgtcattgttgatgaaaatgagaaggcagttggacctattcttgacggagatgcagtggtgaccattaatttccgagcagatcgtatgactatggttgctaaagcattcgaatacgagaattttagtgcatttgaccgagttcggtatccaaaaattcgatatgcaggaatgcttcagtatgatggagagttaaagcttccatctcattatcttgtttccccaccagatatcgatagaacatcaggagaataccttgtccacaatgggatacggacatttgcatgcagtgaaactgtaaaattcggtcatgttacatttttctggaacggaaaccggtcaggatattttaacgaggaactggagacatatgtcgaaattccaagtgattcaggaatcacattcaatgtcaagccaaaaatgaaggccttggaaattgctgaaaaaacaagagatgccatattgagtggccgttatgatcaggttcgtgtgaatctgcctaatggtgacatggtagggcataccggcgatatagaggcaacagttgttgcgtgtaaggctgctgatgaggctgtaaagattattcttgatgcaatagaacaagttggtggcatctaccttgttactgcagatcatggaaatgccgaggatatggtgaaaagaaacaccaaaacaggtcaaccagcgaaggataaagatggaaaaattcaaattcttacatctcatactctctccccagtgccaattgctataggaggtcctggacttaaggaaggattgaggtttcgtagtgatttgcaacagcccggccttgcaaatgttgcctccacgataattaatctcttgggatttgaggctccaagtgattatgaaccaactttgattgaagttgccaacaattgatttatgagtcaaatatggaagcacggagtaaatcaaataatgttttaatttttggaagccaaggttagcaggtcatttcttgaatttgtcatagttgttctgttctttaagaattcaccccgagagtagatacagtaattgtgtaactctgcggcttttttggtatattaaaggtctgagcaacatacttattcaaatgataataatttatcgagatgtttgtgatatttaaattcacgatggtggatggttgaagtcctgcacatgggaatgctcctttgttgcaagaggaaatttaataaaattcaatcttaattttgtggtatgaaaaaaaaaaaaaacaaaatactctgtcgttagaactaacctactcgtctttcgtaggaagtactcgaccg

SEQ ID NO: 5289 - DNA, 2088 bp, Picea glauca
gatcaaagctttgcatccttctcgtttgcttcctctgcttaactacactgctttgctcgatctctagccattcagaagatgggcagcaccgatttctcatttaagttggccgatcatcccaagattccaaaggggaagcagttggctgtgataattttggacggttggggcgaggagaaacctgatcagtacaactgtatttatgttgctgagactcccaccatggattctctcaagaagggggctccagagaaatggacactgatcaaagcacatggacctgcagttggactccctacagaagatgatatgggtaacagtgaagtaggtcacaatgctcttggagctgggagaatatttgctcaaggagcaaaactagtggattatgctcttgcctctggcaagatatatgagggagcagggtttaaatacataaaggaatcctttgaaaatggtactcttcatctcattggccttttgagtgatggtggtgttcactcacgattagatcagttgcagttgcttttgaaaggtgctgcacaaaatggtgcaaaaagaatccgagtgcatatcctcacagatggtcgtgattgtcttgatgggtcaagtattgggtatgtagagacactagagaatgatcttgtcgagttacagaaacagggtgttgatgcacagattgcttctggtggaggtcgcatgtatgtgacaatggaccgctatgagaatgattggggtgtggtcaaacgaggctgggatgcacaggttttgggaaaagcacctcataaatttagaagtgctttggaagcagttaaaaaacttagggaggatcccaaagctagtgatcagtacttgcctccttttgtcattgttgatgaaaatgagaaggcagttggacctattcttgacggagatgcagtggtgaccattaatttccgagcagatcgtatgactatggttgctaaagcattcgaatacgagaattttagtgcatttgaccgagttcggtatccaaaaattcgatatgcaggaatgcttcagtatgatggagagttaaagcttccatctcattatcttgtttccccaccagatatcgatagaacatcaggagaataccttgtccacaatgggatacggacatttgcatgcagtgaaactgtaaaattcggtcatgttacatttttctggaacggaaaccggtcaggatattttaacgaggaactggagacatatgtcgaaattccaagtgattcaggaatcacattcaatgtcaagccaaaaatgaaggccttggaaattgctgaaaaaacaagagatgccatattgagtggccgttatgatcaggttcgtgtgaatctgcctaatggtgacatggtagggcataccggcgatatagaggcaacagttgttgcgtgtaaggctgctgatgaggctgtaaagattattcttgatgcaatagaacaagttggtggcatctaccttgttactgcagatcatggaaatgccgaggatatggtgaaaagaaactccaaaacaggtcaaccagcgaaggataaagatggaaaaattcaaattcttacatctcatactctctccccagtgccaattgctataggaggtcctggacttaaggaaggattgaggtttcgtagtgatttgcaacagcccggccttgcaaatgttgcctccacgataattaatctcttgggatttgaggctccaagtgattatgaaccaactttgattgaagttgccaacaattgatttatgagtcaaatatggaagcacggagtaaatcaaataatgttttaatttttggaagccaaggttagcaggtcatttcttgaatttgtcatagttgttctgttctttaagaattcaccccgagagtagatacagtaattgtgtaactctgcggcttttttggtatattaaaggtctgagcaacatacttattcaaatgataataatttatcgagatgtttgtgatatttaaattcacgatggtggatggttgaagtcctgcacatgggaatgctcctttgttgcaagaggaaatttaataaaattcaatcttaattttgtggtata

SEQ ID NO: 5290 - DNA, 2347 bp, Taxus baccata
gggttgttctctgtgagaaaactggaggggttctgacacggacgaagacagcaatggccgagatcgtttggtcgacgatatacggacaatcgcgagccgcacaacgtaggacggtacgtggaaaaaatttgcatcggttgagtgtggaaaaattcgtctgcatcgatttctcattgggattatgatttggtttatcggcaactcgaaagcttacaaacgccacgatccaagccaaagcagcggcgtaaaaatcgcatcgtaagaagcggcgcagatccattcccgcctcgctggagcaaaattgggccgttccgtcggggcactcctttccgccagaagtcgcgggaaggtgtatatatatgatagaatacacagaccacataaaccagaaaaacaatagtttgactgatttctttggaggcttagaaattcacggaacatgggcagcatagattggaagttggctgatcatccgaagcttccaaaggggaagcagttggctgtgattatcttggacggatggggagaagagaagcctgatcagtacaattgcattcatgttgccgacacacctaccatggattccctcaagcagggggctccagagaaatggacactggtcaaagctcacggacccgcagttggactccctacagaagatgacatgggaaacagtgaagtgggccacaatgctcttggagctggtagaatatttgctcaaggagcgaaattagtagaccgggctcttgaatcaggcaaaatttatgatggtgaagggttcaagtacatcaaagaatgcttcgaaacaggcacacttcatttcattggccttttgagtgatggtggtgttcattcacgattggatcagttgcagttgcttttgaaaggttctgccaagaatggtgccaaaagaatcagagtgcatatcctcactgatgggcgtgattgtcttgatgggtctagtattggttttgttgagacattagagaaagatcttgaagagttacgtaaacagggtattgatgcacgtattgcctctggtggtggtcgcatgaatgttacgatggatcgttatgagaatgattggggtgtggtcaagcgaggctgggatgcacatgttttgggagaggcaccctataaattcaaaggtgctgtggaagcagtcaaaaaactcagggagggtcctaaggcgtctgatcagtacctgcctccctttgtcatagttgatgaaaatgacaagcctgttggacccattcttgatggagatgcagttgtaaccttcaattttcgagcggatcgtatggttatgattgccaaagcactagaatatgaaaatttcagcatgtttgatcgagttagataccccaaaattcattatgcaggaatgcttcagtatgatggagaattaaagcttccaagccattatcttgttgtcccaccagatattgatagaacatcaggagaatttttggtccataatggtgtccgaacatttgcttgcagtgaaactgtaaagtttggtcatgttacatttttttggaatggcaaccggtcaggatattttaataaggaccttgaagaatatgtcgaaattccaagtgattcagggattacattcaatgaaaagccaaagatgaaagctttagaaattgctgagaaggcaagagatgctattttaagtggcaagtttgatcaggttcgtgtaaatctacctaacggcgacatggttggacacactggcgatatcgaagcaacagttgttgcatgtaaatctgctgatgaggccgtaaagatgattcttgatgcagtagaacaagctggtggcatctatcttgttactgcagatcatggaaatgctgaggatatggtgaaaagaaacaccaaaacaggaaagccacagctggataaagatggaaaaatccaaattcttacttcacatactttatctccggttccaattgccataggaggtcctggactgaaggaaggagtaaggttccgaaatgatttgaaacagcctgggcttgcaaatgtggcagccaccatgatgaatcttttgggattcgaggctcccagtgattatgagccaacattgattgaagttgtggacaactgaatcaaacctgtatgagacaggactaataaaaaagtaattttttgatggttgggaagacaattgctaaccaagagtatctacattgattggatagctctggtttctttttgtaaacttttattacaaaagtcaaagcaatgcttatttaaataataatgtcatcaagatattgtctattatgtcaattaagattgaagtttaagttgaagagaatatgtatgttaaaatgtg

SEQ ID NO: 5291 - DNA, 2129 bp, Solanum lycopersicum
ttctttgaatatcaacaagtgtaggcctccggtatttcagccctccattccaataaagacccctccttcactcctccattgttttctccactacacacctttttgctctcttctctcttctctcttctataccgcttaagaatttttaagatctgagataatgggtagttcaggagatgcatggaaattgaaggaccatcctaagcttcctaagggaaagactgttgctgttattgttttggatggttggggtgaggctaaacctaatgagtataacgctatctctgttgctgaaactcctgttatggactcactcaagaagggtgctcctgaacattggagattgattaaggcacatggaaatgctgtggggcttcccacagaggatgatatgggtaacagtgaagttggtcacaatgctcttggggctggaaggatctttgctcaaggtgcaaagcttgttgacctagcccttgcctctgggaaaatctatgatggagaaggtttcaaatacgttcaagaatgttttgagaaaggaactctgcaccttattggtctcgtgagtgatgggggtgtccactccaggcttgaccaattgctgttgctactgaaaggtgctgctgagcgtggtgccaaaagaattcgtgtccatgccctcaccgatggacgtgatgttctggatggttctagtgtgggcttcatggagaccctcgagaatgatctagcaaaattacgtggacaaggtgttgatgcccgggttgcatctggtggaggtcgcatgtatgttaccatggatcgttatgagaatgactgggatgtcgtaaaaagaggttgggatgcacaagttcttggtgaggctccacaccatttcaaggatcccgttgaggcaattaagaagttgaggcaggaacccaatgccaatgatcaatacttagccccttttgttattgttgatgataatggaaagcctgttggtcctattttggatggtgatgctgttgtgactttcaacttcagagcagatcgtatggtcatgcttgcaaaggcccttgaatatgagaatttcgataaatttgatcgtgtacgagtccctaaaatccattatgctggtatgctccaatatgacggtgaattgaagcttccaagcaaataccttgtttctcctccagagattgacaggacatctggggagtatctagtgcgcaatggtattcggacttttgcttgcagcgagaccgttaaatttggtcatgtcaccttcttttggaatggaaaccgttctgggtattttgacgagaaattggaagagtatgtggaaattccaagtgacagtgggattacatttaatgttaagccaaaaatgaaggcactggagattgctgaaagggctagggaggccatccttagccacaaatttgaccaggtacgtgtgaacttacctaacagtgatatggtgggccatactggtgacatcaaagcaacaattgaagcttgcaaggctgccgatgatggtgtcaagatgatccttgatgctattgagcaagtgggtggaattttccttgttactgctgaccatggaaatgctgaagatatggttaagagaaacaagaagggagagccattacttgacaaaaatggaaacattcagattctcacttctcacactctcgaacctgttcctattgcaattggtggtcctggacttgtacctggtgtgagattccgcacagatctccccaccggtggacttgcaaatgttgcttcaacctttatgaatctgcacggatacgaggcgcctagcgattacgagccaaccttgatcgaggttgtggacaactagataatctcatagaccttagggttgaagttttggcgcaagaagaaagcgataatgaccattctacactttgtttatttgaataagacatttttgagcttatatcaacagaggttgacattctaccacgtggcctgtaatgatgctatgatggaagagtgtgatatactactgttcattttaaaccctgttgtctttcaaggcataacttcgagtttttgttttttggtgaacaagaattcttaatctttcactatttgtggcagaaatatattagttgtttgatgctcta

SEQ ID NO: 5292 - DNA, 1782 bp, Carthamus tinctorius
  misc_feature (1496)..(1496): n is a, c, g, or t
  misc_feature (1596)..(1596): n is a, c, g, or t
ccatccacctaaccttttttttcctccattttcgcaccctcgacggagatctagagaaggcatcgagaaacatgggaagcactggattttcatggaaattggccgatcatcccaagcttcccaagggaaagcttgtcgccatgatcgttttggatggctggggtgaagcttctcctgacaagtataactgtatccatgtcgctgagactccaaccatggattctctcaaaaacggcgctcctgaaaaatggagattggtgagagctcatggtactgcggtcggacttcccactgaagatgacatgggaaacagtgaagttggacataatgctcttggtgctggaagaatctttgctcaaggtgcaaaacttgttgatcttgcgcttgcctctggaaaaatatatgaagatgaaggtttcaattacatcaaggaatcttttgcgaataacaccttgcaccttattggattgatgagtgatgggggtgtccactcacgccttgatcagttacagttgttgctcaggggagccagcgaacgcggtgccaagaagatacgtgttcatgtgcttactgatggccgtgatgttttggatggttcaagtatcggttttgctgaaacactggaagcagaactctcagatttgcgcagcaaaggtattgatgcacaggttgcttctggtggtgggcgcatgtatgtcaccatggatcgttatgagaatgattgggaagttgtgaaacgtggttgggatgcccaggttcttggcgaagccccacacaaatttaagaatgttgttgaggctgtcaagaaactgagggaggctcctggtgctaatgaccaatacttgcccccatttgtcattgctgatgagagtggaaagcctgtgggtcccattgtggatggtgatgccgtcgtcactttcaacttccgagcagatcgtatgacaatgcttgcccaagctcttgagtatgagaagttcgataaatttgacagagtgcgtgtccctaagattcgctatgctggtatgcttcagtatgatggggagttgaagcttccaaaccactaccttgtatctcctccattgatagagaggacatctggtgaatatttagtgcataacggggttcgcactttcgcttgcagtgagactgtcaaatttggtcatgtcacatttttctggaacggaaaccgctctggatatttcaattcggagttggaagaatatgtggaaattcccagcgatagtggaattaccttcaacgaacaaccaaagatgaaagctctggagattggtgagaaaacccgtgatgctatcctcagcggaaaatttgaccaggtacgtgtgaacataccaaatggtgacatggttgggcatactggtgatgttgaagcgactgttgtggcctgcaaggctgccgatgaagctgtaaagatgattcttgatgcagtagagcaagttggtggaatatatgtggtgactgcagatcatggtaatgcngaggacatggtaaagagaaacaagaagggagagcctattctcaaggatggcaagttcagatcctaacatcgcacactcttcagccggtgccgattgcaantggaggtccgggattaacagcaggtgctagattccgtaaggatgttccaagtggaggacttgcaaacgtagcagcaacggtgatgaatctgcatgggtttgtggctcctgatgactatgaaacgactctaattgaagttgttgattgaggagttagttggtctttgaaggtgaaagaatgaaactt

SEQ ID NO: 5293 - DNA, 1930 bp, Eutrema halophilum
cttgtccttccctctctctcacttttttctcagatctgtttttgacatttttctcgattgcatctcaaaatctcagctatggctacctcctcagcttggaagctcgatgaccatcccaagctccctaagggcaaaaccatcgccttaatcgtcttggatggttggggtgaatctgctcctgatcagtacaactgcatccacaacgctcccactcccgccatggattctctcaaaaacggagctcctgatacttggacgttgatcaaagctcatggtactgccgttggactacccagcgaagatgatatgggaaacagtgaggtcggtcacaatgctctcggtgctggtcgtatttacgctcaaggtgctaagctttgtgacatagctcttgcttccggcaaaatcttcgacggtgaaggtttcaaatacgtttctgaatctttcgagaaatctactttacacttcgttggacttctcagtgacggtggagtccactcccgtctcgatcagctccagttgctgattaagggatctgctgaacgtggtgctaagagaatccgtgtccatattctcactgatggtcgtgatgttttggatggttcaagtgtcgggtttgtggaaactcttgaagccgacctcgctgaattacgcgagaatggtgtggatgctcagattgcatctggtggtggtcgtatgtatgtgactttggacagatatgagaacgattgggaagttgtgaaacgaggttgggatgctcaggttctcggagaagctccccacaagttcaaaaacgccgttgaagcagtgaagacattgaggaaggagcctggtgcaaatgaccagtatttgccaccgtttgtcatcgttgatgatgcagggaaagccgttggtccgattgtggacggtgatgctgttgtcactttcaatttcagggctgatcgtatggttatgcatgccaaggcactcgaatatgaagattttgacaagtttgatcgtgtgaggtttcccaagatccgttacgctggaatgcttcagtatgatggagagctaaagctgcctagccgttaccttgtttctcccccggagattgatagaacctctggtgaatatttggctcacaatggcgtccgtacttttgcttgcagtgagaccgtcaagtttggtcatgtcacattcttctggaatggaaaccgatctggatatttcaacgagaaattggagcagtatgttgaaatcccaagtgacagtggaatttcattcaatgtccaaccaaagatgaaagctctggaaattggtgagaaggcgagggacgcaatcctcagtggcaagtttgatcaggtgcgagttaacctgccaaatggagatatggtgggtcatacaggtgacattgaagctacggttgttgcatgcgaggctgctgataaagctgtgaagatgatccttgatgcgatcgaacaagtgaaaggcatttacgttgtgactgctgatcacggaaatgcagaggacatggtgaagagggataagtctgggaagcctgctttggataaggaagggaagcttcagattctaacctctcacactctcaagcctgtgccaattgccattggaggtccaggattgtctgaaggagtgagattccgtaaggatttggagacaccaggacttgcgaatgtagctgcaacagtgatgaacctccatggatttgtggctccctctgactacgagcccaccctaattgaagttgtggacaagaattgagagcctaatttgtttgaagagagggctgaaacgctataattgtgttatgttgttttcaatttaataagggtttacacacacgcagacttgtatttttggttttggcattcggccaaaaacgttgattttggtttaaatgagattgaagtttagtttttctctttctcttcca

SEQ ID NO: 5294 - DNA, 1890 bp, Chelidonium majus
ttttggatggatggggtgaagccgatgaagataagtataactgtatccatgttgctcaaacacccaccatggattcccttaaaaagggtgctccggagcattggagattggtaagagctcatggtaaggcagttgggctcccaactgaagatgacatgggtaacagtgaagttggtcataatgcacttggtgctggaaggattttcgctcagggtgccaagcttgttgaccttgcccttgcctcaggaaaactatatgatggagaaggctttaaatacatcaaagaatcttttgataatggcacacttcacctaattgggttattgagtgatgggggtgtccactccaggcttgatcaagtacagttgctattaaaaggagtcagcgagaggggtgccaaaagaatccgtcttcatattcttactgatggtcgtgacgttttggatggttcaagtgtaggttttgtcgaaactcttgaaaatgacctcgtggagttgcgaaagaagggcattgatgcacaaattgcatctggtggaggtcgcatgtatgtcacaatggatcgctacgagaacgactggagtgtcgtaaaacgaggatgggatgcccaagttcttggtgaggcaccttacaagtttaagagtgcagtagaagctgtcaagacactgagggcggaaccaaaggccaatgaccaatacttgcctccgtttgttatagttgatgacagtgggaaggcggtaggcccaatagtggacggcgatgctgttgtaacatttaactttcgagcagatcgtatgactatgcttgctaaggcacttgagtatgaggacttcaagaattttgatcgtgttcgattcccaaagattcggtatgctggtatgctccagtatgatggtgagttgttgcttcccaagaagtaccttgtttcacctccagagatagagagaacatcgggtgaatacttagtgcacaatggcgtccgtacttttgcatgcagtgagactgtcaagtttggacatgtcaccttcttctggaatgggaatcggtctggatatttcaaggaagatatggaggaatacgtagaaattccaagtgatagcggaattacattcaatgaacagccattaatgaaggccttggaaattggtgagaaagcaagggatgctattctcagcggcaagtgggaccaggtccgtgtcaacatacctaatggtgacatggtaggacatacaggtgacatagaggcgactgttgtggcttgcaaggctgctgatgaagctgtaaagatgatccttgatgcaattgagcaagtgggtggaatttatgttgttactgccgaccatggtaatgccgaggatatggtgaagaggaacaagaaaggggaaccacttcttgataaagaaggcaaaattcaaatcctcacttctcacacccttcaacccgtcccgatcgcaattggtggacctggtctggctccaggggtcagattccgtaaggatgttccagaaggtgggctcgccaatgtagctgcaacagtgatgaatctccatggatacgtggcaccaagtgactatgagacgactctcattgaggttgttgacaactagagtaaagtccgataggctcgggagttcgccatgaagtaggaaagagaaagagagagtaacatcaagtacttttatttttgcttgatattattattatggcgctcaactaatcacgcatttatgagtgtgtgaagcggtatttatcatcacaattttaaaaataggttttttttgtttgcttgttttgaatccctcatgtgagaaggatgatggatttgtcaatttaaactcataaacttcagggttccctataaaataagattttgcttaagaatgaatggtttat

SEQ ID NO: 5295 - DNA, 2016 bp, Cirsium arvense
cggggggtgcaaaccacataccaccaccatccacctaacctttctttccaccattttcgcacacttgacggagatctagagaaggcatcgagagagaaaaacatgggaagcactggattttcatggaagttggccgatcatccgaagcttcccaagggaaagcttgtcgccatgatcgttttggatggctggggtgaagcttcacctgacaagtataactgtatccatgttgccgagactccaaccatggattctctcaaaaacggagctcctgagaaatggagattggtgagagctcatggtactgcggttggacttccaactgaagatgatatgggaaacagtgaagttggacataatgctcttggtgctggaagaatctttgctcaaggtgcaaaacttgttgatcttgcacttgcctctggaaaaatatttgaagatgaaggtttcaattacatcaaggaatcttttgcaaataacaccttgcaccttattggattgatgagtgatgggggtgtgcactcacgccttgatcagttacagttgttgctcaggggagccagcgaacgtggtgccaagaagatacgtgttcatgtgcttactgatggccgcgatgttttggatggttcaagtatcggttttgctgaatcgcttgaagcagaactctcagatttgcgcagcaaaggtatcgatgcacaggttgcttccggtggtgggcgcatgtatgtcaccatggatcgttatgagaatgattgggaagttgtgaaacgtggttgggatgcccaggttcttggtgaagccccacacaaatttaagaatgttgttgaggccgtcaagaaactgagggaggctcctggtgctaatgaccaatacttgcccccatttgtcattgctgatgagagtggaaagcctgtgggtcccattgtggatggtgatgctgttgtcactttcaacttccgagcagatcgtatgactatgcttgcccaagctcttgagtatgagaagtttgacaaatttgacagagtgcgtgtccctaagatccgctatgcgggtatgcttcagtatgatggggagttgaagcttccaaaccactacctagtatctcctccattgatcgagaggacatctggtgaatatttagtgcataatggggttcgcactttcgcttgcagtgagactgtcaaattcggtcatgttacatttttctggaacggaaaccgctctgggtatttcaattcggaattggaagaatatgttgaaattccaagtgatagtggaattaccttcaacgaacaaccaaagatgaaagctttggagattggtgagaaaacccgtgatgctatccttagtggaaaatttgaccaggtacgtgtgaacataccaaatggtgacatggttgggcatactggtgatgtagaagcgactgttgtggcctgcaaggctgctgatgaagctgttaagatgattcttgatgcagtagagcaagttggtggaatatatgtggtgactgcagatcatggtaatgctgaggacatggttaagagaaacaagaagggagagcctattctcaaggatggcaaggttcagatcctaacatcacacactcttcagccggtgccgattgcaattggaggtccgggattaacagcaggtgctagattccgtaaggatgttccaagtggaggacttgcaaacgtagcagcaaccgtgatgaatctgcatgggtttgtggctccggatgactacgagacgactctaattgaagttgtcgattaaggagttggttagttttgtttgaagatgaatgaaagaaagaaacttttgattttgaataatttgaaggaaaacagatagctactagtttgctttttccaattttggtcagtaatgttgctgctttatattttatatgcagtcacttgattaaaacacattgaaatgttgttttggaggaaggggaaaggtttctttatgaattttgtactaaattccaaaaagaaaaaagtaccgactgcg

SEQ ID NO: 5296 - DNA, 1968 bp, Flaveria ramosissima
aggcatctgtgctatcttcctcacaaacccacccactcacccaaccattttgttgcttcattttcgaactcaatcgaagatctagataacaaattcagatcgaatgggaagcacaggattctcatggaaattagccgatcatccgaagctaccgaaaggaaaactggtggcgatgatcgttttggacggttggggcgaagcttctcccgataagttcaactgtattcatgtcgccgagactccaaccatggattctctcaaaaacggcgcccctgataaatggagactggtgagggctcatggtactgctgttgggcttcccactgatgatgatatgggaaacagtgaagttggacataatgctcttggtgctggaaggatctatgctcaaggtgcaaaactcgtagatcttgctcttgcatctggaaaaatatttgaagatgaaggatttaattatatcaaggaatcttttgctacaaacaccttgcaccttattggattgatgagtgatgggggtgtgcactcacgccttgatcagttacagttgttgcttagaggagcgagccagcatggtgccaagagaattcgtgttcatgtgcttactgatggacgtgatgtgttagatggttcaagtgttgggtttgctcaaatacttgaagcagaactttcagatctacgcagcaaaggcattgacgcacaggtggcatctggtgggggccgcatgtatgtgacaatggatcgctatgagaatgattgggaagttgtgaaacgtggttgggatgctcaagttcttggtgaagccccacacaaattcaaaaatgttgttgaggctatcaagacacttagagaggcccctggtgctaatgaccagtacttgcccccatttgtcatagttgatgatagtggaaagcctgtgggtcccattgtggatggtgatgctgttgtcacttttaacttccgagcagatcggatgaccatgcttgcccaagctcttgaatatgaaaattttgataaatttgacagagtgcgggtcccaaaaatccggtatgcgggtatgcttcagtacgatggggagttgaagcttccaagccactaccttgtatctcctccattgatagaaaggacatccggcgagtatttggtgcataacggggtccgtacttttgcttgcagtgaaacagtcaaattcggccatgtcacatttttctggaacgggaatcgttctggatatttcaactcagagttggaagaatatgttgaaattccaagtgatagtggaattaccttcaacgttcaaccaaaaatgaaagctttggagattggtgaaaaggcccgtgatgctatcctcagtggaaagtttgatcaagtacgtgtgaacataccaaatggtgatatggttgggcataccggtgatgttgaggctactgttgtggcctgcaaggctgcagatgaagctgttaagatgattcttgatgcagtagaacaagtgggtggaatatatgtggtgactgctgatcatggtaatgccgaagacatggttaaaagaaacaaaaagggtgagcctattctcaaggatggtgaggttcagatcttgacatcacacactcttcagccggtgcccattgcaattggggggccggggttagcaccgagtgtgaaattccgcaaggatgtgccgagcggcgggctagcaaatgtagcagcaacagtgatgaatcttcatgggtttgtggcacctgatgactatgagacaacccttattgaagtagttgattgagtattgaaagaaggtggttttgactttactttgacccacgtgttctaataatttgatggaaatagtaaaacatgtgacaatatgttttgttacctttttcaaattttctcacgatgtttgagtgagttttagtcacagcctttatattttgaacaaacacgtggttgtaaaatcaatagttgaattaaaaa

SEQ ID NO: 5297 - DNA, 1974 bp, Lotus japonicus
ttcttgttccattgcatcatcgccgctcgcaaattcgattcaacgttcgtttgtgttcttctgcaataaccaggaaaaacaaggaagatgggaagccagtggaagttgaatgatcaccctaagcttccaaaggggaagcagattgccatggtggttttggatggttggggtgaggccaaacctaatgagtacaactgcatccacactgccgagacacctactatggattctctaaaaaacggtgcacctgagaggtggagattggttaaggctcatgggaaagctgtggggcttcctactgatgatgatatgggcaacagtgaagttggtcacaatgctcttggtgctggccgtatatatgctcagggtgctaagcttgttgacattgctcttgaatctgggagcatttatgaaggagaaggtttcaagtacataaaggaatgttttgaaactggcacattgcatctccttgggttactaagtgacggtggagtccactccagacttgaccagttgcagttgctccttaaaggtgttagtgagcgaggtgttaaaagaattcgttgtcatattcttacggatggccgtgatgttttagatggctcaagtgtcgcatttgttgaaactcttgaagatgatctagcgaaattgcgtgaaaaaggcattgatgcaaggatagcatcaggtggaggtcgaatgaatgtcactatggaccgttatgagaatgactggagcgttgttaaacgagggtgggatgctcaagttcttggtgaagcctctcataagtttactagtgctcttgaagctgtcaagacactgagggcagaaccaaaagccaatgaccagtatcttcctccttttgttatcattgatgagagtgggaagcctgttggcccaatagttgatggagatgctgttgttacattgaacttccgagcagatcgtatggttatgattgctaaagctcttgaatatgaaaattttgacaaatttgacagagttcgtgtccctaagattcactatgctggaatgcttgaatatgatggtgaattgaagcttccaaggcattaccttgtttctccaccattgattgaaagaacatctggagaatatttagtgaataatggtattcggattttcgcttgcagtgagactgttaaatttggtcacgtcacattcttctggaatggaaaccgctctgggtattttaacccggcaatggaggaatatgtggaaattcctagtgatagtgggattacattcaacgtcaaaccaaagatgaaggcagtggagattgctgaaaaggcaagagatgcaattcttagcaagaaatttgatcaggtacgtgttaacctcccaaatagtgatatggtggggcatacaggtgacattgaagcaacagttgtggcttgcaaggctgctgatgaggctgtaaagatgatccttgatgcaattgagcaagtgggtggaatttatgttgtaactgctgaccacggaaatgcagaggacatggtgaagagggacaaatctggaaatcctcaacttgacaagaatggaaaaatccagattctcacttctcacactcttgagccagtgccacttgcgattggaggccctggactgtcagctggtgtcaggttccgcagtgatgttcccaccggaggcctggccaatgtcgcagctactgtgataaatctccatggatttgaggctcccagcgactacgagacaactctgatagaagtagttgataaataggacagcatagttgaattataattttgtgcaaattcggggaatgtgttgtcaccctccaaataattgagaactttcatcctccacctctatggtgggttttgtacttttgaattttttagcatttgctgctgttgacagagctggataaactatattaatgaggtttttaatgaagtttctttttctctttatttaaattctcctgaatctacaatt

SEQ ID NO: 5298 - DNA, 1937 bp, Ambrosia trifida
gggtttcagaaaatcttaccttaaccttccattttcttttttattaataattaattaataaccataaacgagatcttgttattcagatagcgatggggagcacaggcgtttcattgaaattggcggaccatccaaagctaccaagggaaagctggtagccatgattgttttggacggttggggtgaagcttctcctgataagtttaactgcatccatgttgctgagactcctaccatggattcgctcaaaaacggcgcccctgataaatggaggttggtgagggctcatggtactgctgttgggcttcccactgaggatgacatgggaaacagtgaagttggacataatgctcttggtgctggaaggatctttgctcaaggtgcaaaacttgttgatagtgctcttgcctctggaaaaatttacgaagatgaaggttttaactacatcaaggaatcttttgcaaccaacaccttgcaccttattggattgatgagtgatgggggtgtgcactcacgccttgatcagttacagttgttgctcagaggagctagccagcatggcgccaagaggatccgtgttcatgtgcttactgatggtcgtgatgttttagatggttcaagtgttggttttgctgaaacacttgaagccgaactttcagatctacgcagcaaaggcattgatgcacaggtggcgtcaggcggagggcgtatgtatgtcaccatggatcgttatgagaatgattgggaggttgtgaaacgtggctgggatgctcaggttcttggtgaagccccacacaaatttaagaatgttgttgaggctatcaagacacttagagaggcacccggtgctaatgaccagtacttgccaccatttgtcatagttgatgatagtggaaaggctgtgggccccgttgtggacggtgatgcagttgtgactttcaatttccgtgcagatcgtatgactatgcttgctcaagctcttgaatatgagaagtttgataaattcgacagagtgcgggtcccgaaaatccgttatgccggtatgcttcagtatgatggggagctcaagcttccaagtcactacctagtatctcctccattaatagaaaggacctctggcgagtatttggtgaataatggggtccggacatttgcttgcagtgagactgtcaaattcggccatgtcacatttttctggaatggaaaccgctctggatacttcaattcagagttggaagaataggttgaaattccaagtgatagtggaattaccttcaacgttcaacccaagatgaaagctttggagattggtgagaaggcccgggatgctatcctcagtggaaagtttgaccaggtacgtgtgaacataccaaatggagacatggttgggcacaccggtgatgttgaggctactgttgtggcttgcaaggctgctgatgaagctgttaagatgattcttgatgcagtagagcaagtaggcggaatatatgtggtgactgcagatcatggtaatgctgaggacatggttaaaagaaacaagaagggtgagcctattctcaaggatggggaggttcagattctaacatcacacactcttcagccggtgccaattgcaattggcgggcccgggttagcagcaggtgcgaagttccgcaaggatgtgccaagtggggggctagcaaacgtggctgcgactgtgatgaatttgcatgggtttgtagcacctgatgactacgagacgactcttattgaagtcgttgattgagtatgaaaggtgattttttttacagctcttcaaccctgcatttgaataatttcccggaaacagtaaacatatgacaatatgttttgttacaatttccagttttggtcatatgagtgggtttagctagctttattatatttgagcaaactcatggtttttaaagtatgcttta

SEQ ID NO: 5299 - DNA, 1791 bp, Flaveria ramosissima
cgaagatctagataacaaactccgatcgaatgggaagcacaggattctcatggaaattagccgatcatccgaagctacagaaaggaaaactggtggcgatgatcgttttggacggttggggtgaagcttctcctgataggttcaactgtattcatgtcgccgagactccaaccatggattctctcaaaaacggcgcccctgataaatggagactggtgagggctcatggtactgctgttgggcttcccactgatgatgacatgggaaacagtgaagttggacataatgctcttggtgctggaaggatctatgctcaaggtgcaaaactcgtagatcttgctcttgcatctggaaaaaatatttgaagatgaaggatttaattatatcaaggaaacttttgctgcaaacaccttgcaccttattggattgatgagtgacgggggtgtgcactcacgccttgatcagttacagttgttgctcagaggagctagccagcatggtgccaagagaattcgtgttcatgtgcttactgatggacgtgatgtgttagatggttcaagtgttgggtttgctcaaatacttgaagcagaactttcagatctacgcagcaaaggcattgacgcacaggtggcatctggtgggggccgcatgtatgtgacaatggatcgctatgagaatgattgggaagttgtgaaacgtggttgggatgctcaagttcttggtgaagccccacacaaatttaaaaatgttgttgaggctatcaagacacttagagaggcccctggtgctaatgaccagtacttgcccccatttgtcatagttgatgacagtggaaagcctgtgggtcccattgtggatggtgatgctgttgtcacttttaacttccgggcagatcggatgactatgctcgcccaagctcttgaatatgagaaatttgataaatttgacagagtgcgggtcccaaaaatcaggtatgcgggtatgcttcagtacgatggggagttgaagcttccaagtcactatcttgtatctcctccattgatagaaaggacatccggagagtatttggtgcataatggggtccgtacttttgcttgcagtgaaactgtcaaatttgggcatgtcacatttttctggaatggaaaccgttctggatatttcaattcggagttggaagaatatgttgaaattccaagtgatagtggaattacctttaacgttcaaccaaaaatgaaagctttggagattggtgagaaggctcgtgatgctatcctcagtggaaaatttgaccaagtgcgtgtgaacataccaaatggtgacatggttgggcatacaggtgatgttgaggctactgttgtggcttgcaaggctgctgatgaagctgttaagatgattcttgatgcagtagaacaagtgggtggaatatatgtggtgactgctgatcatggtaatgcggaagacatggttaaaaagaaacaaaaagggtgagcctattctcaaggatggtgaggttcagatcctgacatcacacactcttcagccggtgccaatcgcaattggggggccggggttagcgccgggtgtgaaattccgcaaggacgtgccgagtggcgggctagcaaatgtagcagcaacagtgatgaatctgcatgggtttgttgcacctgatgactatgagacaactcttattgaagtagttgattgaggatgaaaaaggtggttttgacttttactttgaccccacgtgttttaataatttgatggaatagttaaaaacatatatgacaatat

SEQ ID NO: 5300 - DNA, 1911 bp, Arabidopsis thaliana
acttttctctcagatctgctttgagattctccgattgcatctcaaaaaatctcagctatggctacctcctccgcttggaagctcgatgaccaccccaagctccccaagggtaagaccatcgccgtaatcgtcttagatggttggggtgaatctgcccctgatcagtacaactgtatccacaacgctccaactccagccatggattctcttaaacatggagctcctgatacttggactttgatcaaagctcacggtactgctgtaggacttcctagtgaagatgatatgggaaacagtgaggttggtcataatgctcttggtgctggtcgtatctttgctcaaggtgctaagctttgtgaccaagctcttgcttctggcaaaatctttgaaggtgaaggttttaaatacgtttctgaatctttcgagacgaatactttgcatcttgttggacttctcagtgacggtggagttcactctcgtctcgatcaactacagttgttgattaaaggatctgctgaacgtggtgctaagagaatcagagtccatattcttactgatggtcgtgatgttttggatggttctagtgttggatttgtggaaacccttgaagccgacctcgttgcattacgtgagaatggtgtggatgctcagattgcatctggtggaggacgtatgtatgtgactttggaccgatatgagaatgattgggaagttgttaaaagaggttgggatgctcaagttcttggagaagctcctcacaaattcaaaaacgctgttgaagctgtgaagactttgaggaaagagcctggtgctaatgaccagtatttgcccccgtttgtgattgttgatgaatcagggaaagcagttggtccgattgtggacggtgatgctgttgttaccttcaacttcagggctgatcgtatggttatgcatgctaaggcacttgagtacgaagattttgacaaatttgaccgtgtgaggtacccaaagattcgttatgctggtatgcttcagtatgatggagagcttaagctaccaagccgttaccttgtttctcccccggagattgatagaacatctggtgaatatttgactcacaatggcgtcagtacttttgcttgcagtgagaccgtcaagtttgggcatgtcaccttcttctggaatggaaatcgatctggatatttcaacgagaaattggaggagtatgttgaaatcccaagtgacagtggaatatcattcaatgtccagccaaagatgaaagctctggaaattggtgagaaggcaagggatgcaatccttagtggcaagtttgatcaggtgcgagttaacattccaaatggagatatggtgggtcatacaggtgatattgaagccacggttgttgcatgcgaggctgctgatcttgctgtgaagatgatttttgatgcaatcgaacaagtgaaaggaatttatgttgtgactgctgatcacggaaacgcagaggacatggtgaagagggataaatctggcaagcctgctttggataaggaagggaagcttcagattctaacctctcacacactcaagccagtgccaattgctattggaggtcctggtttggctcaaggagtgagattccgtaaagatctggaaacaccggggcttgcaaatgtagctgcaacagtgatgaacctccatggatttgtggctccctctgactatgagcccaccctgattgaagtagtggagtagaagaattgagagccttatcagtttttgaagagagggctgaaactctctagttatcttttgttgcttttctaataataagagtttacacacagactacttgtatttttgattttggctttaggccaaaaacattgaaattccatcttgaatgatatgcaagcttttttctttctctcccat

SEQ ID NO: 5301 - DNA, 2005 bp, Brassica napus
catttctcgccacatcacctcttcgtcttcgccaatctccatacgagcttcctctgtttctccgctgctatgggtagctccggcgacgttaactggaaactcgaggaccaccccaagctcccaaaaggaaaaaccatcggactgatcgttctcgacggatggggcgaatccgagcccgatcaatacaactgcatccacaaagctccaactcccgccatggattccctcaaaaacggacgtcctgatacgtggaggctgatcaaagctcacggcacggccgttggtcttcccagcgaagacgatatgggaaacagcgaggttggccataatgctctcggagcagggagaatctacgctcaaggtgctaagcttgttgatctcgcgcttgagtccgggaagatttatgaagatgaaggatttaaatacatttctgagtcttttgagaagggcactgtgcatcttattgggcttttaagtgacggtggagttcactctcggttagatcaagtgcagttgctgttgaagggtttcgcagaacgtggcgctaagagaatccgtgttcatattcttacggatggtcgtgatgttttggacggctctagtgtcggctttgtggagactcttgaaagtgagctcgctgagctacgttccaagggtgttgatgctcaggttgcttctggtggaggtcgtatgtatgtcacaatggaccgttatgagaatgattggactgttgtgaaacgtgggtgggacgctcaagtccttggagaagctccccacaaattcaaaaacgctcttgaagcggttaagaagctgagggctgaacctaaagccaatgaccagtacttgcctccgtttgtcattgttgacgacagtgggaaggctgttggtccgatcgttgatggtgacgcggttgttacgttcaacttccgtgctgatcgaatggtcatgcttgccaaggccctcgagaatgaagattttgacaagtttgatcgcgtacgtttcccgaagattcgttacgcaggaatgctccaatatgatggagagctaaagcttcctagccattaccttgtttctccaccgttgattgacagaacttctggtgaatatcttgcacataatggagtccgtacttttgcttgcagtgaaactgttaagttcggccatgttaccttcttctggaatggaaaccgctctggatatttcaacgaaaagctagagaagtacgttgagattccgagtgacagcggaatatcattcaatgaacagccaaagatgaaagcgctggaaattgctgagaaagctagggacgctatccttagtggcaactttgaccaggtgcgtgttaacctgccgaatggagacatggtgggtcataccggcgatcttgacgctactgttgttgcatgcgaggctgctgatgttgctgttaggatgattcttgatgccattgagaaggtgggagggatatatgttgtgacagcagatcacggaaatgctgaggacatggttaaaagggacaaagctggcaagccggctcttgacaaggaaggaaagcttcagattctcacctctcacaccctgaaaccagtgccaattgccataggaggtcctggtttgtcagcaggagttaggttcagacaggacttggacacaccagggcttgcgaatgtagctgcaacggtgatgaacctccatggatttgtggctcctggcgattatgagccgagtctgattgaagtagtcgacaagtaatgatggtgtggtgatcgttgttccctctgaaagtcccacttgagcttctctaaatcatgattctgtttacgtttcttacttttttttttcctcgtgctcttcctttgataaggccctcttgatttttgaggtggcgatagtttagactcgccaccatcagctgtctgttgtgggtcaagttaaacactgcatttggatgtttttgtttggcacaaactgacttttgattttgaaggtttaataataattaaac

SEQ ID NO: 5302 - DNA, 1959 bp, Lactuca sativa
agctctcatagaaaccagagacagagatcgtgagaaggagatgggaagcaaagaggtttcatggaagttggccgatcacccaaagctgccgaagggaaagttggtggcggtggtggttttggatggttggggtgatgcttctcccggaaaatacaactgcatccatgtcgccgaaacacctaccatggattctctgaaaaacactgcccctgataaatggagactggtgagggctcatggtactgctgttgggcttcccacagaggatgacatgggaaacagtgaagtaggacataatgctcttggtgctgggagaatctatgctcaaggggcaaaacttgttgatcttgcccttgcatctggaaaaatatacgatgatgaagggttcaaatacattaaggaatcttttgcaaacaacaccttacacctcattggattaatgagtgatggaggtgtccactctcgccttgatcaattacagttgttgctaaaaggtgctagtgagcgtggggccaagaagataagagtccatgttcttactgatggtagggatgttttggatggaacaagtgtcacccatgctgaaaccctagaaaaagatctctccgagttgcgtgctaaaggcattgatgcacaaattgcttccggtggtggacgcatgtatgtcactatggatcgttatgagaatgattggcaagttgtgaaacgtggttgggatgctcaagttcttggtgaagctccacacaagttcaagaatgcagttgaggcgataaagaaactaagggaagctccaaatgctaatgaccaatatttaccaccatttgtgattgttgatgatggcgggaaggcggtgggtcccattgtggatggtgatgcggttgtgacagttaactttcgagctgatcgtatgacaatgcttgctcaagctcttgaatatgaaaagtttgataagtttgatagagtccgcttccccaaaattaggtatgcaggtatgcttcagtatgatggagagttgaaacttccaagtcattatcttgtatcacctccattgattgagaggacttccggtgaatatttggtcaacaatggtatccgcactttcgcctgcagcgaaacggtgaagtttggtcatgttactttcttctggaatggaaatcgttcgggatgtttcaattctgagaaggaagaatatgtggaaattccaagtgattctggaattacatttaatgagaaaccaaagatgaaggcttttgagattggtgagaaagcgcgtgatgctatcctaagtggaaagtttgaccaggtacgagtgaatataccaaatggtgatatggttgggcatacgggcgatgtggacgccacaattgtcgcttgcaaggctgcggatgaggctgttaagacgatacttgatgcggtggagaaagtgggtggcatatatgtcgtgactgcagatcatggaaacgcagaggatatggtgaaacgggacaagaaaggggagccaatagttggcaaggatggaaaagtccaaatcctaacctcacacactcttcagccagtgccggttgcgataggaggaccggggttagcgagtggtgtgaagttccgtaaggatgttccaaatggtgggctagcgaatgtggcggcaacggttatgaatttgcatgggtttgtggctcctgatgactatgagaccacacttattgaagttgcttaatttgttaattaatcaacacttgagattatcatgagttttggcttcatttttgccagtttagggtgagttgaggtcgactcttgatgctcaaataatgtctgtcttttttagaattgaatgagttgggtttaagtaaaaaagctaccaacttaatttggttacaagagttggatcatgttagataaaattatattcatggaaatggttatcaagaaaatagtgaaacagtccgcaaattctaccga

SEQ ID NO: 5303 - DNA, 2094 bp, Lactuca sativa
ctgaattaagctctcatagaaaccagagacagagatcgtgagaaggagatgggaagcaaagaggtttcatggaagttggccgatcacccaaagctgccgaagggaaagttggtggcggtggtggttttggatggttggggtgatgcttctcccggaaaatacaactgcatccatgtcgccgaaacacctaccatggattctctgaaaaacactgcccctgataaatggagactggtgagggctcatggtactgctgttgggcttcccacagaggatgacatgggaaacagtgaagtaggacataatgctcttggtgctgggagaatctatgctcaaggggcaaaacttgttgatcttgcccttgcatctggaaaaatatacgatgatgaagggttcaaatacattaaggaatcttttgcaaacaacaccttacacctcattggattaatgagtgatggaggtgtccactctcgccttgatcaattacagttgttgctaaaaggtgctagtgagcgtggggccaagaagataagagtccatgttcttactgatggtagggatgttttggatggaacaagtgtcacccatgctgaaaccctagaaaaagatctctccgagttgcgtgctaaaggcattgatgcacaaattgcttccggtggtggacgcatgtatgtcactatggatcgttatgagaatgattggcaagttgtgaaacgtggttgggatgctcaagttcttggtgaagctccacacaagttcaagaatgcagttgaggcgataaagaaactaagggaagctccaaatgctaatgaccaatatttaccaccatttgtgattgttgatgatggcgggaaggcggtgggtcccattgtggatggtgatgcggttgtgacagttaactttcgagctgatcgtatgacaatgcttgctcaagctcttgaatatgaaaagtttgataagtttgatagagtccgcttccccaaaattaggtatgcaggtatgcttcagtatgatggagagttgaaacttccaagtcattatcttgtatcacctccattgattgagaggacttccggtgaatatttggtcaacaatggtatccgcactttcgcctgcagcgaaacggtgaagtttggtcatgttactttcttctggaatggaaatcgttcgggatgtttcaattctgagaaggaagaatatgtggaaattccaagtgattctggaattacatttaatgagaaaccaaagatgaaggcttttgagattggtgagaaagcgcgtgatgctatcctaagtggaaagtttgaccaggtacgagtgaatataccaaatggtgatatggttgggcatacgggcgatgtggacgccacaattgtcgcttgcaaggctgcggatgaggctgttaagacgatacttgatgcggtagagaaagtgggtggcatatatgtcgtgactgcagatcatggaaacgcagaggatatggtgaaacgtgacaagaaaggggagccaatagttggcaaggatggaaaagtccaaatcctaacctcacacactcttcaaccagtgccggttgcgataggaggaccggggttagcgagtggtgtgaagttccgtaaggatgtcccgaatggtgggctagcgaatgtagcggcaacggttatgaatttgcatgggtttgtggctcctgatgactatgagaccacacttattgaagttgcttaatttgttaattaatcaacagttgagattatcatgagttttggcttcatttttgccggtttagggtgagttgaggtcgactcttgatgctcaaataatgtctgtcttttttagaattgaatgagttggatttacgtaaaaaagctaccaacttaatttggttacaagagttggatcatattagataaaattatattcatggaatggttatcgagaaaatagtgaaacaatccccaaattctacaaaattttcaatcatgctgatgtaattctcggtaaaatataagatcatcgacgtaaagacgtacataaagaaatttacttttatcttctttgaagtggacatctttttaaaattatccttcataaagcaag

SEQ ID NO: 5304 - DNA, 2185 bp, Solanum tuberosum
ctataatattcttgattttctttgaatatcaacaagtgtaggcctccggtatttcagcccaacaatcccataaagacccctccttcactcctccattgttttctccactacacacctttttgctctctcttctcttctataccgcttaagaatttttaagatctgagatatgggtagttcaggagatgcatggaaattgaaggaccatcctaagcttcctaagggaaagactgttgctgttattgttttggatggttggggtgaggctaaacctaatgagtataacgctatctctgttgctgaaactcctgttatggactccctcaagcagggtgctcctgaacattggagattgattaaggcacatggaaatgctgtggggcttcccacagaggatgatatgggtaacagtgaagttggtcacaatgctcttggtgctggaaggatctttgctcaaggtgcaaagcttgttgacctagcccttgcctctgggaaaatctatgatggagaaggtttcaaatacgttcaagaatgttttgagaaaggaactctgcaccttattggtctcgtgagtgatgggggtgtccactccaggcttgaccaattgctgttgttgctgaaaggtgctgctgagcgtggtgccaaaagaattcgtgtccatgccctcaccgatggacgtgatgttctggatggttctagtgtgggcttcatggagaccctcgagaatgatctagcaaaattacgtgaacaaggtgttgatgcccgggttgcatctggtggaggtcgcatgtatgttaccatggatcgttatgagaatgactgggatgtcgtaaaaagaggttgggatgcacaagttcttggtgaggctccacaccacttcaaggatcccgttgaggcaattaagaagttgaggcaggaacccaatgccagtgatcagtacttggccccttttgtgattgttgatgataatggaaagcctgttgggcctattttggatggtgatgctgttgtgactttcaacttcagagcagatcgtatggtcatgcttgcaaaggcccttgaatacgaagattttgacaaatttgatcgtgtacgagtccctaaaatccattatgctggtatgctccaatatgatggtgaattgaagcttccaaacaaataccttgtttctcctccagagattgaccggacatctggggagtatctagtgcgcaatggtgttaggacttttgcttgcagtgagactgttaaatttggtcacgtcaccttcttttggaatggaaaccgttctgggtattttgacgagaaattggaagagtatgtggaaattccaagtgacagtgggattacatttaatgttaagccaaaaatgaaggcactggagattgctgaaaggactagggatgccatccttagccacaaatttgaccaggtacgggtgaacatacctaatagtgatatggtggggcatactggtgacattaaagcaacaattgaagcttgcaaggctgctgatgacggcgtcaagatgatccttgaagctattgaacaagtgggtggaatatttctagttactgctgaccatggaaatgctgaggatatggtcaagagaaacaagaagggcgagccattacttgacaagaatggaaacattcagattctcacttctcacactctcgaacctgttcctattgcaattggtggtcctggactcttacctggtgtgagattccgcacagatctccccaccggtgggcttgcaaatgtggctgcaacctttatgaatctgcacggatttgaggcacctagcgattacgagccaaccttgatcgaggttgttgacaactagatatctcatagaccttagggttgaagttttggcgcaaggggaaagcgataatgaccgcattctacactttctgtttatctgaataagacatttttgagcttatattaacagaagttgacattctaccacatggccttgtgatgctatgatggaagagtgcgatatactgttcatgttaaaccctgtaatcttttaaggcataacttcgagtttttgtttggtgaacaagaattcgtaatctttcactatatgtggcagaaatacataagctgtttgatgctctatatttctgtatctgtcgaagaaacagtatgctccagttgaagttgttatttc

SEQ ID NO: 5305 - DNA, 2112 bp, Zostera marina
gttgcgcatgatttatgacccacagagtcacggccgttgaaattgagactccgatttgccctaaattctaccgatctataaatagcacgtccgttcgtcttttccctaatcacgtctctcgagaatatcttgaattgtttccggtaaagtagaaattaagaagctatggcgagctctggattatcgtgggagttggaagcacacccgacgcttccaaagggaaagaccgtagctgttgtggttcttgatggttggggtgaggctactcctgatcagtacaactgcgttcatgttgcagagacaccgaccatggattctcttaaaaatggtcatccagatacctggagattggtgcgtgctcatggccatgcagttggacttcccacagaggatgatatgggtaacagtgaagttggtcacaatgcattaggtgctggacgaatttttgctcagggtgctaagttggtggatcttgcattggaatctggaaaaatttacgatgatgaaggatttaattacatcaaggattgttttgctgaaaataccttgcatctaattggcttattgagtgatggtggtgttcattctcgtcttgatcaattacagttgcttcttaaaggatccagtgaacgtggtgctaagagaattcgtgtgcatatcctcactgatggacgtgatgttctggatggctccagtattggttttgttgagactcttgagagcaccctttcaactttacgtgagaaaggtatcgatgctcaaattgcatcgggtggtggacgcatgtatgtcactatggatagatatgagaatgactgggaagttgtcaaacgtggatgggatgcccaagttcttggcgaagcaccataccaatttaagaatgcagttgaagctgtcaaaaatttaagagaagaaaccaaatgcagcgaccaatatttgcccccctttgttattgttgatgacaatggtaaagcagttggacctatagttgatggtgatgctgttgtgacattcaatttccgtgcggatcgtatgaccatgattgctaaatcacttgagtataaagatttcgacaaattcgaccgagtgcgtgtcccaaagatcaaatattgtggaatgcttcagtatgatggtgaattactgcttccatctcattatcttgtttctccgcccgaaatagataggacttctggtgaatatctagtgcataatggtgtcaaaacctttgcatgcagtgagactgttaagtttggtcatgtaacatttttttggaatggaaatcgttctggttactttgattctagtatggaagaatacgttgaaattccaagtgacgttggaataacattcaatgtcaaacctaaaatgaaggccttggaaattgctgagaaggccagagatattatcttgagtggcaaatttcaccaggtacgtgtgaacttgcctaactctgacatggtgggtcataccggtgatatagaggccactgttgtggcatgcaaaacttcagacaaaggtgttaagatgattctggatgctgttgagcaagtgggtggtatatatctagtgactgcagatcatggtaatgccgaggatatggtaaagaggaacaaggctggtaacccagctcttgacaaaagcggaaacattcaagtgttgacttcacatactcttcaacctgttccgattgccatcggaggtcctggacttcattcaggagttagattcaaaagagatgtgcccaatggtggacttgccaatgttgctgccaccgtgatgaatctccatggtctggttgcacccagtgactacgaggagaccctcattgaggttgttggcaactaaagaattttgctactacctcaattactacacaagaaatgttttgactgccttatttatcaaaccaccgtatttatttaaatgctgctgctgctgtttctccttgtttttaattttgttctaaataattttaacttgtcactttgttctttacgtttttctttttgttttccttatctcaagtaataaaaatttacttacagaatttctggtaagtttgtagaactttttacagttttaatcagttatagtttctgttacaccaaaaaa

SEQ ID NO: 5306 - DNA, 2029 bp, Brassica napus
cctaccgtatctcaccacatcaccctcttcgtcttcgccaatctccatacgagagcttcctctgtttctccgctgctatgggtagctccggcaacgttaactggaaactcgaggaccaccccaagctccccaaaggcaaaaccatcggactgatcgttctcgacggatggggcgaatccgagcccgatcaatacaattgcatccacaaagctccaactcccgccatggactccctcaaaaacggacggcctgacacgtggaggctgatcaaagctcacggcacagccgttggtcttcccagcgaggacgatatgggaaacagcgaggttggccataatgctctcggagctgggagaatctacgctcaaggtgctaagcttgttgatctcgcgcttgagtccgggaagatttatgaagatgaaggttttaaatacatttctgaggcctttgagaagggaacagtgcatcttattgggcttttaagtgacggtggagttcactctcggttagatcaagttcagttgctgttgaagggtttcgcagaacgtggcgccaagagaatccgtgttcatattcttactgatggtcgtgatgttttggacgggtctagtgtcggctttgtggagactcttgaaagtgaactcgctgagttacgttccaagggtgttgatgctcaggttgcttctggtggagggcgtatgtatgtcacaatggaccgttatgagaatgattggactgttgtgaaacgtgggtgggacgctcaagtccttggagaagctccccacaaattcaaaaacgctcttgaagcagttaagaagctgagggctgaacctaaagccaatgaccagtacttgcccccgtttgtcattgttgacgacagtgggaaggctgttggtccgatcgttgatggtgacgcggttgtaacgttcaacttccgtgctgatcgaatggtcatgctcgccaaggctctcgagaatgaagattttgacaagtttgatcgcgtacgtttcccaaagatccgttacgcaggaatgctccaatatgatggagagcttaagcttcctagccattaccttgtttctccaccgttgattgatagaacttctggtgaatatcttgcacataacggtgtccgtacttttgcttgcagtgaaactgttaagtttggccatgttaccttcttctggaacggaaaccgctctggatatttcaatgaaaagctagagaagtacgttgagattccgagtgacagcggaatatcattcaatgaacagccaaagatgaaagcgctggaaattgctgagaaagcaagggacgctatccttagtggcaactttgaccaggtgcgtgttaacctgccaaatggagacatggtgggtcataccggcgatcttgacgctactgttgttgcatgcgaggctgctgatgttgctgtgaggatgatccttgatgccatagagaaggtgggagggatatacgttgtgactgcagatcacggaaatgctgaggacatggttaaaagggacaaagctggcaagcccgctcttgacaaggaaggaaagcttcagattctcacctctcacaccctgaaaccggtgccaattgccataggaggtcctggtttgtcagcaggagttaggttcagacaggacttggacacacctgggcttgcgaatgtagctgcaacggtgatgaacctccatggatttgtggctccgggcgattatgagccgagtttgattgaagtagtcgacaagtaatgatggtgtggtgatcgttgttccctctgaaagtcccacttgagcttctctaaatcatgattctgtttacgtttcttttttttttcctcgtgctcttcctttaataaggccctcttgtatttttgaggtggcgatagtttagactcgccactatcagctgtcgttgtgggtacaaagttaaaactgctatttggattgtttttgttttgcacaaactgattttctattttgaaggtttaataataattaaacgaattacataaaattat

SEQ ID NO: 5307 - DNA, 2035 bp, Manihot esculenta
ggttttcggttttctctgtatatcgctgcttgattttgatcagcccaaggctttaatatcggtcaattctgttcagatcttttttgagatagattgagatggggagctctggacaattcacatggaagctggcggatcatccaaagcttcccaaggagaagattattgcaatggtagttttggatggttggggtgaggctaaccctgatgaatataactgtatccacgttgctgagactcccaccatggactccttcaaaaagactgctcctgagaagtggagattgattagggctcatggtaccgctgtgggtcttccgactgaagatgatatgggcaacagtgaagttggtcacaatgctcttggcgctggacgcatttttgctcaaggtgcaaagcttgttgaccttgctcttgcctctggaaaaatctttgaaggagagggatttaagtatataaaggaatcttttgcaaccaatactttacaccttattggcttactaagtgatggaggagttcactccaggcttgatcagttgcagttgttgctaaaaggtgctgctgaacgtggtgctaaaagaatccgagttcatgttcttactgatggacgtgatgttatagatggtacaagtgttggctttgtagaaactcttgataaagatctagcaattttacgtgaaaaaggtgttgatgcacagattgcatctggtggaggccgcatgcatgttacaatggatcgttatgagaatgactggaatgttgtgaaacgaggatgggatgctcaggtccttggtgaagccccacataagtttcgaaatgctcttgaagctgtcaagaaactaagggaagaacccaaagccaatgaccagtacttacctccttttgtcattgttgatgagaacggcaagccagtgggcccaattgtggatggtgatgctgttgtcacattcaacttccgtgcagatcgtatggttatgattgccaaggcgcttgaatatgagaagtttgacaaatttgacagagtcagattccctaaaatccgttatgctggaatgctcgagtatgatggcgagttgaagcttccaagccattaccttgtatcaccaccagagatagaaaaaacttctggtgaatatttagtccataatggtgttcgcacattcgcttgcagtgagactgtcaaatttggtcatgtcactttcttctggaatggaaatcgttctggatgttttaacccagaaatggaggaatatgttgaaattcccagtgatgttggaatcacattcaacgtcaaaccaaagatgaaggcactagagattgcagagaaggcaagggatgctatcctcagccgcaaattccaccaggttcgtgtcaacctaccaaatggtgacatggttggacatacaggagatattgatgccacagttgtggcatgcaaggctgctgatgatgctgtcaagatgatcattgatgctatagagcaagttggtggaatatatgttgtcactgcagatcatggcaatgctgaggacatggtgaagagggacaagtctgggaaaccagctgttgataagagtggcaaaattcagatactaacgtcacacacgcttcagccagtgcccattgccattggaggtcctggattggcagcaggtgtcagattccggaatgatgttcccagcggtggacttgctaatgtggctgcaacagtgataaatctccatggatttgaggcacctggtgactacgagcctactctgattgaagtagtggattgacgtaaaacgtataaattcacgttagttttgcttaaatattgatcagaaactgcacaatgcaaaagcctggctacgctgggcatattctctggataaataagcaattttgagtttgcttgtggggtgttggcctccctattttggatttttgtatgcattactcattaattatatggaattgaattaatagtgtacttcagatgcactttcaggaatgctgtgtttatttttgctgcgtaatgcatactttcatctac

SEQ ID NO: 5308 - DNA, 2050 bp, Pseudotsuga menziesii
gcttcctctgcttaactagactggttttcctgagctccagatatacagataagatgggcagcaccgatttctcatttaagttggccgatcatcccaagcttccaaaggggaagcagctggctgtgataattttggacggttggggtgaggagaaacctgatcagtacaactgtattcatgttgctgagactcccaccatggattctctcaaaacgggggctccagagaaatggacactgattaaagcacatggacctgcagttggactccctacagaagatgatatgggaaacagtgaagtaggccacaatgctcttggagctgggagaatatttgctcaaggagcaaaattagtggattatgctcttgcctctggcaaaatctacgagggagaagggtttaaatacattaaggagtgctttgaaaatggcacacttcatctcattggccttttgagtgatggtggtgttcattcgcgattagatcagttgcagttgcttttgaaagggtctgcacaaaatggtgcaaaaaggatccgagtgcatatcctcactgatggtcgtgattgtcttgatgggtcaagttttggtttcgtagagacactagagaatgatcttgctgagttacgtaaacagggtgttgatgcactaattgcctccggcggaggccgcatgtatgtgacaatggatcgttatgagaatgattggggtgtggtcaaacgaggctgggatgcacaggttttgggaaaagcacctcataaatttaaaagtgcgttggaagcagtcaaaaagctgagggaggatcataaagttaatgatcagtacttgcctccttttgtcattgttgatgaaaatgagaaggcagttggacctattcttgatggagatgcagtggtgaccattaattttcgagcagatcgcatgactatggttgctaaagcatttgaatacgagaattttagtgcatttgatcgagttcgatatcctaaaattcgttacgctggaatgcttcagtatgatggagagttgaagcttccatctcattatcttgttaacccaccagatattgatagaacatcaggagaatatctcgtccataatgggatacggacatttgcatgcagtgaaactgtaaaatttggtcatgttacatttttctggaacggcaaccggtctggatattttagcgaggaactagaggaatatgtggaaatcccaagtgattcaggaatcacattcaatgtcaagccaaaaatgaaggccttggaaattgctgaaaaaacaagagatgccatattgagtggccgttttgatcaggttcgtgtgaatctgcctaatggtgacatggtagggcatactggcgatatagatgcaacaattgttgcgtgtaagtctgccgacgaggctgtaaagattattcttgatgcaatagaacaggttggtggcatctaccttgttactgcagatcatggaaatgctgaggatatggtgaaaagaaacaccaaaacaggtcaaccggcaaaggataaagatggaaatattcaaattctgacctctcatactctctccccagtgccaattgccataggaggtcctggactggcggaaggagtgaggtttcgtagtgatttgaaacagcctgggcttgcaaatgttgcctccactataattaatctcttgggatttgaggctccaaatgattatgagccaacattgattgaagttaccaaccattgatttttggatcaaacatggcagcacggagcaaatcaaataatgttatagttttaatttttggaagccaaaattagtgggtcatttcttaaatttgtcatagttgtctgtcttttagaatttaccccgagagtagatacagtaattgggtagctctgcggctcttttggtatgtatttattattaaattctgagcagcgtacctattcaaatgataatttgttccagatgcttatgttatttaaattcacgatggtggatggttgaagttctgcacaagggaatgctcctttgccgcaagaggaaatttaataaaa

SEQ ID NO: 5309 - DNA, 2157 bp, Pinus taeda
tacgaaagcattgaatacttctcgcttgcttcctctgcgtaatttcactgcattgctcgagcttcaaacattcagaaaatgagtagcaccaatttctcattcaagttggctgatcatcctaagcttccaaaggggaagcagttagctgtggtagttttggacggttggggcgaggagaaaccggatcagtacaactgtattcatgttgccgagactcccgccatggattctcttaagaagggggctccagagaaatggacactgatcaaagcacatggacctgcagttggactccctactgaagatgatatgggtaacagtgaagtaggtcacaatgctctcggagctgggagaatatttgctcaaggagcaaaattagtggattacgctcttgcctctggcaaaatctatcagggagaagggtttacatacattaaggagtgctttgaaaatggcacacttcatctcattggccttttgagtgatggtggtgtccactcacgtttagatcagttgcagttgcttttgaaaggtgttccacaacatggtgcaaaaaggatccgagtgcatattctcactgatggtcgtgattgtctggatgggtcaagtattggctatgtagagacactagagaatgatcttgctgagttacggaaacaaggtgttgatgctttaattgcctctggtggaggtcgcatgtatgtgacaatggatcgctatgagaatgattggggtgtggtcaaacgaggctgggatgcccaggttttgggaaaagcaccttataaatttagaaatgctgtggaagcagtcaagaagcttcgggaagctccaatagtagtgatcaatatttacctccatttgtcattgtcgatgaaaatgacaaggccgttggacctattcttgatggagatgcagtggtgaccattaatttccgagcagatcgtatgactatggttgctaaagcattcgaatatgagaattttagtgcatttgatcgagttcggtatcctaaaattcgatatgcaggaatgcttcagtatgatggagagttaaagcttccggctcattatcttgtttccccaccagatatcgatagaacatcaggagaatatcttgtacacaatgggatacggacatttgcatgcagtgaaactgtaaaattcggtcatgttacatttttctggaacggcaaccgatccggatatttagcgaggaactggaggaatatgtggaaatcccaagtgattcaggaatcacattcaatgtccaaccaaaaatgaaggccttggaaattgctgaaagaaccagagatgccatattgagtggccgttatgatcaggttcgtgtgaatctgccaaatggtgatatggtagggcacactggcgatatagaggcaacggttgttgcgtgtaaggctgctgatgaggctgtaaagattattctggatgcaatagaacaagttggcggcatctaccttgttacggcagatcatggaaatgccgaggatatggtgaaaagaaacaaaacaggtcaaccggcgaaggataaagatggaaagattcaaattttgacttctcatacttgttccccagtaccgattgctataggaggtcccggacttacgaaaggagcgaggtttcgtactgatttgaaacagcccgggcttgcaaatgttgcctccactataattaatctcttgggatttgaggctccaagtgattacgagccaactttgattgaagttgccagcaattgatctacgagtcaaatatggcaatttttggaagccaagattagtaggtcatttcttaaatttgtcataattgttctgttctttcagaatgcaccctgagaatagaatctagatacagtaaatggttagttctgcggctttttgcgaataaatttatgttgtgagtagcatacttattcaaatgatactattttatcaagatgcttgtgatatttcctttgtaggaggaaatttaataatattagattttgatcttgtgatatgcttcttttgctaaaggcaaaaattaatgtatctattatacgttcgtgtatttgtttctggagtgttcaaaagctagtgggaaagtatattctccatccatgttagttatgcccataccatatatttaatttctcagaaac

SEQ ID NO: 5310 - DNA, 1919 bp, Ambrosia trifida
ctataataatatctttgttacttattatttccttcattttcattaaaccctaacgtagatccaaacaagctaagagcaggatgggaagcactggattttcatggaagttggccgatcatccgaagctacctaaaggaaagctgttggccatgattgtattagacggttggggtgaagcttctcccgataagttcaattgcatccacgtcgctgatactcctaccatggattctctcaaaaacggtgcccctgataaatggagattggtgagggctcatgggactgctgttgggcttcccactgaggatgacatgggaaacagtgaagttggacataatgctcttggagcgggaaggatctatgctcaaggtgcaaaactagtggaccttgctcttgcatctggaaaaatttatgaagatgaagggtttaattacatcaaggaatcttttgcaacaaataccttgcaccttattggattgatgagtgatgggggtgtgcactcacgtcttgatcagttacagttgttgctcaaaggagctagccagcatggggccaagaggattcgcgttcacgtgcttactgatggacgtgatgttttagacggttcaagtgttggctttgctgaaatacttgaagcagaactttcagatctacgcagcaaaggcattgacgcccaggtggcttctggtggtggtcgcatgtatgtcaccatggaccgttatgagaatgattgggaagttgtgaaacgtggttgggatgctcaggttcttggtgaagctccacacaagtttaagaatgttgttgaggctatcaagacacttagagaggcccctggtgctaatgatcagtacttgcccccttttgtcatagttgatgatagtggaaagtctgtgggtcccattgtggatggtgacgctgtcgtcactttcaacttccgagcagatcgtatgaccatgcttgcccaagctcttgaatatgagaactttgataaatttgacagagtgcgggtcccaaaaatccggtatgcgggtatgcttcagtatgatggggagttgaagcttccaagtcactaccttgtatctcctccattgatagaaaggacatctggcgagtatttggtacataacggggtccgcacatttgcttgcagtgaaactgtcaaattcggtcacgtcacatttttctggaacggaaaccgttctggatattttaattcagagttggaagaatatgttgaaattccaagtgatagcggaattaccttcaatgttcaaccaaaaatgaaagctttggagattggtgagaaggctcgtgatgctatcctcagtggaagatttgaccaagtacgtgtgaacataccaaatggtgacatggttgggcatactggtgatgttgaggctactgttgtggcctgcaaggctgctgatgaagctgttaagacgattattgatgccgtagaacaagtgggtggaatatatgtggtgactgctgatcatggtaatgccgaagacatggttaaaagaaataaaaagggtgagcctattctcaaggatggtgaggttcagatcttaacatcacacactcttcagccggtgccgatcgcaattggcgggcctgggttagcagcggttgtgaaattccgcaaggacgtgccaagtggcgggctagcaaatgtagcagcaactgtgatgaatctgcatgggtttgttgcacctgatgactatgagccaactcttattgaagttgttgattgagcaagtatgaaaaaaaggtggttttgatttttgtccgacccacgtgttttaataattggatgaaaatagtaaacatatggcaatatgttttgttacattttccaaatttcttcacaacattttagtgggttttagttgtcttaatgtttgagcaaacgcatagtt

SEQ ID NO: 5311 - DNA, 1902 bp, Arabidopsis lyrata
ttttctcagatctgctttcagtttattcttcgattgcatctcaaaaatctcagctatggctacctcctccgcctggaagctcgatgaccatcccaaactacccaagggcaaaaccatcgccttaatcgtcctagatggttggggtgaatctgctcctgatcagtacaactgtatccacaacgctccaactccagccatggattctcttaagcatggagctcctgatacttggacgttgatcaaagctcacggtactgctgttggacttcccagtgaagatgatatgggaaacagtgaggttggtcataatgctcttggtgctggtcgtatcttcgctcaaggtgctaagctttgtgaccaagctcttgcttctggcaaaatctttcaaggtgaaggtttcaaatacgtttctgaatctttcgagacaaatactttgcatcttgttggacttctcagtgacggtggagtccactctcgtctcgatcagctacagttgttgattaaaggatctgctgaacgtggtgctaagagaatcagagtccatattcttactgatggtcgtgatgttttggatggttctagtgttggatttgtggaaactcttgaagccgatctcgttacattacgtgagaatggtgtggatgctcagattgcatctggtggaggtcgtatgtatgtgactttggaccgatatgagaatgattgggaagttgttaaaagaggttgggatgctcaagttcttggagaagctcctcacaaattcaaaaacgctgttgaagctgtgaagactttgaggaaagaacctggtgctaatgaccagtatttgcctccctttgtcattgttgatgattcagggaaaccagttggtccgattgtggacggtgatgctgttgttaccttcaacttcagggctgatcgtatggttatgcatgctaaggcacttgagtatgaagattttgacaaatttgatcgtgtgaggttccccaagattcgttatgctggtatgctgcagtatgatggagagcttaagctacctagccgttacctcgtttctcccccggagattgatagaacttctggtgaatatttggctcacaatggcgtcagtacttttgcttgcagtgagaccgtcaaatttgggcatgtcaccttcttctggaatggaaaccgatctggatatttcaacgagaaattggaggagtatgttgaaatcccaagtgacagtggaatatcattcaatgtccaaccaaagatgaaagctctagaaattggtgagaaggcaagggatgcaatccttagtggcaagtttgatcaggtgcgagttaacattccaaatggagatatggtgggtcatacaggtgatattgaagccacggttgttgcatgcgaggctgctgatcttgctgtgaagatgatttttgatgcaatcgaacaagtgaaaggaatttatgttgtgactgctgatcatggaaacgcagaggacatggtgaagagggataaatctgggaagcctgctttggataaggaagggaagcttcagattctaacctctcacacactcaagccagtgccgattgctattggaggtcctggcttgtctaaaggagtgaggttccgtaaagatctggaaacaccagggcttgcaaatgtagctgcaacagtgatgaacctccatggatttgtggctccctctgactatgagcccaccctaattgaagtagtggagtagaagaattgagagcctaatcagtttttaagagagggctgaaactctctagttatcttttgttgctttctaataatgagtttacacacaagacttgtatttttgattttggctttatgccaaaaacattgaaaatcggatttaaatgatatgcaagctttttccttctcttccat

SEQ ID NO: 5312 - DNA, 1955 bp, Arnica chamissonis
gttcagaaatccacctacctttttgacttcattttcaaacccaaacgagatccagagaagaaactgagaccgagaaaacgatggggagcaccggattttcatggaaattggcggatcatcccaagctaccgaagggaaagctggtggctatgattgttttggacggttggggtgaagcttctcccgataagttcaactgcatccatgtcgctgaaactcctaccatggattctctcaaaaacggcgcccctgataaatggaggttggtgagggctcatggtactgctgttgggcttcccaccgaggatgacatgggaaacagtgaagttggacataatgctcttggtgctggaaggatctttgctcaaggtgcaaaacttgttgatcatgctcttgcctctggaaaaatatacgaagatgaaggttttaattacatcaaggaatcttttgcaaccaacaccttgcaccttattggtttgatgagtgatgggggtgtgcactcacgtcttgatcaagtgcagttgttgcttagaggagctagccagcatggcgccaagaggatacgtgttcatgtgcttactgatggtcgtgatgttttagacggttcaagtgttggttttgctgaaatacttgaagcagaactttcagatctacgtggtaaaggcattgatgcacaggtggcatctggtggagggcgtatgtacgtcaccatggaccgttacgagaatgattgggaagttgtgaaacgtggttgggatgctcaggttcttggtgaagccccacacaaatttaagaatgttgttgaggctatcaagacacttagagaggcccccggtgccaacgaccagtacttgccttcatttgtcatagttgatgatagtggaaagcctgtgggtcccattgtggatggtgatgctgttgtgactttcaatttccgtgcagatcgtatgactatgcttgctcaagctcttgaatatgagaagtttgataaattcgatagagtacgggtcccgaaaattcgctatgctggtatgcttcagtatgatggggagctcaagcttccaaatcactaccttgtatctcctccattgatagaaaggacttcaggggagtatttggtgcataacggggtccgtactttcgcttgcagtgagaccgtcaaattcggccatgtcacatttttctggaatggaaaccgttctggatatttcaattcagagttggaagaatatgttgaaattccaagtgatagtggaattaccttcaatgtccaacccaagatgaaagctttggagattggtgagaagacccgtgatgctatcctcagtgggaagtttgaccaggtacgtgtgaacataccaaatggagacatggttgggcataccggtgatgttgaggctactgttgtggcctgcaaggctgctgatgaagctgttaagatgattcttgatgcagtagagcaagtgggtggaatatttgtggtaactgcagatcatggtaatgctgaagacatggttaagagaaacaaaaagggcgagcctcttctcaaagatggtcaggttcagattctaacatcacacactcttcagccggtgccaattgcaattggtgggccggggttagcagcaggtgtgaaattccgcaaggatgtgccaagtggtgggctagcaaacgtagctgcaacagtgatgaatctgcatgggtttgtggcacctgatgactatgagacgactcttattgaagtcgttgattgagtatgaaaggtggtttcgaattttcttcaccccgtattttaaataatttcgtggaaacagtaatcatttaacaatgtgttttgttacaatttccagttttggtcaatacgggtggggtttagttagctttatatttgagcaaactcatggttgtaaaaggaatgattgatctgacccaagttgcaattacttgatagtttt

SEQ ID NO: 5313 - DNA, 2319 bp, Citrus clementina
tgcgtgactcattccaaaaaggtcaccgcaaaaccgccttcaccatttaaatttactaattaattaacactggcccaagaactgattctttaaacacgacgacccatcgttgcacctaacacactaaaatttacgcaagtatagaaatagaatattcgtagctagaagattcttcttctttttctttttcaaaatttctagaaaagtatcacgtgatgacgcacgggtctggagtcaaaaaacaggactacgtgtcccattggtttctagatccaacggcgagaggcgtgctctgattttgctattcaaagacgtatataatattcacgctctaatatcaaagggttcgtcctggtattctctctctgtgtaatatcacttgtttgtttgttagctttctacggacgcgcgattcgccttcaatccaaaactaattaagagtgaaagatggataactggaaattaaaagagcatccacagctgtcgaggaataacattgtagccgttgtggtgctggatggctggggtgagtacaagcccgacaagtataactgcatccatgtcgccgacactcccaccatggactctttcaagaagtctgcacctgagaggtggaggttggtccgagctcatggtagtgctgtggggcttccaactgaagatgacatgggtaacagtgaagtcggtcataatgcactcggtgctggtcgcatttttgctcaaggtgcaaagcttgttgaccttgctctggcctctgggaaaatctatcaagatgagggatttaattacattaagccgtcttttgaaaccggcacattgcaccttattgggttactgagtgatggtggagtacactctaggcttgatcaacttcagttgttgctaaaaggagctagtgagcgtggtgctaaaagaattcgtcttcatattcttactgacgggcgtgatgttttggatggttcaagcgtaggattcgtagaaactattgagaaagatcttgcagaattgcgtgggaaaggtgttgacgcacagattgcatctggaggaggccgcatgtacgtcacgatggaccgttatgagaatgattgggatgttgtcaaacgaggatgggatgcccaagttcttggagaagctccacacaagtttaagagcgccgttgaagctgtcaaaaaactaagggaacagcccaatgccaatgaccagtacttacctccatttgtcattgttgatgaaaatggaaaggctgtgggtccaatagtagatggtgatgcagttgtaactttcaacttccgagctgatcgaatggttatgcttgctaaggcccttgaatatgaagattttgacaaatttgatcgagttcggttccctaaaatccgttatgctggaatgcttcaatatgatggggagttgaaacttcccagtcattaccttgtgtctcctccagagatagacagaacatctggtgaatatttagtgcataatggtgtccgtacttttgcttgcagtgagactgtcaagtttggacatgtcactttcttctggaatggaaaccgctctgggtatttcgactcgaatttggaggaatatgtggaaattcctagtgattctggaattactttcaatgtacagcccaagatgaaggctttggagattgctgagagggcaaagaaggccatccttagtcgcaggttccaccaggtacgtgttaacctaccaaatagtgacatggtggggcacacgggagatattgaggcaacagtggtggcatgcaaggctgctgatgaagctgtcaagataatcattgatgcaatagagaaagttggtggaatatatcttgttactgcagatcatggcaatgctgaggacatggtcaagaggaacaaatctggggagcctcttcttaaggatggcaatattcaagtgctcacgtctcacactcttaaacccgttcccattgcaatcggaggtcctggactgccagataatgtcaagttccgcgcagatctccctaatggtgggctcgccaatgtagcagcaacttttatcaatctccatggatatgaagcacctagtgactacgagccaagtcttattgaagtaactgacgactgagaagtaactgacgactgggcgaacaatggatcgtcgcctagattttataactccggaggaattccgttaaaacgtaaaacaataaattgaattttggggtcttgaattcattttgatacgcgtgctgtttttcagcttacatttcgattgctgtctgttggaggcagacagaacaatatagctcaaaatttatttttgttagaacta

SEQ ID NO: 5314 - DNA, 2002 bp, Brassica juncea
aaacacacttctctctctcagatctgtctgaacagcttttttccgatcgcatctcaaaacctcagacatggcttccaactccgcctggaaactagatgaccaccccaagctccccaagggcaaaaccatcgccttgatcgtgttagatggctggggtgaatctgcccctgatgagtacaactgcatccacaccgctcccactcccaccatggattctcttaaaaacggacgtcctgatacatggacgttgatcaaagctcatggaactgccgttggactccctagtgaagacgatatgggaaacagtgaggttggtcacaacgctctcggtgctggtcgtatcttcgctcaaggtgctaagctttgcgacattgctcttgcttccggcaaaatctttgacggtgaaggtttcaaatacgtttctgaatctttcgagaagaacactttgcacttcgttggacttctcagtgacggtggtgtccactctcgtctcgaccagctccaattgctgatcaagggttctgctgaacgtggtgctaagagaatccgtgtccatatcctcactgatggtcgtgatgttttggatggttccagtgtcggatttgtggagactcttgaagctgacctcgttaagttgcgtgagaacggtgtggatgctcagattgcgtctggtggaggtcgtatgtacgtgactcttgaccggtacgagaacgactggggtgttgtgaaacgtggttgggatgctcaggtgcttggagaagctccccacaagttcaaaaacgctgttgaagcagtgaagactttgaggaaggagcctggtgctaacgaccagtacttgcctccgtttgtgattgttgatgacgcagggaaagctgttggtcctattgtggacggtgatgcggttgtcaccttcaacttcagggctgatcgtatggttatgcacgccaaggcgcttgagtatgaggactttgacaagtttgatcgtgtgaggttccccaagatccgttacgctggaatgcttgagtatgatggagagctaaagctgccaagccgttaccttgtttctcccccggagattgatagaacctctggtgaatatttgactcacaatggcgtcagtacttttgcttgcagtgagaccgtcaagtttgggcatgtgacattcttctggaatggaaaccgatcaggatatttcaacgagaaactggaggagtatgttgaagtcccaagtgacagtggaatatcattcaatgtccagccgaagatgaaggctttggagattgctgagaaggcaagggacgcgattctaagtggcaagtttgatcaggtgcgagttaacttgccaaatagtgatatggttggacatacaggtgacattgaagccacggttgttgcttgcgaggctgctgatgttgctgtgaagatgatcctagatgcaattgaacaagtgaaaggtatttacgttgtaactgctgatcacggaaacgcagaggacatggttaagagggataaggctgggaagcctgctttggacaaggaagggaagcttcagattctaacctctcacactctcaagccagtgccaattgccattggaggtccaggattgtctgaaggagtgagattccgtaaggatctggagacaccaggacttgcgaatgtagctgcaacagtgatgaacctgcacggatttgtggctcccgctgactacgagcccacactcattgaagttgtggagaagaactgagagccttcttagcttttgaagagagggctgaaactctgaaaactatgttatattgctttccatttaataaggtttacacacaagacaatcatttttgatgttgccttttggccaaacacattgattttggtttaaatgattttccaagcattttcctcgagatctcagccaagagttttttttatgtcaaagaggttaaagattctcactattcgtattcaataaaatttcttgaccaccaaaatcacatcgata

SEQ ID NO: 5315 - DNA, 3007 bp, Eutrema parvulum
atttgcgtgaaaaacaagtggcccatttgatagatgtgggccatcccacaaagattgcctctttttaaaacccgcctcctcctgctcaccaaaccttcacttcgtctttcttctcagatctgttttgatatttttttctattcatcttcttcgattcgattgcatctctaaatcttagctatggctaactcctccgcctggaaactcgatgaccatcccaagctcccaaagggcaaaaccatcgccttaatcgtcttagatggttggggtgaatctgctcctgatcagtacaactgcatccataacgctcctactcctgccatggattctcttaaaaacggagctcctgatacttggacgttgatcaaagcccatggtactgctgttggactccccagcgaagacgatatgggaaacagtgaggttggtcacaacgctctcggtgctggtcgtatctacgctcagggtgctaagctttgtgacatcgctcttgcttccggcaaaatctttgacggcgaaggtttcaaatacatttctgaatctttcgagaagtcaactctgcatttcgttggacttctcagtgacggtggagtccactcccgcctcgatcagctccagttgctgattaagggttctgttgaacgtggtgctaagagaatccgtgtccatattcttactgatggtcgtgatgtcttggatggttcaagtgtcggatttgtggaaactcttgaagccgacctcgctaatttacgtgagaatggtgtggatgctcagattgcatctggtggaggtcgtatgtatgtgaccttggaccgatacgagaacgattgggaagttgtgaaacgaggttgggatgctcaggtcctcggagaagctccccacaaattcaaaaacgctgttgaagcagtaaagacgttgaggaaggaacctggtgcaaatgatcagtatttgcctccgtttgtcatcgtcgatgatgccgggaaagcagtgggtccgattgtggacggtgatgctgttgtcaccttcaactatagggctgatcgcatggttatgcatgccaaggcacttgaatatgaagattttgacaaatttgatcgtgtgaggttcccaaagatccgttacgctggaatgcttcagtatgatggagagctaaagctgcctagccattacctcgtttctcccccggagattgatagaacctctggtgaatatttggctcacaatggcgtccgtacttttgcttgcagtgagaccgtcaagtttgggcatgtcaccttcttctggaatggaaaccgatctggatacttcaacgagaagttagagcagtatgttgaaatcccaagtgacagtgggatatcattcaatgtccagccaaagatgaaagctctggaaattggtgagaaggcgagggacgcaatccttagtggcaagtttgatcaggtgcgagttaacttgccaaatggagatatggtgggtcatacaggtgacattgaagccacggttgttgcatgtgaagctgctgatcttgctgtgaagatgatccttgatgcgatcgaacaagtgaaaggcatttacgttgtgactgctgatcacggaaacgcagaggatatggttaagagagataagtcggggaagcctgctttggataaggaagggaaacttcagattctaacctctcacacactcaagccagtgccaatcgcaattggaggtccaggattgcctgaaggagtgaaattccgtaaggatctggagataccaggacttgctaatgtagctgcaacagtgatgaacctccatggatttgtggctccgtctgactacgagcccaccctaattgaagttgtggagaaaaattgagggcctaactagtattgaagagagggctgaaagaaactctacaaagttatacgttatgtttgctttcaatttaataaggtttacacgcagacttgcatttttcattttggcttttggccaaaaacgttgattttggttttaaatgatatttgagctttttccttctcttccaaaagacctctctagccaagagtataatttttatcaaagagattaaacaacttcaaattgtgtacataaggaacaaaggagatctgacgtattcaaatttcttgaccattgcaaagcattcaacagggaatgtcacaacctttacatagtcatgactcatataaaacttgaaccaatacaaagtcgaactgcgtctccttaaaacttggaaccaatacaaaactcaagttccgagagatgtttacgcagaagcttctgtggctatggctgcgtcctctcccttaacttctttcggattgtgagaatcttcgacatctgcttctttcaatgcttgtgctcggaacctaaccattatctcctctgctttttcaaatgtcgacaacagattcccatagcgtgcttgcagttttcgctccgtctccttttgcttaaccacttcttcctccaaattcttcttcctgaaagatgcagctatctcttcttgcctcttcaatgctttaaagcactctacttctgttccaccaacctcaatctgcttcaaactcgcctctatttggctccacacggtctctgcccttctctgtcaaatggacaaatagtaaatcattaaatataacaccaaactaaagcgtgattcaaccatataatgtagtttcagaattaagataaaggcaatgtggactgtatatatacctcatgaccttttgtataagttttatacttagccttcatgtgttctgccttcttctcatcctcctccattttttttctagcattctccatctccacttgcaaagctgcaactttctctgcgttcacagcaacacttgagagcccgtaagcatttcgggtggggaagtacatgagatcgttcacgcatgtgttgcgagcttctacgaaatcatcaaatgacccattctcgtgtcccattgacacgcaaagaaattgcccctcctcctttatcattttgtcagcc

SEQ ID NO: 5316 - DNA, 2103 bp, Gossypium hirsutum
caacgcttcgccattcactccgttcaccctttttttttcattttgcctgatttttcgagttttagatttcttatataatcaactacctaatcctctcgctctctcaaccacaagctaactagcaaacacccacacatactaacatctatggggagttcagggcagcaagtctcctggaaattggcggatcacccaacacttccaaaggggaagacccttgctctcatcgttctcgatggctggggcgagtacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcggtgcaggtcgcattttcgctcaaggggctaagcttgttgatattgctcttgcctctggaaaaatctatgaaggagaaggattcaagtacataagcgaatgctttgaaaagggaactttgcacctgattggattacttagtgatggtggtgtccattcacgacttgatcaattgcagttgttgctgaagggagctagtgagcgtggtgctaaaagaattcgtgttcatattctcaccgatggtcgtgatgtattggatggttcaagtgtagcctttgtggagactcttgagagtgaccttgcaaaattacgtgagaatggtgttgatgcccggattgcatctggtggaggccgcatgtatgtcacaatggaccgttatgagaatgattgggacgttgtgaaacgaggatgggatgctcaggttcgtggtgaagcccctcacaagtttgcaaatgctgttgaagctgtaaagaaattaagggaaaatgccaatgaccagtacttacctccctttgttattgttgatgagaatgagaaagctgtgggtccaatagaagatggtgatgctgttgttacttttaacttccgagcagatcgaatggttatgcttgcaaaggcactcgagcatcaagatttcgacaaatttgatcgcgtaaaggttcctaaaattcattatgctggaatgcttcaatatgatggtgagttgaagcttccaggccactaccttgtttctccccccgagattgacagaacatccggcgaatatttggtgcacaatggtgtacgtacttttgcgtgcagtgagacagttaaatttggccatgtcacattcttctggaatggaaatcgctccggctatttcaaccctgaaatggaagaatatgcggaaatcccaagtgatgttggcattacattcaatgttcaaccaaaaatgaaggcactggagattggtgaaaaggctagggatgcaattctgagccgcaaatttgaccaggtgcgtgtgaacattccgaatggtgacatggttggtcatactggagatatccaggctactgtcgtggcatgcaaggccgctgatgaagctgtcaagatgatcattgatgccatagagcaagttggtggaatatatgttgtgacagctgaccatggcaatgctgaggacatggtgaagaggaataagtccgggcaacctctttatgacaagagcggcaagctccaaatcctcacttcccacacttgtcagcctgtgcctattgcaatcggaggtccaggattggcagcaggcgttagattcaggaatgatgttccggatggcggacttgcgaatgtggctgcaactgtcatgaacctccatggttatgtagctccaaatgactatgagccaacactcattgaagtagtgaacaattaggcatatgttgcagtcgctgaatgggctaaacgagtttataataaggatatatttggttccaaaaataggttgtattttggtagacatatgtggttttgagtatatttccccaatgtgttgggaaaatttttgggcttcattgcgccgattttaagaaaaccggatcgaatgttgaaatgatttgcactatgaggtctttttatgattgttcgaaatttttaatgcccaaagcttggattattttcgtcaaccatttctcgttgccccttctctatt

SEQ ID NO: 5317 - DNA, 1922 bp, Euphorbia peplus
agagatgggtagctccggtggcgttacatggaagttggcggatcatccaaagcttccgaaggggaagactattgcaatggtggttttggatggatggggtgaagctaaacctgatgaatataattgtattcatgttgctgagacccctactatggattctttcaaaaagactgctcctgagaagtggaggttgattagggctcatggacctgctgtcgggcttcctaccgatgatgatatgggcaatagtgaagttggtcacaacgctcttggtgccggtcggatttacgctcaaggcgcaaagcttgttgaccaagctcttgcctctggaaagatttacgaggatgtgggctttaactacataaaggagtctttcgctaatggtactttgcatctcattggcttattgagtgatggtggagttcactccaggctcgatcagttgcagttgttagtaaaaggtgcggctgaacatggcgctaagagaatccgagttcatgttcttactgatggacgtgatgttatagatggtactagtgttggatttgtggagactcttgtgaaagaccttgcaaatttacgggagaaaggtgttgatgcacaaatagcatctggtggaggccgtatgtacgttacaatggaccgatatgagaacgactggagtgttgttaaacgtggatgggacgcgcaggttcttggtgaagccccatacaagtttaaggatgctgttgaagctgtgaagacattaagacaagagcccaaatccaatgaccagtacctacctccttttgtcatcgttgatgatagcgggaaggctgtgggcccaattgtcgatggtgatgctgttgtcacctttaacttccgtgcagatcgaatgactatgcttgccaaggcacttgaatatgaaaattttgacaaatttgatagagtccgtgtccctaaaatccgttatgctggaatgcttcaatatgacggtgaattgaagcttccgagctattaccttgtatctcctccactgatagaaagaacatctggtgaatatttaacacacaatggggttcatacctttgcttgcagtgagacagtcaagtttggtcatgtcactttcttttggaatggaaatcgctctggttacttcaatgaacaaatggaagaatatgtcgaaattccaagtgatgttggaattacatttaatgtccaaccaaagatgaaggcaatagcgatcgcggagaaggctagggaggccattctcagtggcaaattccaccaggttcgcgttaatataccaaatagtgacatggttggacatacgggagatgttgaagccactgttgtcgcatgcaaggctgctgatgaggccgtcaagattatcgttgatgctatccagcaagtaggtggaatatttgtaattactgcagatcatggcaatgctgaagatatggtgaagagggacaagtccgggaagcctgccaaagataagaacggcaatgttcagatactcacatctcatacccttgagccagttccaattgcaattggaggtcctggattggcatctggtgtccgtttccgcaatgatgttcctgatggtgggcttgctaatgtggctgctaccgtgatgaatctccatggatttgtggctcctgatgactatgagaagaccctgattgaagttgttgattaagtagattaacattattcgataagtcggtatttgatttttgcataaattttggattagcaacagtgaaatgcggaagcttgtattttacaacagattatcaatctgcggaataaattattgagagcctgttagctgggctcctattttggattattgatatacatacatgttatcaactcaaatgttttgactgatgtaattttgtctttgcttttttggtctactctctgttagtgac

SEQ ID NO: 5318 - DNA, 2130 bp, Solanum phureja
ctataatattcttgattttctttgaatatcaacaagtgtaggcctccggtatttcagcccaacaatcccataaagacccctccttcactcctccattgttttctccactacacacctttttgctctctcttctcttctataccgcttaagaatttttaagatctgagatatgggtagttcaggagatgcatggaaattgaaggaccatcctaagcttcctaagggaaagactgttgctgttattgttttggatggttggggtgaggctaaacctaatgagtataacgctatctctgttgctgaaactcctgttatggactccctcaagcagggtgctcctgaacattggagattgattaaggcacatggaaatgctgtggggcttcccacagaggatgatatgggtaacagtgaagttggtcacaatgctcttggtgctggaaggatctttgctcaaggtgcaaagcttgttgacctagcccttgcctctgggaaaatctatgatggagaaggtttcaaatacgttcaagaatgttttgagaaaggaactctgcaccttattggtctcgtgagtgatgggggtgtccactccaggcttgaccaattgctgttgttgctgaaaggtgctgctgagcgcggtgccaaaagaatttgtgtccatgccctcaccgatggacgtgatgttctggatggttctagtgtgggcttcatggagaccctcgagaatgatctagcaaaattacgtgaacaaggtgttgatgcccgggttgcatctggtggaggtcgcatgtatgttaccatggatcgttatgagaatgactgggatgtcgtaaaaagaggttgggatgcacaaattcttggtgaggctccacaccacttcaaggatcccgttgaggcaattaagaagttgaggcaggaacccaatgccactgatcagtacttggccccttttgtgattgttgatgataatggaaagcctgttgggcctattttggatggtgatgctgttgtgactttcaacttcagagcagatcgtatggtcatgcttgcaaaggcccttgaatacgaagattttgacaaatttgatcgtgtacgagtccctaaaatccattatgctggtatgctccaatatgatggtgaattgaagcttccaaacaaataccttgtttctcctccagagattgaccggacatctggggagtatctagtgcgcaatggtgttaggacttttgcttgcagtgagactgttaaatttggtcatgtcaccttcttttggaatggaaaccgttctgggtattttgacgagaaattggaagagtatgtggaaattccaagtgacagtgggattacatttaatgttaagccaaaaatgaaggcactggagattgctgaaaggactagggatgccatccttagccacaaatttgaccaggtacgggtgaacatacctaatagtgatatggtggggcatactggtgacattaaagcaacaattgaagcttgcaaggctgctgatgacggcgtcaagatgatccttgaagctattgaacaagtgggtggaatatttctagttactgctgaccatggaaatgctgaggatatggtcaagagaaacaagaagggcgagccattacttgacaagaatggaaacattcagattctcacttctcacactctcgagcctgttcctattgcaattggtggtcctggactcttacctggtgtgagattccgcacagatctccccaccggtggacttgcaaatgtggctgcaacctttatgaatctgcacggatttgaggcacctagcgattacgagccaaccttgatcgaggttgttgacaactagatatctcatagaccttagggttgaagttttggcgcaaggggaaagcgataatgactgcattctacactttctgtttatctgaataagacatttttgagcttatattaacagaagttgacattctaccacatggccttgtgatgctatgatggaagagtgcgatatactgttcatgttaaaccctgtaatcttttaaggcataacttcgagtttttgtttggtgaacaagaattcgtaatctttcactatgtggcaaaaatacataagctgtttgatgctct

SEQ ID NO: 5319 - DNA, 2038 bp, Brassica rapa
agatcaccctaccatatctcaccacatcacctcttcgtcttcgccaatctccatacgagagcttcctctgtttctccgctgctatgggtagctccggcgacgttaactggaaactcgaggaccaccccaagctccccaaaggcaaaaccatcggactgatcgttctcgacggatggggcgaatccgagcccgatcaatacaattgcatccacaaagctccaactcccgccatggattcactcaaaaacggacgtcctgacacgtggaggctgatcaaagctcacggcacagccgttggtcttcccagcgaggacgatatgggaaacagcgaggttggccataatgctctcggagctgggaggatttacgctcagggtgctaagcttgttgatctcgcgcttgagtccgggaagatttatgaagatgaagggtttaaatacatttctgaggcttttgagaaggggactgtgcatcttattgggcttttaagtgacggtggagttcactctcgcttagatcaagttcagttgctgttgaagggtttcgcagaacgtggcgctaagagaatccgtgttcatatacttactgatggtcgtgatgttttggacgggtctagtgtcagctttgtggagactcttgaaagtgagctcgctgagctacgttccaaaggtgttgatgctcaggttgcctctggtggaggtcgtatgtatgtcacaatggaccgttacgagaatgattggactgttgtgaaacgtgggtgggatgcgcaagtccttggagaagctccccacaaattcaaaaacgctcttgaagcagttaagaaactgagatctgaacctaaagccaatgaccagtacttgccaccgtttgtcattgttgacgacagtgggaaggctgtgggtccaatcgttgatggtgacgcggttgttacgttcaacttccgtgctgatcgaatggtcatgcttgccaaagccctcgagaatgaagattttgacaagtttgatcgcgtacgtttcccaaagattcgttacgcaggaatgctccaatatgatggagagctaaagcttcctagccattaccttgtttctccaccattgattgacagaacgtctggtgaatatcttgcacacaatggcgtccgtacttttgcttgcagtgaaactgtcaagtttggccatgttaccttcttctggaatggaaaccgctctggatatttcaacgagaagctagagaagtacgttgagattccgagtgacagcggaatatcattcaatgaacagccaaagatgaaagcgctggaaattgctgagaaagcaagggacgctatccttagtggcaactttgaccaggtgcgtgttaacctgccaaatggagacatggtgggtcataccggtgatcttgatgctactgttgttgcatgtgaggctgctgatgttgctgtgcggatgattcttgatgccatagaaaaggttggagggatatatgttgtgactgcagatcacggaaatgctgaggacatggttaaaagggacaaagctggcaagcccgctcttgacaaggaaggaaagcttcagattctcacctctcacaccttgaaaccggtgccaattgcaataggaggtcctggtttgtcagcaggagttaggttcagacaggacttggacacaccagggcttgcgaatgtagctgcaacggtgatgaacctccatggatttgtggctccgggcgattatgagccgagtctgattgaagtagtcgacaagtaatgatggtgtggtgatcgttgttccctctgaaagtcccacttgagcttctctaaatcatgattctgtttacgtttcttttttcttttcctcgtgctcttcctttaataaggccctcttgatttttgaggtggcggtagtttagactcgccactatcaactgtctgttctgggtcaagttaaaaactgcatttggatgttttgtttgcacaaactgattctgattttgaaggtttaataataattaaacgaattacataaaattattcgtagga

SEQ ID NO: 5320 - DNA, 2017 bp, Brassica napus
accgtatctcaccacatcaccctcttcgtcttcgccaatctccatacgagagcttcctctgtttctccgctgctatgggtagctccggcaacgttaactggaaactcgaggaccaccccaagctccccaaggggaaaaccatcggactgatcgttctcgacggatggggcgaatccgagcccgatcaatacaattgcatccacaaagctccaactcccgccatggattccctcaaaaacggacgtcctgacacgtggaggctgatcaaagctcacggcacagccgttggtcttcccagcgaggacgatatgggaaacagcgaggttggccataatgctctcggagctgggaggatttacgctcagggtgctaagcttgttgatctcgcgcttgagtccgggaagatttatgaagatgaagggtttaaatacatttctgaggcttttgagaaggggactgtgcatcttattgggcttttaagtgacggtggagttcactctcgcttagatcaagttcagttgctgttgaagggtttcgcagaacgtggcgctaagagaatccgtgttcatatacttactgatggtcgtgatgttttggacgggtctagtgtcagctttgtggagactcttgaaagtgagctcgctgagctacgttccaaaggtgttgatgctcaggttgcctctggtggaggtcgtatgtatgtcacaatggaccgttacgagaatgattggactgttgtgaaacgtgggtgggatgcgcaagtccttggagaagctccccacaaattcaaaaacgctcttgaagcagttaagaaactgagatctgaacctaaagccaatgaccagtacttgccaccgtttgtcattgttgacgacagtgggaaggctgtgggtccaatcgttgatggtgacgcggttgttacgttcaacttccgtgctgatcgaatggtcatgcttgccaaagccctcgagaatgaagattttgacaagtttgatcgcgtacgtttcccaaagattcgttacgcaggaatgctccaatatgatggagagctaaagcttcctagccattaccttgtttctccaccattgattgacagaacgtctggtgaatatcttgcacacaatggcgtccgtacttttgcttgcagtgaaactgtcaagtttggccatgttaccttcttctggaatggaaaccgctctggatatttcaacgagaagctagagaagtacgttgagattccgagtgacagcggaatatcattcaatgaacagccaaagatgaaagcgctggaaattgctgagaaagcaagggacgctatccttagtggcaactttgaccaggtgcgtgttaacctgccaaatggagacatggtgggtcataccggtgatcttgatgctactgttgttgcatgtgaggctgctgatgttgctgtgcggatgattcttgatgccatagaaaaggttggagggatatatgttgtgactgcagatcacggaaatgctgaggacatggttaaaagggacaaagctggcaagcccgctcttgacaaggaaggaaagcttcagattctcacctctcacaccttgaaaccggtgccaattgcaataggaggtcctggtttgtcagcaggagttaggttcagacaggacttggacacaccagggcttgcgaatgtagctgcaacggtgatgaacctccatggatttgtggctccgggcgattatgagccgagtctgattgaagtagtcgacaagtaatgatggtgtggtgatcgttgttccctctgaaagtcccacttgagcttctctaaatcatgattctgtttacgtttcttttttcttttcctcgtgctcttcctttaataaggccctcttgatttttgaggtggcggtagtttagactcgccactatcaactgtctgttctgggtcaagttaaaaactgcatttggatgttttgtttgcacaaactgattctgattttgaaggtttaataataattaaacgaattacataaaa

SEQ ID NO: 5321 - DNA, 2145 bp, Citrus sinensis
ttctctctctgtataatatcacttgtttgtttgttagctttctacggacgcgcgattcgccttcaatccaaaactaattaagagtgaaagatggataactggaaattaaaagagcatccacagctgtcgaggaataacattgtagccgttgtggtgttggatggctggggtgagttcaagcccgacaagtataactgcatccatgtcgccgacactcccaccatggactctttcaagaagtctgcacctgggaggtggaggttgctccgagctcacggtagtgctgtggggcttccaactgaagatgacatgggtaacagtgaagtcggtcataatgcactcggtgctggtcgcatttttgctcaaggtgcaaagcttgttgaccttgctctggcctctgggaaaatctatcaagatgagggatttaattacattaagccgtcttttgaaaccggcacattgcaccttattgggttactgagtgatggtggagtacactctaggcttgatcaacttcagttgttgctaaaaggagctagtgagcgtggtgctaaaagaattcgtcttcatattcttactgacgggcgtgatgttttggatggttcaagcgtaggattcgtagaaactattgagaaagatcttgcagaattgcgtgggaaaggtgttgacgcacagattgcatctggaggaggccgcatgtacgtcacgatggaccgttatgagaatgattgggatgttgtcaaacgaggatgggatgcccaagttcttggagaagctccacacaagtttaagagcgccgttgaagctgtcaaaaaactaagggaacagcccaatgccaatgaccagtacttacctccatttgtcattgttgatgaaaatggaaaggctgtgggtccaatagtagatggtgatgcagttgtaactttcaacttccgagctgatcgaatggttatgcttgctaaggcccttgaatatgaagattttgacaaatttgatcgagttcggttccctaaaatccgttatgctggaatgcttcaatatgatggggagttgaaacttcccagtcattaccttgtgtctcctccagagatagacagaacatctggtgaatatttagtgcataatggtgtccgtacttttgcttgcagtgagactgtcaagtttggacatgtcactttcttctggaatggaaaccgctctgggtatttcgactcgaatttggaggaatatgtggaaattcctagtgattctggaattactttcaatgtacagcccaagatgaaggctttggagattgctgaaagggcaaagaaggccatccttagtcgcaggttccaccaggtacgtgttaacctaccaaatagtgacatggtggggcacacgggagatattgaggcaacagtggtggcatgcaaggctgctgatgaagctgtcaagataatcattgatgcaatagagaaagttggtggaatatatcttgttactgcagatcatggcaatgctgaggacatggtcaagaggaacaaatctggggagcctcttcttaaggatggcaatattcaagtgctcacgtctcacactcttaaacccgttcccattgcaatcggaggtcctggactgccagatgatgtcaagttccgcacagatctccctaatggtgggctcgccaatgtagcagcaacttttatcaatctccatggatatgaggcgcctagtgactacgagccaagtcttattgaagtaactgacgactgagaagtaactgacgactgggcgaacaatggatcgtcgcctagattttataactccggaggaattccgttaaaacgtaaaacaataaattgaattttggggtcttgaattcattttgatacgcgtgctgtttttcagcttacatttcgattgctgtctgttggaggcagacagaacaatatagctcaaaatttatttttgttagaactattactgggtccttcttcatcgtattgttgtcgccgtgaattctcttctcttaagccatccagccatgtagagagcatgtctgggccaaaaaaaccttgtgtttccaaaggccggacttactcatcacaaaaagacagatataaaatatgacaggaagtgttgattttattttctattaataat

SEQ ID NO: 5322 - DNA, 1941 bp, Citrus sinensis
cttgtttgtttgttagctttctacggacgcgcgattcgccttcaatccaaaactaattaagagtgaaagatggataactggaaattaaaagagcatccacagctgtcgaggaataacattgtagccgttgtggtgttggatggctggggcgagttcaagcccgacaagtataactgcatccatgtcgccgacactcccaccatggactctttcaagaagtctgcccctgggaggtggaggttgctccgagctcacggtagtgctgtggggcttccaactgaagatgacatgggtaacagtgaagtcggtcataatgcactcggtgctggtcgcatttttgctcaaggtgcaaagcttgttgaccttgctctggcctctgggaaaatctatcaagatgagggatttaattacattaagccatcttttgaaaccggcacattgcaccttattgggttactgagtgatggtggagtacactctaggcttgatcaacttcagttgttgctaaaaggagctagtgagcgtggtgctaaaagaattcgtcttcatattcttactgacgggcgtgatgttttggatggttcaagcgtaggattcgtagaaactattgagaaagatcttgcagaattgcgtgggaaaggtgttgacgcgcagattgcatctggaggaggccgcatgtacgtcacgatggaccgttatgagaatgattgggatgttgtcaaacgaggatgggatgcccaagttcttggagaagctccacacaagtttaagagcgccgttgaagctgtcaaaaaactaagggaacagcccaatgccaatgaccagtacttacctccatttgtcattgttgatgaaaatggaaaggctgtgggtccaatagtagatggtgatgcagttgtaactttcaacttccgagctgatcgaatggttatgcttgctaaggcccttgaatatgaagattttgacaaatttgatcgagttcggttccctaaaatccgttatgctggaatgcttcaatatgatggggagttgaaacttcccagtcattaccttgtgtctcctccagagatagacagaacatctggtgaatatttagtgcataatggtgtccgtacttttgcttgcagtgagactgtcaagtttggacatgtcactttcttctggaatggaaaccgctctgggtatttcgactcgaatttggaggaatatgtggaaattcctagtgattctggaattactttcaatgtacagcccaagatgaaggctttggagattgctgaaagggcaaagaaggccatccttagtcgcaggttccaccaggtgcgtgttaacctaccaaatagtgacatggtggggcacacgggagatattgaggcaacagtggtggcatgcaaggctgctgatgaagctgtcaagataatcattgatgcaatagagaaagttggtggaatatatcttgttactgcagatcatggcaatgctgaggacatggtcaagaggaacaaatctggggagcctcttcttaaggatggcaatattcaagtgctcacgtctcacactcttaaacccgttcccattgcaatcggaggtcctggactgccagatgatgtcaagttccgcacagatctccctaatggtgggctggccaatgtagcagcaacttttatcaatctccatggatatgaggcgcctagtgactacgagccaagtcttattgaagtaactgacgactgagaagtaactgacgactgggcgaacaatggatcgtcgcctagattttataactccggaggaattccgttaaaacgtaaaacaataaattgaattttggggtcttgaattcattttgatacgcgtgctgtttttcagcttacatttcgattgctgtctgttggaggcagacagaacaatatagctcaaaatttatttttgttagaacta

SEQ ID NO: 5323 - DNA, 1793 bp, Brassica napus
acagcttttttccgatcgcatctcaaaacctcagacatggcttccaactccgcctggaaactagatgaccaccccaagctccccaagggcaaaaccatcgccttgatcgtgttagatggctggggtgaatctgcccctgatgagtacaactgcatccacaccgctcctactcccaccatggattctcttaaaaacggacgtcctgatacatggacgttgatcaaagctcatggaacagctgttggactccctagtgaagacgatatgggaaacagtgaggttggtcacaatgctctcggtgctggtcgtatcttcgctcaaggtgctaagctttgcgacattgctcttgcttccggcaaaatctttgacggtgaaggtttcaaatacgtttctgagtctttcgagaagaacactttgcacttcgttggacttctcagtgacggtggtgtccactctcgtctcgaccagctccaattgctgatcaagggttcagctgaacgtggagctaagagaatccgtgtccatattcttactgatggtcgtgatgttttggatggttcaagcgtcggattcgttgagactcttgaagccgacctcgctaagttgcgtgagaacggtgtggatgctcagattgcgtctggtggaggtcgtatgtacgtgactcttgaccggtacgagaacgactggggtgttgtgaagcgtggttgggatgctcaggttcttggagaagctccacacaagttcaaaaacgctgttgaagcagtcaagactctgaggaaggagcctggcgctaacgaccagtacctccctccgtttgtgatcgttgacgacgcagggaaagctgttggtcctatcgtggacggtgatgcggttgtcacgtttaacttcagggctgaccgtatggttatgcacgccaaggcgcttgagtacgaggactttgacaagtttgaccgcgtgaggttcccaaagatccgttacgctggtatgcttgagtatgatggagagctaaagcttccgagccgttaccttgtttctcccccggagattgatagaacctctggtgaatatttgactcacaatggcgtcagtacttttgcttgcagtgagaccgtcaagtttgggcatgtgacgttcttctggaacgggaaccgatcaggatatttcaacgagaaactggagcagtatgttgaaatcccaagtgacagtggaatctcattcaatgtcaagccaaagatgaaggcattggagattgctgagaaggcaagggacgcgattcttagtggcaagtttgatcaggtgcgagttaacttgccaaacagtgatatggttggacatacaggtgacattgatgcaacggttgttgcttgcgaggctgctgatgttgctgtcaagatgatcctagatgcaattgaacaagtgaaaggcatttacgttgtgactgctgaccacggaaacgcagaggacatggttaagagggataaagctgggaagcctgctttggataaagaagggaagcttcagattcttacctcccacactctcaagccagtgccaattgccattggaggaccaggactgtctgaaggagtgagattccgcaaggatctggagacaccaggacttgcgaatgtagctgctaccgtgatgaacctccatggatttgtggctcccgctgactacgagcccaccctcattgaagttgtggagtagaactgagagccttcttagttttgaaaagaggctgaaactctaaagattacgttgttttgctttccatttaataatgtttactc

SEQ ID NO: 5324 - DNA, 1993 bp, Cedrus atlantica
gttttagatacggctacctatataaatcaacatacaagtattaacacgccaccaaagcattgaatcctcgtttgctttctctgcttaaatacagtgcttttcttcagctccagacattagataagaagatgggcaacaccgatttctcatggaagttggccgatcatcccaagcttccaaaggggaagcagttggctgtgataattttggacggttggggtgaggagaagccggatcagtacaactgtattcatgtagctgagactcccaccatggattctctcaagacgggggctccagagaaatggacactgattaaagcacatggacctgcagttggactccctacagaagatgatatgggtaacagtgaagtaggccacaatgctcttggagctgggagaatatttgctcaaggagcaaaattagtggattatgctcttgcctctggcaaaatctatgagggagaagggtttaaatacattaaggaatgctttgaaaatggtacacttcatcttattggccttttgagtgatggtggtgtccattcacgactagatcagttgcagttgcttttgaaaggtgccgcacaaaatggtgcaaaaaggatccgagtgcatatactcactgatggtcgtgatgttcttgatgggtcaagtttgggtttttagagttactggagagtgatcttgctgagttacagaaacagggtgttgatgcactaattgcctctggtggaggtcgcatgtacgtgacaatggatcgctatgagaatgactggaatgtggtcaaacgagggtgggatgcacaggttttgggaaaagcaccacacaaatttagaagtgctttggaagcagtaaaaagctaagggaggatccgaaagctagtgatcagtacttgcctccttttgtcattgttgatgaaaatgagaaggcagttggacctattcttgatggagatgcagtggtgacgattaattttcgagcagatcgtatgactatggttgctaaagcatttgaatatgagaattttagtgcatttgatcgagttcgatatcctaaaattcgttatgcggaatgcttcagtatgatggagagttaaagcttccatctcattatcttgtttccccaccagatattgatagaacttcaggagaatatctcgtccataatgggatacggacatttgcatgcagtgaaactgtaaaattcggtcatgtgacatttttctggaatggcaaccggtcaggatatttcaacgaggacctggaggaatacgtggaaatcccaagtgattcaggaatcacattcaatgtccagccaaaaatgaaggccttggaaattgctgaaagaacaagagatgctatattgagtggccgttttgatcaggttcgcgtgaatattcctaatggtgatatggtagggcatactggcgatatagaggcaactattgttgcgtgtaaggctgctgacgaggctgtaaagattattcttgatgcaatagaaaatgttggtggcatctaccttgttactgcagatcatggaaatgccgaggatatggtgaaaagatccaaaacaggtcaaccagcgaaggataaagaaggaaaaattcaaattctgacttctcatacttgtaacccagtgccaatttctataggaggtcctggattgacggaaggagcgaggtttcgtactgatttgcgacaacctgggcttgcaaatgttgcctccactgtaattaatctcttgggatttgaggctccaagtgattatgaaccaactttgattgaagttgccagtaattgatttatgaatcaaatatagcagcacagagcaaatgaaatattgttattgttttaatttttggaagccaaggttagcaggtcatttcctaaatttgtcacaattgttctatttttttcgaattcatcccgagagtagatacagtaattgggtagctctgcggctctttttggtatatagtcattattaaa

SEQ ID NO: 5325 - DNA, 2940 bp, Brassica rapa
atttgcgtgaaatacaagtggcccattagtcattacgtgggcccatctccaagcttgactcttattaaaagccgccccttggtcctcaccaaacacacttctctctctcagatctgtctgaacagcttttttccgatcgcatctcaaaacctcagacatggcttccaactccgcctggaaactagatgaccaccccaagctccccaagggcaaaaccatcgccttgatcgtgttagatggctggggtgaatctgcccctgatgagtacaactgcatccacaccgctcctactcccaccatggattcacttaaaaacggacgtcctgatacatggacgttgatcaaagcccatggaacagctgttggactccctagtgaagacgatatgggaaacagtgaggttggtcacaatgctctcggtgctggtcgtatcttcgctcaaggtgctaagctttgcgacattgctcttgcttccggcaaaatctttgacggtgaaggtttcaaatatgtctctgagtctttcgagaagaacactttgcacttcgttggacttctcagtgacggtggagtccactctcgtctcgaccagctccaattgctgatcaagggttcagctgaacgtggagctaagagaatccgtgtccatattcttactgatggtcgtgatgttttggatggttcaagtgtcgggttcgtggagattctcgaagccgacctcgctaagttgcgtgagaacggtgtggatgctcagattgcgtctggtggaggccgtatgtacgtgactttggaccggtacgagaacgactggggtgttgtgaagcgtggttgggatgctcaggttcttggagaagctccccacaagttcaaaaacgctgttgaagctgtgaagactctgaggaaagagcctggcgctaatgaccagtatctccctccgtttgtgatcgttgacgacgcagggaaagctgttggtcctatcgtggacggtgatgcggttgtcacgttcaacttcagggctgaccgtatggttatgcacgccaaggcgcttgagtacgaggactttgacaagtttgaccgcgtgaggttcccaaagatccgttacgctggtatgcttgagtatgatggagagctaaagcttccgagccgttaccttgtttctcccccggagattgatagaacctctggtgaatatttgactcacaatggcgtcagtacttttgcttgcagtgagaccgtcaagtttgggcatgtgacgttcttctggaacgggaaccgatcaggatatttcaacgagaaactggagcagtatgttgaaatcccaagtgacagtggaatctcattcaatgtcaagccaaagatgaaggcattggagattgctgagaaggcaagggacgcgattcttagtggcaagtttgatcaggtgcgagttaacttgccaaacagtgatatggttggacatactggtgacattgatgccacggttgttgcttgcgaggctgctgatgttgctgtcaagatgatccttgatgcaattgaacaagtgaaaggcatttacgttgtgactgctgatcacggtaacgcagaggacatggttaagagggataaggctggaaagcctgctttggataaagaagggaagcttcagattctaacctcccacactctcaagccagtgccaattgccattggaggaccaggattgtctgaaggagtgaggttccgcaaggatctggagacaccaggacttgccaatgtagctgctaccgtgatgaacctccatggatttgtggctcccgctgactacgagcccaccctcattgaagttgtggagtagaactgagagcctttttagttttgaaaagaggctgaaactctaaagattacgttgttttgctttccatttaataatgtttactcggactacatttttgattttggttttccaccaaaaatgtaatgttgatttcggtttaaacgatattcaagccatgagtttttttttatctaagaggttaaagattcacacgatctgtcatactagatcaaatttctcgatcattgcttgcaataagcatacacaactgagaaatatcacaacatttacaaagactcataaaacttgtaaccaaatacaaagtcaagctgcggatccttatataacttggaaacaatacaaaactcaagttctgacagatgtttaagaagaagcttccgtgaatatggtaacgttctcttcctctccagtggctagcttagcttctttcagattgtgagaatcttcaacgtccgcttgtttcaatgcttgtgctcggaacccgaccattatctcttctgctttttcaagcgttgacaacagctccccatagcgcgcttgcagtttccgctccgtctccttttgctttaccacttcttcctccaggttcttcttcctgaaagacgcagccatctcttcttgcctcttcaatgctttaaagcactctacttctgttccaccaatctcaatatgcttcaaactcgcctctatttggctccacacggtctctgcccgtttctgtcaaatgaacaaatagtaaatcattaaacattacaccaaacttaagagcgatcgtacactatagttccagaattcaagataaaggcaatgaggaatatattcatacctcgtgaccctttgtataagttttatacttagccttcatgtgttctgcctttttctcatcttcctccatcttttttctcgcattctccatctctacttgcaaagctgcaactttctctgccttcacagcaacacttgcgggtccgtaagcattacgagtggggaagtacatgagatccttcacgcaatcatcgtgagcttttacgaaatcgtcaagtgtcttgttctcgtttcccattgccacgcaaagaaactgcgcctcctcctttatcattttgtcagcc

SEQ ID NO: 5326 - DNA, 1887 bp, Centaurea maculosa
gccgatcatcccaagcttcccaagggaaagcttgtcgccatgatcgttttggatggctggggtgaagcttcacctgacaagtataactgtatccatgtcgctgagactcctaccatggattctctcaaaaacggagctcctgaaaaatggagattggtgagagctcatggtaccgcggtcggacttccaactgaagatgatatgggaaacagtgaagttggacataatgctcttggtgctggaagaatctttgctcaaggtgcgaaacttgttgatcttgcacttgcctctggaaaaatatatgaagatgaaggtttcaattacatcaaggaatcttttgcgaacaacaccttgcaccttattggattgatgagtgatgggggtgtgcactcacgccttgatcagttacagttgttgctcaggggagctagcgaacgtggtgccaagaagatacgcgttcatgtgcttaccgatggccgtgatgttttggatggttcaagtatcggttttgctgaaacacttgaagcagaactctcagatttgcgcagcaaaggcatcgatgcacaggttgcttctggtggtggacgcatgtatgtcaccatggatcgttatgagaatgattgggaagttgtgaaacgtggttgggatgcccaggttcttggcgaagccccacacaagtttaagaatgttgttgaggctgtcaagaaactcagggaggctcctggtgctaatgaccaatacttgcccccattcgtcattgctgacgaaagtggaaagcctgtgggtcccattgtggatggtgatgccgttgtcactttcaacttccgagctgatcgtatgactatgcttgctcaagctctcgagtatgagaagtttgacaaatttgacagagtgcgtgtccctaagatccgctatgcgggtatgcttcagtatgatggtgagttgaagcttccaaaccactaccttgtatctcctccattgatcgagaggacatctggtgaatatttagtgcacaatggggttcgcactttcgcttgcagtgagactgtcaaatttggtcacgtcacatttttctggaacggaaaccgctctgggtatttcaattcggagttggaagaatatgttgaaattcctagcgatagtggaattaccttcaacgaacaaccaaagatgaaagctttggagattggtgagaaaacccgtgatgctatcctcagtggaaaatttgaccaggtacgtgtgaacataccaaatggtgacatggttgggcatactggtgatgttgaagcgactgttgtggcctgcaaggctgctgatgaagctgttaagatgatccttgatgcagtagagcaagttggtggtatatacgtggtgactgcagatcatggtaatgctgaggacatggttaagagaaacaagaagggagagcctattctcaaggatggcaaggttcagatcctaacatcacacactcttcagccggtgccaattgcaattggaggtccgggattaacatcaggtgctagattccgtaaggatgttccaagtggaggacttgcaaacgtagcagcaaccgtgatgaatctgcatgggtttgtggctcctgatgactacgaaacaactctaattgaagttgttgattaaggagttgattagttttttctgaagatgaaagaaagaaagaaagagacttttgattttgaataatttgaagttactacttatcttcaattttggtgatcaccactttgtaagtgagtggttttacttttagtcagtaatgttgctgctttttatttatttgcagtcacttgattaaaacataatgaatgctattttggaggaaaagtttggaaagctttctttatgaattttgtactaaattcc

SEQ ID NO: 5327 - DNA, 1806 bp, Brassica napus
tctgaacagctttttcccgatcgcatctcaaaacctcagacatggcttccaactccgcctggaaactagatgaccaccccaagctccccaagggcaaaaccatcgccttgatcgtgttagatggctggggtgaatctgcccctgatgagtacaactgcatccacaccgctcctactcccaccatggattctcttaaaaacggacgtcctgatacatggacgttgatcaaagctcatggaacagctgttggactccctagtgaagacgatatgggaaacagtgaggttggtcacaatgctctcggtgctggtcgtatcttcgctcaaggtgctaagctttgtgacattgctcttgcttccggcaaaatctttgacggtgaaggtttcaaatacgtttctgagtcttttgagaagaacactttgcacttcgttggacttctcagtgacggtggagtccactctcgtctcgaccagctccaattgctgatcaagggttctgctgaacgtggagctaagagaatccgtgtccatattcttactgatggtcgtgatgttttggacggttcaagtgtcggattcgtggagactctcgaagccgacctcgctaagttgcgtgataacggcgtggatgctcagattgcgtctggtggaggccgcatgtacgtgactttggaccggtacgagaacgactggggtgttgtgaagcgtggttgggatgctcaggttcttggagaagctccccacaagttcaaaaacgctgttgaagctgtgaagactctgaggaaagagcctggcgctaatgaccagtatctccctccgtttgtgatcgttgacgacgcagggaaagctgttggtcctatcgtggacggtgatgcggttgtcacgttcaacttcagggctgaccgtatggttatgcacgccaaggcgcttgagtacgaggactttgacaagtttgaccgcgtgaggttcccaaagatccgttacgctggcatgcttgagtacgatggagagctaaagcttccgagccgttaccttgtttctcccccggagattgatagaacctctggtgaatatttgactcacaatggcgtcagtacttttgcttgcagtgagaccgtcaagtttgggcatgtgacgttcttctggaatggaaaccgatcaggatatttcaacgagaaactggagcagtatgttgaaatcccaagtgacagtggaatctcattcaatgtcaagccaaagatgaaggcattggagattgctgagaaggcgagggacgcgattctaagtggcaagtttgatcaggtgcgagttaacttgccaaacagtgatatggttggacatacaggtgacattgatgcaacggttgttgcttgcgaggctgcagatgttgctgtgaagatgatcctagatgcaattgaacaagtgaaaggcatttacgttgtgactgctgatcacggaaacgcagaggacatggttaagagggataaggctggaaagcctgctttggataaagaagggaagcttcagattcttacctcccacactctcaaaccagtgccaattgccattggaggaccaggactgtctgaaggagtgaggttccgcaaggatctggagataccaggacttgccaatgtagctgctaccgtgatgaacctccatggatttgtggctcccgcagactacgagcccacccttattgaagttgtggagtagaactgagagccttcttagttttgaaaagaggctgaaactctaaaaattacgttgttttgctttccatttaataatgtttacacagactaca

SEQ ID NO: 5328 - DNA, 1807 bp, Tropaeolum majus
gatggatggggcgaggcaaaccctgataagtataactgcatccacgttgctgagacccccgttatggactctctcaaaaacggtgccccagataagtggagattaattaaagctcatggtactgctgttggccttccaactgaggatgacatgggaaacagtgaagttggtcataatgctctaggtgctggacgcatttacgctcaaggtgcaaagcttgttgatattgctcttgcctctgagaaaatttatgatgaagacggattcaagtacatatctgaatcttttgaaagtggtacattgcacctcattagcttattgagtgatggtggagtccattctcgtattgatcaattgcagttgttgctaaagggagctagcgagcgtggtgctaaaagaatccgtgtccatattctcactgatggacgtgatgttttggatggttccagtgtaggctttgcagaaactcttgagagcgaccttgccaagctacgtgagaatggtattgatgcacaggttgcatctggtggaggtcgaatgtatgtcacaatggatcgttatgagaatgactggagtgttgtgaaaagagggtgggatgcccaagtcctaggggaagccccatacaaatttaagagtgccgttgaagctatcaagacactgaggcaggaacccaaggcaaacgatcagtacttacctccatttgtcattgttgatgacagtgggaaggctgtgggtcctatcgtagatggtgatgctgtagttactatgaacttccgtgcagatcgtatggttatgcttgctaaggcacttgagtatgaaaattttaacaattttgatcgtgtgcgcttccccaaaatccgttacgctggaatgcttcaatatgatggagagttgaagctccctagtcgctatcttgtttctccccctttgattgaaagaacatctggtgaatacttggtgcacaatggtgtccgtacttttgcttgcagtgaaactgtcaagtttggtcatgtcactttcttctggaacggaaaccgctctggatacttcaaggaagacatggaagagtatgtggagattccaagtgacagtggaatcacattcaacgtcaaaccaaaaatgaaggcgcttgaaattgcagagaaggccagagatgctattcttagccgcaagttccagcaggtacgtgtcaacctacctaacagtgacatggtagggcataccggagacattgaggctacagttgttgcatgtaaggctgccgatgaggcggtcaagatgatcattgatgccatagaacaagtgagtggtatatatgtggtcactgcagatcatgggaatgctgaggacatggtaaagagagataaggctgggaagcctgctatggacaagagtgggaacattcagatactcacttctcatactctacagccagtgccggttgcaattggaggccctggattggcttctggtgttagatttcgcaaggatgtaccaacaggcggacttgctaatgttgctgctactgttatgaacctccacgggtatatagcacctgatgactatgagacaactctgattgaagtggtagatgcctagaatgatctgattagtttgattgttgcctagacttgaagttggaaataagcaacaattctatattactgttttgtttggagttcactttttggttactggtggaggcagacagaaaagtagttaaattatgagttactactccttgtactgtgtgattgatttcattatcacaaatagttgttttgatacttgtgatagtttttagttg

SEQ ID NO: 5329 - DNA, 1926 bp, Raphanus sativus
  misc_feature (190)..(190): n is a, c, g, or t
  misc_feature (196)..(196): n is a, c, g, or t
  misc_feature (232)..(232): n is a, c, g, or t
  misc_feature (391)..(391): n is a, c, g, or t
  misc_feature (394)..(394): n is a, c, g, or t
  misc_feature (478)..(478): n is a, c, g, or t
  misc_feature (1717)..(1717): n is a, c, g, or t
  misc_feature (1903)..(1903): n is a, c, g, or t
aggacacttctctctcccagatctgtctcaaacacctctttttccgatccaatctcaaaacctcagagctatggctaccaactggaaactcgatgaccatcccaagctccccaagggcaagaccgtcgccatgatcgtcttagatggctggggtgaatctgcccctgatgagtacaactgcatccacacngctccnactcccaccatggattctcttaaaaacggacgtccngatacatggacgttgatcaaagctcatggaacagctgttgggctccccagcgaggacgatatgggaaacagtgaggttggtcacaacgctctcggtgctggtcgtatcttcgctcaaggtgctaagctttgcgacattgctcttgcttccggcaaaatnttngacggtgaaggtttcaagtacgtctctgaatctttcgagaagaacactttgcacttcgttggtcttctcagcgacggtggagtncactctcgtctcgaccagctccaattgctgatcaagggttctgctgaacgtggtgctaagagaatccgtgtccacattctcactgacggtcgtgatgttttggatggttcaagtgtcggattcgtggagactcttgaagccgacctcgctaagttgcgtgagaacggtgtggatgctcagattgcttccggtggaggtcgtatgtacgtgaccttggaccgttacgagaacgactggggtgttgtgaagcgtggttgggatgctcaggtgctcggagaagctccccacaagttcaaaaacgctgttgaagctgtcaagacgctgaggaaggagcctggcgctaacgaccagtacttgcctccgtttgtgattgttgatgaggcagggaaagctgttggtccgatcttggatggtgatgcggttgtcaccttcaacttcagggctgaccgtatggtgatgcacgccaaggcgcttgagtatgaggactttgacaagtttgaccgtgtgaggttccctaagatccgttacgctggtatgcttgagtatgatggagagctaaagctgccgagccgttaccttgtttctcccccggagattgatagaacctctggtgaatatttgactcacaatggcgtcagtacttttgcttgcagtgagacggtcaagtttgggcatgtgacattcttctggaatggaaaccgatctggatatttcaacgagaaactggagcagtatgttgaaatcccaagtgacagtggaatctcgttcaatgtcaagccaaagatgaaggctttggagattgctgagaaggcaagggacgcaattctaagtggcaagtttgatcaggtgcgagttaacttgccaaacagtgatatggttggacatacaggtgacattgaagccacggttgttgcttgcgaggctgctgatgttgctgtcaagatgatcctagatgcaattgaacaagtgaaaggtatttacgttgtaactgctgatcacggaaacgcagaggacatggttaagagggacaaggctgggaagcctgctttggacaaagaagggaaccttcagattctaacctcccacaccctcaagccagtgcctattgccattggaggtccaggattgtctgaaggagtgagattccgtaaggatctggagacaccaggacttgcgaatgtagctgctaccgtgatgaacctccatggatttgtggctcccgctgactacgagcccacnctcattgaagttgtggagaagaactgagagccttcttagcttttgaagagagggctaaaactctgaaacgatgttatattgttttccatttaataaggttttacacacgagacaagcatttttgaatttgcctttttggccaccaaacacattgattttggtttaaatgatattcaagctttctcnttaatatctctagccagatttct

SEQ ID NO: 5330 - DNA, 1960 bp, Sciadopitys verticillata
ctgaggcttcaatttcacggtatgggcagcacagatttctcatggaagttggccgattctcctaagttcccaaaggggaagcagttggccgtgatagttttggacggatggggcgaagagaagcccgatcagtacaattgcatccacgttgccgagacgcctaccatggattctctcaagaagggggctccagagaagtggacactgatcaaagcacatggacctgcagttggactccctacagaagatgacatgggcaacagtgaagtaggtcacaatgctctcggagctgggagaatatttgcgcaaggggctaaattagtggatcaggctattgaatcgggcaaaatctatgatggagaagggttcaagtacattaaggaatgctttgaaaatggcacacttcatctcattggtcttttgagtgatggtggtgttcattcaagaatagatcagttgcagttgcttttgaaaggttctgcaaaaaatggcgcgaaaagaatccgagtgcatattctcaccgatggtcgtgattgtcttgatggatctagtgttggttttgtcgagacactagagaacgatcttgctgagttatgtaaacagggtgttgatgcacggattgcctctggtggtggtcgtatgtatgtcacaatggatcgttacgagaatgattggggtgtggtcaagcgaggctgggatgcacaggttttgggagaagcaccccataaattcagaagtgcagtggaagcagtcaaaaagctcaggcaggctcctaaggctagtgatcagtatttgcctccctttgtcatcgtcgatgaaaatgagaaagcagttggacctattctagatggagatgcagtagtaaccattaattttcgagcagatcgtatgactatggttgcgaaagcatttgaatatgaaaattttagcgcatttgatcgagttcgttatccaaaaattcattatgcaggaatgctacaatatgatggagaattaaagttgccaagtcattatctggttaacccaccagatattgatagaacatcaggagaatattttgttcataatggcatccgaacatttgcatgcagtgaaacagtaaagtttggtcatgttacatttttctggaatgggaaccggtcagggtattttaatgaggaccttgaagagtatgtagagatcccaagtgattcaggaattacattcaatgccaagccgaagatgaaagctttagaaattgctgaaaagacaagagatgctattttgagtcgcaagtttgatcaggttcgtattaatttgcctaatggtgacatggttggacacactggtgatattgaggcaacggttgttgcatgtaaagctgctgatgaggctgtaaagatagtccttgatgcagtagaacaagttggtggcatttaccttgttacagcagatcatggaaatgccgaggaaatggtgaaaagaaataccaaaactggtcaaccccagctggataaagatggaaaaattcaagttcttacttctcatacctgttctccggtaccgattgccataggaggtcctggactgaaggaaggagtaaggttccggactgatttgaaacagcctgggcttacaaatgtggcggccactatgatgaatcttttgggattcgaggctcccagtgattatgaaccgactttgattgaagttgtgtaaagttgatcagtgaatcaactctagagcacaaaactaatcagtgatttcatttctcttgatttttggaagccatggttaggaagacaattgcttaccaagagtttatccagtgactggatagctctggtttctttttgtaggattttatatattaaagcaattcgtatttaagtaataagtcatcaagatatgctttttaatatgatgacaatatagatttgagtaaagataaacctgaagagattatgcatttggggatgtc

SEQ ID NO: 5331 - DNA, 1828 bp, Secale cereale
tcctccgccactccgctctccgaaaagttcttcttgttccgcaaaccacacgaagaaaaaagcaaaggagatggcgaccacgaattggacgctccccgaccaccccacgctcccaaacgggaaggacggtggccgtcgtcgtgctcgacggatggggcggaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggcgcgaagcttgttgatgctgctcttgcttctgggaagatttgggaagacgaggggttcaattacatcaaagaatcttttgacaagggtactctgcaccttattggtttgttgagtgatggaggcgtccactccaggctagaccaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcctccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgtgttcgtgtaccaaaaattaagtacgctgggatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgatgagaccagggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacacttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaacactgtgctctctgaagccaaaattgctgtagccaattttgtcgctatagttttgggtgggtgaatgtcgcatcgt

SEQ ID NO: 5332 - DNA, 2200 bp, Abies balsamea
gatttgaactaatattattgatttggatttctttggtgtattcatacgcgtgttggattcctttgctgaaacatatcgggcatgtggatttttcttgatctaggttaggggctggtggattttgagttatggaaatatattttgacgattatttttttttttaggttgtgatataaaagatgggcagcaccgatacctcattgaagttggccgatcatcccaagcttcctaaggggaagcagttggctgtgataattttggacggttggggtgaggagaaacctgatcaatacaactgtattcatgttgccgagactcctaccatggattctctcaagacgggggctccagagaaatggacactgattaaagcacatggacctgccgttggactccctacagaagatgatatgggtaacagtgaagtaggccacaatgctcttggagctgggagaatatttgctcaaggagcaaaattagtggattatgctcttgcctctggcaaaatctactcgggagaagggtttaattacatcaaggaatgctttgtaaatggtacccttcatctcattggccttttgagtgatggtggtgttcattcacgactagatcagttgcagttacttttgaaaggtgctgcacaaaatggtgcaaaaaggatcagagtgcatatcctcaccgatggtcgtgattgtctagatgggtcaagttttggttacgtagagacactagagagtgatcttgctgagttacggaaacagggtgttgatgcactaattgcctctggtggaggtcgcatgtatgtgacaatggatcgctatgagaatgattggagtgttgtgaaacgaggctgggatgcacaggttttgggacaagcacctcataaatttagaaatgctttggaagcagtcaaaaagcttagggaggatccgaaaattaatgatcagtacttgcctccttttgtcattgttgatgaaaatgacaaggcagttggacctattcttgacggagatgcagtggtgaccattaattttcgagcagatcgtatgactatggttgctaaagcattcgaatatgaggattttagtgcatttgatcgagtacgatatcctaaaattcgttatgcaggaatgcttcagtatgatggggagttaaagcttccagctcattatcttgtttccccaccagatattgatagaacatcaggagaatatctcgtccataatgggatacggacattcgcatgcagtgaaactgtaaaattcggtcatgttacatttttctggaatggcaaccggtcaggatatttcaacaaggacctggaggaatatgtggaaatccctagtgattcaggaatcacattcaatgtcaagccaaaaatgaaggccttggagattgctgagaaaactagagatgctatattgagtggccgttttgaccaggttcgtgtgaatctgcctaatggtgacatggtagggcatactggtgatattgatgcaactattattgggtgtaagtcggctgacgaggctgtaaagattattcttgatgcaatagaacaagttggtggcatctaccttgttactgcagatcatggaaatgccgaggatatggtgaagagaaattccaaaacaggacaaccagagaagggtaaagatggaaagattcaaattctgacttcgcatacttgtaacccagtgccaattgctataggaggtcctggactgacgcaaggagtgaggtttcgtactgatttgaaacaacctgggcttgcaaatgttgcctccaccataattaatctcttgggatttgaggctccaagtgattatgaaccaactttgattgaagttgccaacaattgatttatgaatcaaatatggcagcacagagaaaatcaaataatgttattgttttaatttttggaagccaaggttagcatgtcatttcctaaatttttccaattgttctgttctcttagaattcaacccgagagtaaattactaaatacagtaattgggtagctctgcggctttttggtatatattcattagaaaagtctgagcagcatacttattcaaatgagaatttatcgagatacttatgatatttaaatccatgatggtggatggttgaagttctgcacatgggaatgatcctttgttgcaagaggaaattaaataaagttcaaccttaattttgt

SEQ ID NO: 5333 - DNA, 1951 bp, Brassica juncea
tcggggtacttctcttctctcagatctgtctcaaacaccttttttcgatccaatttcaaaacctcagaaagctatggctaccaactggaaactcgatgaccaccccaagctcccaaagggcaaaaccatcgccttgatcgtcttggatggatggggtgaatctgcccctgatgagtacaactgcgtccacaccgctcccactcccaccatggattctcttaaaaacggacgtcctgacacgtggacgttgatcaaagctcatggaactgccgtggactccccagcgaagatgacatgggaaacagtgaggttggtcacaacgctcttggtgctggtcgtatcttcgctcagggtgctaagctttgcgacattgctcttgcttccggcaaaatctttgacggtgaaggtttcaaatacgtctctgaatctttcgagaagaacactttgcacttcgttggacttctcagtgacggtggagtccactctcgtctcgaccagctccaattgctgatcaagggttctgctgaacgtggtgctaagagaatccgtgtccatattctcactgatggtcgtgatgttttggatggttccagtgtcggatttgtggagactcttgaagctgatctcgttaagttgcgtgagaacggtgtggatgctcagattgcgtctggtggaggtcgtatgtacgtgactcttgaccggtacgagaacgactggggtgttgtgaaacgtggttgggatgctcaggtgcttggagaagctccccacaagttcaaaaacgctgttgaagcggtgaagactttgaggaaggagcctggtgctaacgaccagtacttgcctccgtttgtgattgttgacgacgcagggaaagctgttggtcctattgtggacggtgatgcggttgtcaccttcaacttcagggctgatcgtatggttatgcacgccaaggcgcttgagtacgaggactttgacaagtttgaccgtgtgaggttcccaaagatccgttacgctggtatgcttgagtatgatggagagctaaagctgccgagccgttaccttgtttctcccccggagattgatagaacctctggtgaatatttgactcacaatggcgtcagtacttttgcttgcagtgagaccgtcaagtttgggcatgtgacattcttctggaatgggaaccgatcaggatatttcaacgagaaactggaggagtatgttgaagtcccaagtgacagtggaatctcattcaatgtcaagccaaagatgaaggctttggagattgctgagaaggcaagggacgcaattctaagtggcaagtttgatcaggtgcgagttaacttgccaaatagtgatatggttggacatacaggtgacattgaagccacggttgttgcttgcgaggctgctgatgttgctgtgaagatgatcctagatgcaattgaacaagtgaaaggtatttacgttgtaactgctgatcacggaaacgcagaggacatggttaagagggataaggctgggaagcctgctttggacaaggaagggaagcttcagattctaacttctcacactctcaagccagtcccaattgccattggaggtccaggattgtctgaaggagtgagattccgcaaggatctggagacaccaggacttgcgaatgtagctgcaacagtgatgaacctgcacggatttgtggctcccgctgactacgagcccaccctcatactgagagccttcttagcttttgaagagagggttgaaactctgaaaactatgttatattgttttccatttaataaggtttacacacaagacaatcatttttgatgttgccttttggccaaacacattgatttttgtttaaatgattttccaagcattttcctcgagatctcagccaagagttttttttatgtcaaagaggttaaagattctcactattcgtattcaa

SEQ ID NO: 5334 - DNA, 1892 bp, Centaurea maculosa
  misc_feature (3)..(3): n is a, c, g, or t
  misc_feature (588)..(588): n is a, c, g, or t
  misc_feature (681)..(681): n is a, c, g, or t
  misc_feature (714)..(714): n is a, c, g, or t
  misc_feature (756)..(756): n is a, c, g, or t
  misc_feature (768)..(768): n is a, c, g, or t
  misc_feature (771)..(771): n is a, c, g, or t
  misc_feature (773)..(773): n is a, c, g, or t
  misc_feature (810)..(810): n is a, c, g, or t
  misc_feature (834)..(834): n is a, c, g, or t
  misc_feature (855)..(855): n is a, c, g, or t
  misc_feature (864)..(864): n is a, c, g, or t
  misc_feature (1217)..(1217): n is a, c, g, or t
  misc_feature (1238)..(1238): n is a, c, g, or t
  misc_feature (1283)..(1283): n is a, c, g, or t
  misc_feature (1328)..(1328): n is a, c, g, or t
  misc_feature (1807)..(1808): n is a, c, g, or t
  misc_feature (1864)..(1864): n is a, c, g, or t
ttngccgatcatcccaagcttcccaagggaaagcttgtcgccatgatcgttttggatggctggggtgaagcttcacctgacaagtataactgtatccatgtcgctgagactcctaccatggattctctcaaaaacggagctcctgaaaaatggagattggtgagagctcatggtaccgcggtcggacttccaactgaagatgatatgggaaacagtgaagttggacataatgctcttggtgctggaagaatctttgctcaaggtgcgaaacttgttgatcttgcacttgcatctggaaagatatatgaagatgaaggtttcaattacatcaaggaatcttttgcgaacaacaccttgcaccttattggattgatgagtgatgggggtgtgcactcacgccttgatcagttacagttgttgctcaggggagctagcgaacgtggtgccaagaagatacgtgttcatgtgcttaccgatggccgtgatgttttggatggttcaagtatcggttttgctgaaacacttgaagcagaactctcagatttgcgcagcaaaggcatcgatgcacaggttgcttctggtggtggncgcatgtatgtcaccatggatcgttatgagaatgattgggaagttgtgaaacgtggttgggatgcccaggttcttggcgaagccccacacaantttaagaatgttgttgaggctgtcaagaaactnagggaggctcctggtgctaatgaccaatacttgcccccattngtcattgctganganantggaaagcctgtgggtcccattgtggatggtgatgcngttgtcactttcaacttccgagcngatcgtatgactatgcttgcncaagctctngagtatgagaagtttgacaaatttgacagagtgcgtgtccctaagatccgctatgcgggtatgcttcagtatgatggggagttgaagcttccaaaccactacctagtatctcctccattgatcgagaggacatctggtgaatatttagtgcataatggggttcgcacttttgcttgcagtgagactgtcaaattcggtcatgtcacatttttctggaacggaaaccgctctgggtatttcaattcggagttggaagatatgttgaaattccaagtgatagtggaattaccttcaacgaacaaccaaagatgaaagctttggagattggtgagaaaacccgtgatgctatcctnagtggaaaatttgaccaggtncgtgtgaacataccaaatggtgacatggttgggcatactggtgangttgaagcgactgttgtggcctgcaaggctgctgatgaagctgtnaagatgatccttgatgcagtagagcaagttggtggtatatacgtggtgaccgcagatcatggtaatgctgaggacatggttaagagaaacaagaagggagagcctattctcaaggatggcaaggttcagatcctaacatcacacactcttcagccggtgccaattgcaattggaggtccgggattaacatcaggtgctagattccgtaaggatgttccaagtggaggacttgcaaacgtagcagcaaccgtgatgaatctgcatgggtttgtggctcctgatgactatgaaacaactctaattgaagttgtcgattaaggagttgattagttttttctgaagatgaaagaaagaaaggaagaaagagactttttgattttgaataatttgaagttactacttatttccaattttggtgatcaccactttgtaagtgagtggttttacttttagtcagtaatgttgctgctttttatttnnttgcagtcacttgattaaacataatgaatgctattttggaggaaagtttggaaagntttctttatgaattttgtactaaattcc

SEQ ID NO: 5335 - DNA, 1832 bp, Flaveria ramosissima
ttgcttcattttcgaacacaatcgaagatctagagtacaacttccgatcgaatggggagcacaggattctcatggaaattagccgatcatccgaagctaccgaagggaaaactagtggcgatgatcgttttggacggttggggtgaagcttctcccgataagttcaactgtattcatgtcgccgagactccaaccatggattctctaaaaaacggcgcccctgataaatggagattggtgagggctcatggtactgctgttgggcttcccactgaggatgacatgggaaacagtgaagttggacataatgctcttggtgctggaaggatctttgctcaaggtgacaaactcgtagatcttgctcttgcatctaggaaaattatttgaagatggtaagggtttaattatatacaaagaattctttgcaacaaacaccttgcaccttattggattgatgagtgacggggtgtgcactcacgccttgatcagttacagttgttgctccgaggagctagccagcatggtgccaagagaattcgtgttcatgtgcttactgatggacgtgatgtgttagatggttcaagtgttgggtttgctcaaatacttgatgcagaactttcagatctacgcagcaaaggcattgacgcacaggtggcatctggtgggggccgcatgtatgtgacaatggatcgctatgagaatgattgggaagttgtgaaacgtggttgggatgctcaggttcttggtgaagccccacacaaatttaaaaatgttgttgaggctatcaagacacttagagagtcccctggtgctaatgaccagtacttgcccccatttgtcatagttgatgacagtggaaagcctgtgggtcccattgtggatggtgatgctgttgtcacttttaacttccgggcagatcggatgactatgctcgcccaagctcttgaatatgagaaatttgataaatttgacagagtgcgggtcccaaaaaatccggtatgggggtatgcttcagtacgatggggagttgaagcttccaagtcactatcttgtatctcctccattgatagaaaggacatccggagagtatttggttgcataatggggtccggtacttttgcttgcagtgaaactagttcaagttttgggcgatgtcacatttttctggaacggaaaccgttctggattattttaattcggagttggaagaatatgttgaaattccaagtgatagtggaattacctttaacgttcaaccaaaaatgaaagctttggagattggtgagaaggctcgtgatgctatcctcagtggaaaatttgaccaagtgcgtgtgaacataccaaatggtgacatggttgggcataccggtgatgttgaggctactgttgtggcttgcaaggctgctgatgaagctgttaagatgattcttgatgcagtagaacaagtgggtggaatatatgtggtgactgctgatcatggtaatgcggaagacatggttaaaagaaacaaaaagggtgagcctattctcaaggatggtgaggttcagatcctgacatcacacactcttcagccggtgccaatcgcaattggggggccggggttagcaccgggtgtgaaattccgcaaggacgtgccgagtggtgggctagcaaatgtagcagcaacggtgatgaatttgcatgggtttgttgcacctgatgactatgagacaactcttattgaagtagttgattgaggataaaaaaaaggtggttttgactttactttgaccccacgtgttttaataatttgatggaaatagttaaaacatatatgacaatatgttttgtta

SEQ ID NO: 5336 - DNA, 1887 bp, Brassica juncea
acttctcttctctcagatctgtctcaaacacctttttttcgatccaatctcaaaacctcagaaagctatggctaccaactggaaactcgatgaccatcccaagctccccaagggaaaaaccatcgccttgatcgtcttggatggctggggtgaatctgcccctgatgagtacaactgcatccacaccgctcccactcccaccatggattctcttaaaaacggacgtcctgatacatggacgttgatcaaagctcatggaacagccgttggactccccagcgaagatgacatgggaaacagtgaggttggtcacaacgctcttggtgctggtcgtatcttcgctcagggtgctaagctttgcgacattgctcttgcttccggcaaaatctttgacggtgaaggtttcaaatacgtctctgaatctttcgagaagaacactttgcacttcgttggacttctcagtgacggtggtgtccactctcgtctcgaccagctccaattgctgatcaagggttctgctgaacgtggtgctaagagaatccgtgtccatatcctcactgatggtcgtgatgttttggatggttccagtgtcggatttgtggagactcttgaagccgacctcgctaagttgcgcgagaacggtgtggatgctcagattgcctctggtggaggtcgcatgtacgtgactttggaccggtacgagaacgactggggtgttgtgaaacgtggttgggacgcacaggtgcttggagaagctccccacaagttcaaaaacgctgttgaagctgtgaagactctgaggaaggagcctggcgctaacgaccagtacctccctccgtttgtgattgttgacgacgcagggaaagctgttggtcctatcgtggacggtgatgcggttgtcacgttcaacttcagggctgaccgtatggttatgcacgccaaggcgcttgagtacgaggactttgacaagtttgaccgtgtgaggttccctaagatccgttacgctggtatgcttgagtatgatggagagctaaagctgccgagccgttaccttgtttctcccccggagattgataggacatctggtgaatatttgactcacaatggcgtcagtacttttgcttgcagtgagaccgtcaagtttgggcatgtgacattcttctggaacgggaaccgatcaggatatttcaacgagaaactggagcagtatgttgagatcccaagtgacagtggaatctcattcaatgtcaagccaaagatgaaggctttggaaattgctgagaaggcaagggacgcaattcttagtggcaagtttgatcaggtgcgagttaacttgccaaacagtgatatggttggacatacaggtgacattgatgccacggttgttgcttgcgaggctgctgatgttgctgtcaagatgatcctagatgcaattgaacaagtgaaaggcatttacgttgtgactgctgatcacggaaacgcagaagacatggttaagagggataaggctgggaagcctgctttggataaagaagggaagcttcagattctaacctcccacactctcaagccagtgccaattgccattggaggaccaggattgtctgaaggagtgaggttccgcaaggatctggagacaccaggacttgccaatgtagctgctaccgtgatgaacctccatggatttgtggctcccgctgactacgagcccaccctcattgaagttgtggagaagaactgagagccttcttagtttttgaagagagggctgaaactctgaaaactatgttatattgctttccatttaataaggtttacacagaagacaagcattttttatgttgccttttggccaaactcattgattttggtttaaatgatatcaag

SEQ ID NO: 5337 - DNA, 1753 bp, Centaurea maculosa
atggcgaccaattggaagttggccgatcatccgaagctaccgaaagggaagatcatcgccgtcgtcgttttggacggttggggagaagcctcgccggataaattcaactgcatccatgtcgctgaaactccgaccatggattctttcaaaaaaagtgctccggataggtggagattggtgaaggctcatggaactgctgttggacttccgaccgatgatgatatggggaacagtgaagtcggacataatgctcttggtgccggacgaatatatgctcaaggtgcaaaactcgtggatcttgctcttgcctcggggaaaatatatgaagatgaaggtttcaattacatcaaggaatcttttgcaaataacaccttgcaccttattggattattgagtgatgggggagtgcactcccgccttgatcagctacagttgctgcttaaaggtgccagtgaacgtggtgccaagaggatacgtgttcatgtacttactgatggccgtgatgttgtggatggtacaagcgtaggctttgccgagacacttgaaaaggaccttgcggagctacgtggtaaaggcattgatgcacaggttgcttctggtggagggcgcatgtatgtcaccatggaccgttatgagaacgattgggaagttgtgaaacgtgggtgggatgctcaggttcttggtgaagccccacacaaatttaaaaatgctgttgaggctatcaagaagcttagggaagctccaaatgctaatgatcagtatctacccccatttgtgattgttgatgagagtgggaagcctgttggtcccataatggatggtgatgctgttgtcacattcaacttccgggcagatcgcatgacgatgcttgcccaagctcttgaaaatgaaaagtttgataaatttgacagagtgcgcttccccaaaatccgctatgccggaatgcttcaatatgatggagagttgaagcttccaagtcactaccttgtttctcctccattgatagagaggacatctggtgaatatctagtgcataatggtatccgcacttttgcttgcagtgaaacagtcaaatttggtcatgtgacattcttctggaacgggaaccgctctggatattttaattcggacttggaggagtacgtggaaatcccaagtgatagcggtattaccttcaatgtacaaccaaagatgaaggctttggagattggtaagaaggcccgtgatgctatcctcagtcgtaaatttgaccaggtgcgggtgaatataccaaatggtgatatggttgggcatacgggagacattgaggctacggttgtggcctgcaaggctgctgatgaagctgttaagatgattattgatgcagtgacagaagtgggtggaatatatgtggtgactgctgatcatggtaatgcagaggacatggtgaagagaaacaagaagggggagcctcttgttggtaaagatggcaaagttcagattcagacctcacatacccttcaaccggtgccggttgcaattggaggtccgggattagcaggaggtgtgaagttccggaaggacgtaccaaatggtggactagcaaacgtagcggcaacggtgatgaatctgcatgggtttgtggctcctgatgattatgagaccacccttattgaagttgtttgattaacaaaaccagcctttcttttgttttatttttattgctatgtattacaatttgtgatatcaacccattcaattatcacattttcag

SEQ ID NO: 5338 - DNA, 1820 bp, Brassica napus
cggcacgagggtctgaacagctttttttcgatcgcatctcaaaacctcagctatggctaccaactccgcctggaaactagatgaccaccccaagctccccaagggcaaaaccatcgccttgatcgtcttagatggctggggtgaatctgcccctgatgagtacaactgcatccacaccgctcctactcccaccatggattctcttaaaaacggacgtcctgatacatggacgttgatcaaagctcatggaactgctgttggactccctagtgaagacgatatgggaaacagtgaggtcggtcacaatgctctcggagctggtcgtatcttcgctcaaggtgctaagctttgcgacattgctctcgcttccggcaaaatcttcgacggtgaaggcttcaaatatgtctctgagtctttcgagaagaacactttgcacttcgttggacttctcagtgacggtggagtccactctcgtctcgaccagctccaattgctgatcaagggttccgctgaacgtggtgctaagagaatccgtgtccatattcttactgatggtcgtgatgttttggatggttcaagtgtcggattcgtggagattctcgaagccgacctcgctaagttgcgcgagaacggtgtggatgctcagattgcctctggtggaggtcgtatgtacgtgactctggaccggtacgagaacgattggggtgttgtgaagcgtggctgggacgctcaggtgcttggagaagctccccacaagttcaaaaacgctgttgaagctgtcaagactctgaggaaggagcctggcgctaacgaccagtacctccctccgtttgtgattgttgacgacgcagggaaagccgttggtcctatcgtggacggtgatgcagttgtcacgttcaacttcagggctgaccgtatggttatgcacgccaaggcgcttgagtacgaggactttgacaagtttgaccgcgtgaggttcccaaagatccgttacgctggtatgcttgagtatgatggagagctaaagcttccgagccgttaccttgtttctcccccggagattgatagaacctctggtgaatatttgactcacaatggcgtcagtacttttgcttgcagtgagacggtcaagtttgggcatgtgacattcttctggaatggaaaccgatcaggatatttcaacgagaaactggagcagtatgttgaaatcccaagtgacagtggaatctcattcaatgtcaagccaaagatgaaggcattggagattgctgagaaggcgagggacgcgattctaagtggcaagtttgatcaggtgcgagttaacttgccaaacagtgatatggttggacatacaggtgacattgatgcaacggttgttgcttgcgaggctgcagatgttgctgtgaagatgatcctagatgcaattgaacaagtgaaaggcatttacgttgtgactgctgatcacggaaacgcagaggacatggttaagagggataaggctggaaagcctgctttggataaagaagggaagcttcagattcttacctcccacactctcaaaccagtgccaattgccattggaggaccaggactgtctgaaggagtgaggttccgcaaggatctggagataccaggacttgccaatgtagctgctaccgtgatgaacctccatggatttgtggctcccgcagactacgagcccacccttattgaagttgtggagtagaactgagagccttcttagttttgaaaagaggctgaaactctaaaaattacgttgttttgctttccatttaataatgtttacacagactacattt

SEQ ID NO: 5339 - DNA, 1760 bp, Cirsium arvense
ggttaacaatggcgaccaattggaagttggccgatcatccgaagctaccgaaagggaagatcatcgccgtcgtcgttctggacggttggggagaagcctcgccggataaattcaactgcatccatgtcgctgaaactccgaccatggattctttcaaaaaaagtgctccggataggtggagattggtgaaggctcatggaactgctgttggtcttccgaccgatgatgatatggggaacagtgaagtcggacataatgctcttggtgccggacgaatatatgctcaaggtgcaaaactcgtggatcttgctcttgcctcggggaaaatatatgaagatgaaggtttcaattacatcaaggaatcttttgcaaataacaccttgcaccttattggattattgagtgatgggggtgtgcactcccgccttgatcagctacagttgctgcttaaaggtgccagtgaacgtggtgccaagaggatacgtgttcatgtacttactgatggccgtgatgttgtggatggtacaagcgtaggctttgccgagacacttgaaaaggaccttgcggagctacgtggtaaaggcattgatgcacaggttgcttctggtggagggcgcatgtatgtcaccatggaccgttatgagaacgattgggaagttgtgaaacgtgggtgggatgctcaggttcttggtgaagccccgcacaaatttaaaaatgctgttgaggctatcaagaagcttagggaagctccgaatgctaatgatcagtatctacccccatttgtgattgttgacgagagtgggaagcctgttggtcccattatggatggtgatgctgttgtcacattcaacttccgggcagatcgtatgacgatgcttgcccaagctcttgaaaatgagaagttcgataaatttgacagagtgcgcttccccaaaatccgctatgccggaatgcttcaatatgatggagagttgaagcttccaagtcactaccttgtttctcctccattgatagagaggacatctggtgaatatctagtgcataatggtatccgcacttttgcttgcagtgaaacagtcaaatttggtcatgtgacattcttctggaacgggaaccgctccggatattttaattcggacttggaggagtatgtggaaatcccaagtgatagcgggattaccttcaatgttcaaccaaagatgaaggctttggagattggtaagaaggcccgtgatgctatcctcagtcgtaaatttgaccaggtacgggtgaatataccaaatggtgatatggttgggcatacaggtgacattgaagctacggttgtggcctgcaaggctgctgatgaagctgttaagatgattattgatgcagtgtcggaagtgggtggaatatatgtggtgactgcagatcatggtaatgcagaggacatggtgaagagaaacaagaagggggagcctcttgttggtaaagatggcaaagttcagattcagacctcacatacccttcaaccggtgccggttgcaattggaggtcctggattagcaggaggtgtgaagttccggaaggacgtaccaaatggaggactagcaaacgtagcggcaacggtgatgaatctgcatgggtttgtggctcctgatgattatgagaccacccttattgaagttgtttgattaacaaaaccagcctttcttttgttttatttttatgctatgtattacaatttgtgatattaacccattcaattatcacattttcag

SEQ ID NO: 5340 - DNA, 1855 bp, Valeriana officinalis
ggggagcacatggaagttggccgatcatccgaagctaccgaaaggaaagatcgtagctatggtggtgttagatggttggggtgaagcgtctccaaacaagtacaactgcatccatgtcgctgaaactccaaccatggattctcttaaaaagggtgctcctgataagtggagattggttagggctcatggaactgctgtagggcttccgaccgaggatgacatgggtaacagtgaagtcggtcataatgctcttggcgctggaagaatttatgctcaaggtgcaaagctagttgacttggcactcgcttccggaaagatatacgaaggagagggtttcaagtacattaaggaatgctttgaaagtaacacattgcatctaattggattattgagtgatggtggggtccattcccggttggatcagctgcagttgttgttaaaaggggtaggtgagcgtggtgctaaaaaaattcgcattcacatacttactgatggtcgtgatgttttggacggatcaagcattggttttgttgaaacattggagaatgagctcacaaaattgcgcgagaaaggtattgatgcaaagattgcttcaggtggaggccgaatgtatgtcaccatggatcgctatgagaatgattggagtgttgtgaaacgtggatgggatgcacaagttcttggagaagctccacacaaatttaaatgtgcaattgaagctgtaaagaaactgagagcggaacccaaggctaacgatcaatatctacctccatttgtaattgttgatgaaagtgggaaggccgtaggaccgataatggacggtgatgctgttgttacattcaatttcagagcagatcgtatggttatgcttgctaaagcacttgaatataaagatttcgataagtttgacagagttagggtacctaaaatcaactatgctggaatgctccaatacgacggagagttgaaacttccaagccattacctagtttcccctccggagatcgagagaacttctggtgaatacttggttcacaacggagtccgtacatttgcttgcagtgagactgtgaaattcggccacgtcacctttttctggaatggaaatcggtctggatatttcaattcagaaatggaggaatatgttgaaattccaagtgacagtggcatcacttttaatgtgcaacccaagatgaaggctttggagatcgctgaaaaggctagggatgctatcttaagccgtaaattccaccaggtaagggtgaatctgccgaatggtgacatggtcgggcataccggtgatattgaagctactgttgtagcgtgcaaagcagcagatgaggcagtgaagatgatactcgatgcgatagagcaagtgggtgggatatatatagttacagcagatcatggaaatgccgaagatatggtcaagagagacaagaaaggagaacctattcttgataaatctggcaatgttcaaatactcacctcgcacactcttgaaccagtgccgatagcaatagggggacctggactggcaaagggtgtgagattcagaaaggatgttccggatggagggcttgcgaatgtggccgccacagcataaaccttcatgggcttgaagctccttctgattacgagaccactcttatcgaggttgttgatgcttaaacgtgtcttgcatattttttgaattagttagagaagaggaggagaagctcgaaaataatactccgttttggagatactatttacttattttatttagttttactgaacttatctggtgtttttgattagcatttccataatttttttttcatgaaccatatgttagtttgcccagcagtaacaactt

SEQ ID NO: 5341 - DNA, 2063 bp, Gnetum gnemon
cattgggagcggccatttcgtgttatcgcggtagagattcgtcgacgagagctttgacgtttggttgttgatttgctttcgttttttctgtcatcgaaatttttgagcgttgtcaatatgggaagcgcaggcaacgctgcggcttggaagctcgctgatcacccgaagttgcccaagggcaagcttttggccgtcgtcgttcttgacggatggggcgagcagaagccggatccttacaattgcatccatgtcgcggaaacgcccgccatggattccctgaaaaagggagctccagaacattggagattgatcaaggcccatggaccagctgttggattgccaacagaagatgatatgggtaatagtgaagtgggtcataatgctcttggagcaggacgaatttttgcacagggggcaaaattggtagatttggctttggagtcagggaaaatatacgagggagagggatttaagtacatcaaaggatcctatgatagtggcacacttcatttgattggccttttgagtgatggtggtgttcactctcgacttgatcagatacagttgcttctgaaaggatccgcaaaaaatggtgctaagagaattcgagtacacgtcctgactgatggtcgtgatgtccttgatgggacaagtgttcactttgcagaagtcttggagcaagatcttgttgagctacgcaaacagggtgttgacgcacagattgcatccggtggaggcaggatgtatgtgacaatggacagatatgagaatgattgggaagttgtcaaacgaggctgggatgcacaggtcttaggtgaagccccccacaaattcaaaaatgccgtagaggcaattaaaacacttaggcaggagactaaagcaagtgaccagtacttgcccccatttgtcattgttgatgataatgggaaacctgttggtccaattcttgatggggatgcggtggttacagtcaatttccgggcggatagaatggttatggtagcaaaagcttttgagtacaaagattttgacaagtttgatcgggtaagagttccaaacattcgttatgctggaatgctacaatatgatggagaattaaagctcccaagtcagtatcttgtctccccaccagacattgataggacatcaggagaatacttggtacacaatggcattcgcacgtttgcttgcagtgaaaccgtgaagttcggacatgtaacatttttctggaatggtaatcgatcaggatattttaataaggatcttgaggaatatgtagaggttcagagtgatgtaggtattacatttaatgtgaagccgaagatgaaagctttggaaattgcaaagaaggcaagagatgccatattgagtggcaaatttgatcaggttcgggtaaatattcctaacggggacatggtgggacacaccggtgatgtagaggctactattgttggctgcaaagttgccgatgatgctgtaaagataattcttgatgcagtagagcaagttggtggtatttacttggttacagcagaccatggaaacgctgaagagatggtgaaaagagacaaaaaaggtcaaccagctttggataaagcaggaaatgttcaaatattgacctcacatacttgcaatccgattccaattgcaatcggtggtccagggctagccaagggagtgagattccgcaatgatttgaaagtacctggcctcgcaaatgttgcagctactatgatgaacttgttgggttttgaggcgccaagcatctatgaacctcctctcatcgaagttgttgacaactgatacagagttttgaagttttgtctggtattcagttttgtgacatgatttgatgttttaaggttcgaggatttgataaaaaacaaagctatcagttttcttgatagtctttaatatgatggtcagaagtagatgcatcaattaatgttatcaattgaaaattttatggaatagttgagtaattatttctggtattcctttcttcttgtgatcctagaaaaagaatgagaatttattttctagaccttcttggataaattttg

SEQ ID NO: 5342 - DNA, 2114 bp, Secale cereale
cacggacgcggacgtgacggggactgagatcgcgctactacccgtcgtcgtgaccttcggacacgtacgtcacaaggacacgtagtagtctaacgacacgagtacgatgggagtcctccgccactccgcgctccgaaacgttcttcttcgttaccgcaaccaacaacgagaaaaaagacaaagagatggcgacacgaattgacgctcccgaccacccacgcgtcccacggggaagacggtggccgtcgtcgtgctcgacggatgggcgaggccagcccgaccagtacaactgcatccactgtgcccagacgcccgtcatggattcgctcaaagaatggtgctcctgagaagtggagactagtgaaggctcatggaactgctgttggtctcccaagtgacgacgacatgggcaacagtgaagttggccacaatgcccttggcgctggtcggatctttgctcagggcgcgaagcttgttgatgctgctcttgcttctgggaagatttgggaagacgaggggttcaattacatcaaagaatcttttgacaagggtactctgcaccttattggtttgttgagtgatggaggcgtccactccaggctagaccaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgactttcaatttcagagctgaccgcatggttatgcttgcgaaagcacttgagtttcctgatttcgataaatttgaccgggttcgtgtaccaaaaattaagtacgctggaatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgatcaggtgcgtattaacctgccaaacggtgacatggttggtcacactggtgatattgaagccacagttgttgcttgcaaggctgctgatgaagctgtcaagatggtcttgtatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacggcttccaggctcctgctgattacgagacgaccctcatcgaagtcgtcgacaagtaaaaagaaacactgtgctctctgaagccaaaattgctgtagccaattttgtcgctatagttttggggtgggtgaatggtcgcatcgttgaataatatgagatttgccggcagacgcttgctcaaactcttgtaacattgagaaaagtggatttgacttgcagctagctctattttgtatttttttttgaaacggactatgttgtaactttagtgttgccacacgggttgtcaacagaccgatatgcacatctggataatttg

SEQ ID NO: 5343 - DNA, 1903 bp, Plantago ovata
acaactgtatccatgttgctgaaactccactatggattcactcaagaatggtgctcctgagaagtggaggattggtcagggcgcatggcaaagctgttggtctgcccacagaggatgacatgggtaacagtgaggtcggacacaatgctcttggtgctggaaggatctttgctcaaggtgccaagcttgtagatattgctcttgagactggtaaaatctatgatggcgaaggatttaactacatcaaggagtcttttgcaaatggaacacttcaccttattgggctattgagtgatggaggtgtccattctcgactcgatcaagtccagctgttacttaaaggtgctagtgagcgcggtgctaagagaattcgccttcatgttctgaccgatggtcgtgatgtgttggatggttcaagtataggcttcattgagattcttgagaatgatcttgcaaagctacgtgaaaaaggtgttgatgcccagattgcatctggtggaggcagaatgaatgtcactatggaccgttacgagaatgattggaatgtcattaaacgaggttgggatgctcaagtacttggcgaagcaccacacaaatttaagagtgctcttgaagctgtcaagacactgagagcagctccaggtgcaaatgatcagtacttacctccatttgtcattgttgacgacagtgagaaggctgttgggcctattgtcgacggtgatgcagttgtaacattcaatttccgtgcggatcgtatggttatgatggccaaggcacttgaatatgcagaatttgataagtttgacagagtacgggttcctaaaatccgttacgctgggatgcttcagtatgatggtgaactgaaacttccgaaccgctaccttgtttctcctccagaaattgatagaacatctggagagtacttggtgaagaatggtgtccgcacttttgcttgcagtgaaacagttaaatttggtcatgtcacctttttctggaatggaaaccgctcagggtacttcaacaaagatttggaagagtatgttgagattcctagtgatagtggtatctccttcaatgtccaacctaagatgaaggctttggagattgccgagaaggcaagggatgcaattcttagcggcaagtttgaccaggtacgggttaacatccctaacagtgacatggtgggtcacactggtgatattgatgcaaccatagttgcttgcaaggcggctgatattggcgtcaagatgatcattgatgcaattgaacaaattggtggtatatacgtcgtgactgctgaccatggtaatgctgaggatatggtgaagaggaataaaaagggcgagccacttcttgacaagaatggccaaattcaaattttgacatctcatacattggaacccgttcctattgcaattggtggccctggattagctcccggtgtaagattccgcaaggatgttccagatggtggtcttgcgaatgttgctgctacggtgatgaacctccacgggtttgaggcacccagcgattacgagacaacccttattgaagtggctgacaattagaaaatcatcacttaagcctcttcaaaattttgcagtagaggaagtggtggagaatgtgtgcgaaaaacaccgtccattgttcaataaattttcccttcatatacaatactatgaatgatggtggtagaatatagtatgtttttgctcactgtcatttgagcatgggaagttcgatactgttatcatctgtgtaagtccatactaatgatatccacagactgcaagcagactgcaagcagactgcaagtattaatgcttgtttgtttactggttggctgttgctattttgcaggtttgtatgacttttttctttttaagaatctactactccctcc

SEQ ID NO: 5344 - DNA, 1912 bp, Secale cereale
caaaccaacacgtaagaaaaaaagacaaaggagagtggccggaccacgaattgacgctccccgaccaccccacgctcccaacggggaagacggtggccgtcgtcgtgctcgacggatggggcgaggccagccccgaccagtacaactgcatccatgtcgcccagacgcccgtcatggattcgctcaagaatggtgctcctgagaagtggagactagtgaaggctcatggaactgctgttggtctcccaagtgacgacgacatgggcaacagtgaagttggccacaatgcccttggcgctggtcggatctttgctcagggcgcgaagcttgttgatgctgctcttgcttctgggaagatttgggaagacgaggggttcaattacatcaaagaatcttttgacaagggtactctgcaccttattggtttgttgagtgatggaggcgtccactccaggctagaccaagtgcagttgatttgcaaaggtgccagtgagaggggagcaaaaagaattcgccttcatattcttactgatggacgtgatgttttggatggcagtagtgttggtttcgttgagacaattgagaaagatcttgctcagcttcgtgagcagggtgttgatgcacggattgcatctggtggtggaaggatgtatgttaccatggaccgctatgagaatgactggagtgtggtcaagcgtggttgggatgcacaggtacttggagaagcaccatacaaattccaaaatgcacttgaagctgtgaagactctaagagcagagcccaaggctaatgatcagtatttgcccccctttgtgatagttgatgagagtggcaaatcggttggtcctatagtggacggtgatgcagttgtgacttttaatttcagagctgaccgcatggttatgcttgcgaaagcacttgagtttcctgattttgataaatttgaccgtgttcgtgtaccaaaaattaagtacgctgggatgcttcaatatgatggtgagttgaagcttccaagcaagtaccttgtgtccccacctttgattgagaggacatctggtgaatacttggtgaagaatggtgtccgcaccttcgcttgcagtgagacagttaagtttggccacgtcacatttttctggaatggaaaccgctcgggatactttgacgagaccagggaagagtacgtagaaattcccagtgacagtggtatcacattcaatgagcagcccaaaatgaaggcacttgaaattgctgagagaactcgggatgctatcctcagtgggaagtttgaccaggtgcgtattaacctgccaaacggtgacatggttggtcacactggtgatattgaagccacagttgttgcttgcaaggctgctgatgaagctgtcaagatggtcttggatgctgtggagcaagttggtggtatctatcttgtcacagctgatcatggaaacgcagaggatatggttaagaggaacaaagctggccagccgatgctcgacaagagcggtagcatccagattcttacctcgcatacgcttcagccagtccctgttgctatcggaggccctggtctccaccctggagtgagattccgctcagacatccagacacctgggctcgccaacgttgccgccaccgtgatgaacctccacgctccagctcctgctgattacgagacgacctcatcgaagtcgtcgacaagtaaaaagaacactgtgctctctgaagccaaaattgctgtagccaattttgtcgctatagttttggggtgggttgaatggtcgcatcgttgaataatatgagatttggccggcagacgcttgctcaaactcttgtaacattgagaaagtggatttgacttgcagctagctctatttgttaactttttttgttacgaacgtatttagtttag

SEQ ID NO: 5345 - DNA, 1531 bp, Triticum aestivum
ccacgcgtccgatcgcgcgcacccgtggatggcataggtagattcccctctctgcgtaccatatccagaccacatttattgtggtcgtcgtgcttcctgcccccacggccggtgaaccagccgcaacgacggcgacgacgcccactggtccatgagaaccctgtccggccgtacccgtacgtgtcatcccggcagcctcgaaacgaccgcggtgggcgcgtgccaacaaggcgcgcctcagggcaaggcaagcaccaccaccgctagcttaatcgtgagcgtgagagccggccggacacaggtggacaccagttagcgccaccagcgcgtccgcaagatcaaagccagcaaatggctttgatgcccgtggagctctgctacgccacggtcgcctctccggtggcggcgccatcggccaggagggcgccgaggcggcgggcggtggtgcggtgcgcggcgtccgcgccggcgccgatgggggagaagaccgagtacagggacgggccgctggagcgcgcgttcatggggctgttcgcgcgcaagatggagaagttcgcgggaaggaagaagaagccgggcccgggcggcgaggaggagaagaaggcggtgtgggagtgggactacgagagcttcgtggacgtgtcgcggcgggtgatggtggggcggtcgcgcgcgcagcagcaggaggccgtccgcgaggtgctcctctccatgctccctcccggcgcccccgagcagttcaagaagctcttcccgcccacgcgctgggcctgcgagttcaacgccgccctcaccgtccccttcttccactggctcgtcggtccgtcagaggttatcgaggtagaggttgacggggtgaagcagaggagtggagtgctcataaagaaatgcaggtacttggagaacagcgggtgcgttgggatgtgcgtcaacatgtgcaagatccccacgcagagcttcttcaccgacgagttcggccttcccctcaccatgaatccaaactttgaagacatgagctgcgaaatgatatatggtcaggtgcccccaccactggaagaagatccagtgtcaaaacaaccctgctatcccagcctctgctccatatcgacgccctccgctgcaatatgtcccaaaattcagaactagagaaagcgccgaaaacattccggagttcagatcttcgtcgctttcagtttcttctgcaagcgctcacaagggttttgatacataaatgattgtgcatggtatccgataggccagagttccaacagggacaatagatagtgcattggtaaattttatatatacactcaatgtatataatgtagtccatatcttacaggaaatgcaaagatacatgatccgaactactaattttgtaattgctgcaccttttcgctgcatgactagagttttcggctatctatcattttgtaaagagtaaaatatgtctactgtatgttgtgacttgtgaggggagcatgaagcaattgtctatcttcacattcaaacaaaaaaaaaaaaaaaacga

SEQ ID NO: 5346 - DNA, 1496 bp, Triticum aestivum
ttcccctctctgcgtccatatccagaccacatttattgtggtcgtcgtgcttcctgcccccacggccggtgaaccagccgcaacgacggcgacgacgaccactggtccatgagaaccctgtccggccgtacccgtacgtgtcatcccggcagcctcgaaacgaccgcggtgggcgcgtgccaacaaggcgcgcctcagggcaaggcaagcaccaccaccgctagcttaagcgtgagagccggccggacacaagtggacaccggttagcaccaccagcgcgtccgcaagatcaaagccagcaatggccttgatgcccgtggagctctgctacgccacggtcgcctctccggtggcggcgccatcggccaggagggcgccgaggcggcgggcggtggtgcggtgcgcggcgtccgcgccggcgccgatgggggagaagaccgagtacagggacgggccgctggagcgcgcgttcatggggctgttcgcgcgcaagatggagaagttcgcgggaaggaagaagaagccgggcccgggcggcgaggaggagaagaaggcggtgtgggagtgggactacgagagcttcgtggacgtgtcgcggcgggtgatggtggggcggtcgcgcgcgcagcagcaggaggccgtccgcgaggtgctcctctccatgctccctcccggcgcccccgagcagttcaagaagctcttcccgcccacgcgctgggcctgcgagttcaacgccgccctcaccgtccccttcttccactggctcgtcggtccgtcagaggttatcgaggtagaggttgacggggtgaagcagaggagtggagtgctcataaagaaatgcaggtacttggagaacagcgggtgcgttgggatgtgcgtcaacatgtgcaagatccccacgcagagcttcttcaccgacgagttcggccttcccctcaccatgaatccaaactttgaagacatgagctgcgaaatgatatatggtcaggtgcccccaccactggaagaagatccagtgtcaaaacaaccctgctatcccagcctctgttccatatcgacgccctccgctgcaatatgtcccaaaattcagaactagagaaagcaacgaaaacattccggagttcagatcttggtcgctttcagtttcttctgcaagcgctcacatgggttttgatacataaataattgtgcatggtatccgataggccagaattccaacagggacaatagatagtgcattggtaaattttatatatacactcaatgtatataatgtagtccatatcttacaggaaatgcaaagatacatgatccgaactactaattttgtaattgctgcaccttttcgctgcatgactagagttttcggctatctatcattttgtaaagagtaaaatatgtctactgtatgttgtgacttgtgaggggagcatgaagcaattgtctatcttcacattcaaacacatggaaatagaggatgttggggagggtcccct

SEQ ID NO: 5347 - DNA, 1167 bp, Panicum virgatum
  misc_feature (273)..(273): n is a, c, g, or t
  misc_feature (287)..(287): n is a, c, g, or t
  misc_feature (299)..(299): n is a, c, g, or t
  misc_feature (301)..(301): n is a, c, g, or t
  misc_feature (314)..(314): n is a, c, g, or t
  misc_feature (347)..(347): n is a, c, g, or t
  misc_feature (789)..(789): n is a, c, g, or t
  misc_feature (844)..(844): n is a, c, g, or t
  misc_feature (881)..(881): n is a, c, g, or t
  misc_feature (887)..(887): n is a, c, g, or t
  misc_feature (895)..(895): n is a, c, g, or t
  misc_feature (897)..(897): n is a, c, g, or t
  misc_feature (910)..(910): n is a, c, g, or t
  misc_feature (912)..(912): n is a, c, g, or t
  misc_feature (923)..(923): n is a, c, g, or t
  misc_feature (939)..(939): n is a, c, g, or t
gtgcagcaactcgccggcagattacggccgatggaagcagcccggcccatggagctctgcttcgccgcgcgcgcaggcacgctgacgccgacgccggccgggagggcgccagcaaggctgaagaagcggcgcgccggagccggcaccacggtgcggtgcgcggcgacggcgccggcgccgatgggggagaagacggagtaccgcgacggcccgctggagcgcgcgttcatggggctgttcgcgcgcaagatggagaagtacgctaccggcggnggcggcggcaagangaagcagcagcngncggcggggacggngaaggagaaggcggtgtgggagtgggactacgngagcttcgtggacgtgtcgcggcgcgtgatggtggggcggacgcgcgcgcagcagcaggaggccgtgcgcgaggtgctcctctccatgctgccccccggcgcgccggagcagttccggaagctcttcccgccgacgcggtgggcgtgcgagttcaacgccgcgctcaccgtgcccttcttccactggctcgtcggcccctcggaggtcatcgaggtggaggtcaacggcgtcaagcagaagagcggggtgctcatcaagaaatgcaggtacctggagaacagcgggtgcgtcgggatgtgggtcaacatgtgcaagattccgacgcaggacttcttcaccaacgagtttggactccccctcaccatgaatccaaattttgaagacatgagctgcgagatgatatatggtcaggtgccacctcccttggaagaggatccagcntccaagcaaccttgctatccaaacctctgttccatgtccacgccttctgccccantctgccccaaacttcagtagacgaggagctcatcgcngagtcnagttcagntncagcgcgcattcngntttgtcagggnaacttcagagaaaccncatgcaactgaagcttcatagactcatagtacatagtaacaggtttttggtactggggatgaagatgagatgagatgctctaaactcgaagatgtggtaccggatgtcctcctgttgcacattccatcgatcagcttgtcgcgtatatgatttgttctctcatttgatcatgcagacatatatacgtaccaacaccaaagttgcagccatcagaactagtaaatatcc

SEQ ID NO: 5348 - DNA, 1391 bp, Secale cereale
gactatttattgtggtcgtggtgcttcccgcccccacggccggtgaactagccgcaacgacggcgacgacgaccacttgtccatgagaaccctgtccggccgtacccgtacgtgtcatcccggcagcctcgaaacgaccgcggcgggcgcgtgccaacaaggcgcgccgcagggcagggcaagcaccaccaccgctactgctagcttaagcgtgagcgtgagagccggccggacacaagtggacactagttagcaccaccagcgcgtgcgcaagatcaaagccagcaatgaccttgatgcccctggagctctgctacgccacggtcgcctctccggtggcggcgccatcggccaggtgggcgccgagacggcgggcggtggtgcggtgcgcggcgtccgcgccggcgccgatgggggagaagaccgagtacagggacgggcctctggagcgcgcgttcatggggctgttcgcgcgcaagatggagaaattcgccggaaggaagaagaagccgggcccgggaggcgaggaggagaagaaggcagtgtgggagtgggactacgagagcttcgtggacgtgtcgcggcgggtgatggtggggcggtcgcgcgcgcagcagcaggaggccgtccgcgaggtgctcctctccatgctccctcccggagcccccgagcagttcaggaagctcttcccgcccacgcgctgggcctgcgagttcaacgccgccctcaccgtccccttcttccactggctcgtcggcccatcagaggttattgaggtagaggttgacggggtgaagcagaggagtggagtgctcataaagaaatgcaggtacttggagaacagcgggtgcgttgggatgtgcgtcaacatgtgcaagatccccacgcagagcttcttcaccgacgagttcggccttcccctcaccatgaatccaaactttgaagacatgagctgcgaaatgatttacggtcaggtgcccccaccactggaagaagatccagtgtcaaaacaaccctgctatcccagcctctgttccatatcgacgccctccgctgcaatatgtcccaaaattcagaactagagaaagcaacgaaaacattcctggttcagattttggtcgctttcagtttcttctgcaagcgctcacaagggttttgatacgtactctacataattgtgcatggcatccgataggccagaatttcaagggacaatagatagtgcatccgtaaattttatctatacaatccaatgtatataatgtagcccatatcttacaggaaatgcaaagatacatgatccgaactactaattttgttattgctgcaccttttcgctgcataactagagttttcggctgtctgtcattttgtaataaagagtaaaatat

SEQ ID NO: 5349 - DNA, 1308 bp, Setaria italica
gccacctgctgcagaggggctttcctcggggccacaccacacccggaagaactcaccagacaccaccggccagccgccgccgccacggtgtcgccctcgcagccgcacaacgcgcggccagcagccagcgcagcaactccggcagattacggccgatcgatcgaccgatggcagcagccctgcccatggagctctgcttcgccgcacgcgccgtaacgccggcgccggccgggagggcgccagcaaggccgaggaagcggcgcgccggggcggtgcggtgcgcggcgacggcgccggcaccgatgggggagaagacggagtaccgggacgggccgctggagcgcgcgttcatggggctgttcgcgcgcaagatggagaagtacgcgacgaagaagaagcagcagcagcagcagcagacggagttggagaagaagaagaaggcggtgtgggagtgggactacgagagcttcgtggacgtgtcgcggcgcgtgatggtggggcggacgcgcgcgcagcagcaggaggccgtccgcgaggtgctcctctccatgctcccgcccggcgcccccgagcagttccggaagctcttcccgccgacgaggtgggcgtgcgagttcaacgccgcgctcaccgtgcccttcttccactggctcgtcggaccctccgaggtcatcgaggtcgaggtcgacggcgtcaagcagaagagcggggtcctcatcaagaaatgcaggtacctggagaacagcgggtgcgtcgggatgtgcgtcaacatgtgcaagatcccgacgcaggacttcttcaccaacgagtttgggctccctctcaccatgaatccaaatttcgaagacatgagctgcgagatgatttacggtcaggtgccacctcccttggaagaggatccagtgtcaaagcaaccttgctatccaaacctctgttccatgtcgacgccttctgccccagtctgccccaaacttcagacataggcatcgccgagttgagttcaggttcagtttcgtcagctaaacctttagagaaaccacagttgaaacctcatatagtacatagtagcagaccgttcctaggaaacctttggcttgagacgaccgagaaaacttgcacatgaacatcggcttggtgcggcagcaacattgttttctatacagagtgtacatagtctagcttataactacagttacagttacagagttgttctgattctgaactagtacagagcagatattattatatatactgtgtgtgtgtaagtactgaaaacatcgatcaacactcgtattgctgttcctgatc

SEQ ID NO: 5350 - DNA, 1510 bp, Hordeum vulgare
ggtagatttcccctctctccgtaccatatccagaccacattattgtggtcgtcgtgcttcccgcccccacggccggtgaactagccgcaacgacggcgacgacgaccactggtccatgagaacccggtgcggccgtacccgtacgtgtcatcccggcagcctcgaaacgaccgcggtgggcgcgtgccaacaaggcgcgcctcagggcaaggcaagagcaccaccaccgctagcttaagcttgagcgtgcgagccagccgtcacaagtggacaccagttagcaccaccatcttgcgcgcaaagatcaacgccagcaatggccttgatgcctgtggagctctgctacgccacgttggcatctccggtggcggcgccgtcgggcaggagggtgcctaggcggcgggcggtggtgcggtgcgcggcgaccgcgcccgcgccgatgggggagaagaccgagtacagggacgggccgctggagcgcgcgttcatggggctgttcgcgcgcaagatggagaagttcgccggacggaagaagaagccgggcccgggcggcgaggaggagaagaaggcggtgtgggagtgggactacgagagcttcgtggacgtgtcgcggcgggtgatggttgggcggtcgcgcgcgcagcagcaggaggccgtccgcgaggtgctcctctccatgctccctcccggcgcccccgagcagttcaagaagctcttcccgcccacgcgctgggcctgcgagttcaacgccgccctcaccgtccctttcttccactggctcgtcggcccatcagaggttatcgaggtagaggttgacggagtgaagcagaggagtggagtgctcataaagaaatgcaggtacttggagaacagcgggtgcgttgggatgtgcgtcaacatgtgcaagatccccacgcagagcttcttcaccgacgagttcggccttcccctcaccatgaatccaaactttgaagacatgagctgcgaaatgatatatggtcaggtgcccccaccactggaagaagatccagtgtcaaaacaaccctgctatcccagcctctgttccatatcgacgccctccgcagcaatatgccccaaaattcagaactagagaaagcaacgaaaacattcctgaattcagatcttggtcgctttcagtttcttctgcaagcgctcacaagggttttgatacataaataattgtgcatggtatccgataggccagaatttcaacagggacaatagatagtgcatcggtaaattttatacactcaatgtatataatgtagcccatatcttacaggaaatgcaagggtacatcatccgaacaactactactaattttgtaattgctgcatcttttcgccgcatgactagagttttcggctgtctatctttttgtaataaagagtaaaatatgtctactgtatgttctgacttgtgaggggagcatcaagcaattgtctatgttggcattcaaaacgtggaaatagaggatgttggggagtag

SEQ ID NO: 5351 - DNA, 1359 bp, Avena sativa
cttcccgcccccacagccggtgaagcagccgcaacgacgaggactggtccctgagatgagaaccagtgccgccgtaacccgtacgtgtcactccggcagcctcgcaacgacctctgcgggcgcgtgtcagggcaaggcaaacaccaccaccgctagcttaagcaacacaatcggacactcgcagcaccagcgcaagatcaaagctagcaatggcgttgatgcccgtggagctctgcttcgccgcacgcgcctcgccggcgaccaggacgttgccgaggcggcgagccacggtgcggtgcgcggcgacggctccggcgccgatgggggagaagacggagtaccgggacgggccgctggagcgcgcgttcatggggctgttcgcgcgcaaaatggagaagtacgccggaaggaagaagaagccgggcggcgaggtggagaagaaggcggtgtgggactgggactacgagagcttcgtggacgtgtcgcggcgggtgatggtggggcggtcgcgcgcgcagcagcaggaggccgtccgcgaggtgctcctctccatgctccctcccggcgccccagagcagttcaagaagctcttcccgcctacgcgctgggcttgcgagttcaacgcggccctcaccgtccccttcttccactggctcgtcggcccgtcagaggttgtggaggtggaggtggacggggtgaagcagaggagtggagtgctcataaagaaatgcaggtacttggagaacagcgggtgcgtcgggatgtgcgtcaacatgtgcaagatccccacgcagagcttcttcaccgacgagttcggacttcccctcaccatgaatccaaattttgaagacatgagctgtgaaatgatatatggccaagtgccacccccattggaagaggacccggtgtcaaagcaaccctgctaccccagtctctgttctatatcgacgcccgcagccgcaatctgtcctaaacttcagaattagagaaagtaacaacattgctcaattgagatctttgccgttttcagtcctttcacgagccctcccacagatgttggtaccaaaatggcaaattgtgcgtgatcaccgataggcaagagtttccacaggaatattagatagttcatcagtaaaattttacacactgagtgtatataatgtagcctgtattttacagaaaatgtaaagacaacagtcccccgaaataagcttgtcactgctgaactgttgctgcataattacagtttttcacatgttcatcgaacctataggctacagtgcctctgtaaatgtccaaacaggaacccaaaaatatgtgaattttgtagggataaaaccatgaagcagaataaaaata

SEQ ID NO: 5352 - DNA, 1515 bp, Triticum aestivum
cactcactctcagagccccccagctagctagagtgccctgtgcatctcgtgctcgaagcacccagcaagggtcaattagcagctgatcggcagatcatgggcatggaggggtgctgcaacaagaaggtgatggaggaggaggccctggtgaagaagatcaccggcctcgccgcggccatcggcgagctgccctcgctgagcccgtcgccggcggtgaacgcgctcttcaccgagctggtgacgtcctgcatcccggcgagcaccgtggacgtcgacgcgctgggcccggaggcgcaggagatgcgcgcccgcctgatccgcctctgcgccgacgccgagggccacctggaggcgcactactccgacctcctcgccgcgcacgacaacccgctcgaccacctcaccctcttcccctacttcaacaactacatcaagctcagccagctggagcacggcctcctcgcccgccacgtcccgggccccgccccggcccgcgtcgccttcctcggctccggcccgctgccgctcagctccctcgtgctcgcggcgcgccacctccccgacgcctccttcgacaactacgacatctccggcgaggccaacgagcgcgccagccggctggtgcgcaacgacgccgacgccggcgcgcgcatggcgttccgcacggcggacgtggccgacgtgaccaccgagctggcggggtacgacgtggtgttcctggcggcgctggtgggcatggcggccgaggagaaggcgcgcctggtggagcacctcgggaggcacatggcccccggcgcggcgctcgtggtgcggagcgcgcacggcgcgcgcgggttcctgtacccggtggtgaaccccgaggagatccggcgaggcgggttcgaggtgctcaccgtgcaccacccggaggacgaggtgatcaactccgtcatcatcgcgcgcaaggcggcggcgccagcagccgttgccgccgacggcgacgtgccggtgaacaacggcggcatgccggcgcagtgcgcggtggcggtgagcagaccgtgcctcggctgcgcctgcgagctggggacgagggcgcaccagaagatgaaggagatggccatggaggagatggaggcgtaggcatcggcatcgccagcagacatcggcatcgcccagagcacggtgatgaattcaccgaccgattaatatttgcccgattaatccgcgaccgatacatacatgcatggtaataattcgcttgtcctcatgcatggatggatgtggctacctatttaccaccataattattaatccttgcctgcgtatggctggctggattatttattttctaccgtaattgtgccgtgtttgttttagcaatcgtctgacagctgctgcatgcctccgggtttaacatagaggaggaggatgatatgtgtcgtgttgtgttgtggtgagatcgagtcgagtcgagttgcctgcctgctgttgtaataagtgattttgacactctatatgactgaagtgatcatcacc

SEQ ID NO: 5353 - DNA, 1597 bp, Leymus cinereus x Leymus triticoides
cgttgctgtcgccgttgctgtcgcactcactctcagagccttccagctagctagtgccctgtgcatctcgtgctcggagaacctagcaagtaacttagattagcacagagcaagggtcgattagcagctgatcggctgatcatgggcatggagggctgctgcaacaacaaggtgatggaggaggaggccctcgtgaagaagatcaccggactcgccgcggccatcggcgatctgccctcgctgagcccgtcgccggaggtgaacgcgctcttcaccgagctggtggtgtcctgcatcccgccgagcaccgtcgacgtggacgcgctgggcccggaggcgcaggagatgcgcgcccgcctgatccgcctctgcgccgacgccgagggccacctggaggcgcactactccgacctcctcgccgcgcacgacaacccgctcgaccacctcaccctcttcccctacttcaacaactacatcaagctcagccagctggagcacggcctcctcgcccgccacgtcccgggcccggccccggcccgcgtcgccttcctcggatccggcccgctgcccctcagctccctcgtgctggccgcgcgccacctccccgccgcgtccttcgacaactacgacatctccggcgaggccaacgagcgcgccagcaggctggtgcgcgccgacgccgacgccggcgcgcgcatggcgttccgcaccgcggacgtggccgacgtgaccaccgagctggcgggctacgacgtggtgttcctggcggcgctggtgggcatggcggccgaggagaaggcgcgcctggtggagcacctcgggaggcacatggcccccggcgcggcgctcgtggtgcggagcgcgcacggcgcgcgcgggttcctgtacccggtggtggaccccgaggagatccggcgaggcgggttcgaggtgctcaccgtgcaccacccggaggacgaggtgatcaactccgtcatcatcgcgcgcaaggcagcggcgccaccagccgttgccgcagacggcgacgtgccggtgaacaacggcagcatgcccgcccagtgcgcggtggcggtgagcagaccgtgcctcggctgcgcctgcgagctgggggcgagggcgcaccagaagatgaaggagatggccatggaggagatggaggcgtaggccggccggcagacatcgtcatcgccatagcacggtgattaattcaccgaccgattaatattgcccgattaatctgcgatcgatacatgcatggtaataattcgtttgtcctcatgcatggatgtggctacttatttaccataattaatccttgtctatatatggctggattattttctactgtaattgtgccgtgttttagtaattgtctaacagctgctgcctccgggtttaacatagaggaggatgatatgtgttgtggtgagatcgagtcgagttgcctgctgttgtaataagtgattttgacactctatatgactgaagtgatcatcaccaagaagtgtaacacctatgcttgcttaattgattcccttgtttcaacgagtgtctcaagctcgttagtacagtagtagttaatcccggttctctttta

SEQ ID NO: 5354 - DNA, 1855 bp, Hordeum vulgare
actgccacgcgggccccaacacgctctcgactccgtcggctcctatataacattagcaccccatcgctcactccacagcagatcgtgcccttcgcctccatcactcactctcacagcctctcagctagctagtgccctcctctgcatctcgtgctcccagaacctaggcaggcatctcagactagcagctgatcggctgatcatgggcatggagggctgctgcagcaacaagaaggtgatggaggaggaggccctggtgaagaagatcaccggcctcgccgcggccatcggcgagctgccctcgctcagcccgtcgccggaggtgaacgcgctcttcaccgagctcgtcacgtcctgcatcccgcccagcaccgtcgacgtcgacgcgctgggcccggacgcgcaggagatgcgcgcccgcctcatccgcctctgcgccgacgccgagggccacctggaggcgcactactccgacctcctcgccgcccacgacaacccgctcgaccacctcaccctcttcccctacttcaacaactacatcaagctcagccagctggagcacggcctcctcgcccgccacgtccccggccccgccccggcccgcgtcgccttcctcgggtccggcccgctcccgctcagctccctcgtgctggccgcgcgccacctccccgacgcctccttcgacaactacgacatctccggcgaggccaacgagcgcgccagcaggctggtccgcgccgacgccgacgccggcgcgcgcatggcgttccgcaccgcggacgtggccgacgtgacgaccgagctggcgggctacgacgtggtcttcctggcggcgctggtgggcatggccgccgaggagaaggcgcgcctggtcgagcacctcgggaggcacatggcccccggcgcggcgctcgtggtgcggagcgcgcacggcgcccgcgggttcctgtacccggtggtggaccccgaggagatccggcgaggcgggttcgaggtgctcaccgtgcaccacccggaggacgaggtgatcaactccgtcatcatcgcgcgcaaggcagccgcgccaccacccgttgccgcggacggcgacgtgccggtgaacatgccgatgccagcccagtgcgcggtcgcggtgagcagaccgtgcctcggctgcgcctgcgagctgggggcgagggcgcaccagaagatgaaggagatcgccatggaggagatggaggcgtaggccggccggccgccagcacatcgtcatcgacccatggcacggtgatgaattcacccaccgattaatattgcccgattaatctgcgatcgatacatgcatggtaataatccgtttgtcctcatgcatggatggatgtggctacttaattatttaccataattattaatccttgtctgcatatggctggattattttctaccgtaattgtgctgctatgttttagtggtcgtctgacagctgctgcctccgggtttaacgtagaggaggaggatgatatgtgttgtgctgagaacgagtcgagttgcgtactgctgtaataagtgattttgacactctatatgactgaagtggcaatcactaaaaagtgttgtaacacctgtgcttgcttaattgattcccttgtctcagcgactgtctcaggcccgttgcaaatctcaagctcgttagtggtaattggtagtagtaatcgatcgttgcagttacttacccaatatatgtgggtgtcagctaagttcaagctcatattgtcaactgctagcatctggttgccaaatgattggagtgcaggatttttctgcggtaccaaaacgaccgggctgctcgaagtgtgtgccggccattttaatgaat

SEQ ID NO: 5355 - DNA, 1524 bp, Avena sativa
cacctccatcattcactctcagccctctcaggtagccagtagctagtgcatctcgagctcgatcgggaaagcaagccagatagcagcagagagcaggggatcgagtagcagatcgatcatgggcatggagggctgcaaggtgatggaggaggaggtcctcgtgaagaagatcaccggcctggccgcggccatcggcgagctgccgtcgctgagcccctcgccggaggtgaacgcgctcttcacggagctggtggtgtcgtgcatcccgcccagcaccgtggacgtggacctgctgggcccggaggcgcaggacatgcgcgcacggctgatccgcctgtgcgcagacgccgagggccacctggaggcgcactactccgacctcctcgccacccacgacaacccgctcgaccacctcaccgtcttcccttacttcaacaactacatcaagctgagccagctcgagcacggcctcctcgccaagcacatccccggcccgccgccgtcccgcgtcgccttcctcggatccggcccgctcccgctcagctccctcgtgctggcggcaaggcacctccccgacgcgtccttcgacaactacgacatctccgggagcgccaacgagcgcgccaggaggctggtgcgcgccgacgccgacgccggcgcgcgcatggcgttcgtcaccgcggacgtggccgacgtgacggaggagctgtcgggatacgacgtggtgttcctcgcggcgctggtgggcatggccgccgaggagaaggcggcgctggtggcgcacctcgggaggcacatggcgcccggcgccgctctcgtggtgcggagcgcgcacggcgcgcgcgggttcctgtacccggtggtggaccccgaggagatccggcgaggcgggttcgaggtgctcaccgtgcaccaccctcaggacgaggtgatcaactccgtgatcatcgcgcgcaaggagccggcggcacccgccctcgccgccgatgccgacacgccggtgaacaacggcggcctgaacgcccagtgcgcggtggcagtgagccggccctgccttggctgcacctgcgagatggaggcgagggcgcaccagaagatgacggagatggccatggaggagatggaggcgtaggcatcatcgacgcccacacgtacgcatcgtcgcacacggtgattaatttatcgatcgattaatattcgccccatcagtccgcggttaaaaacatgcgtggtaataattcgtttgtcctcacgcatgcggccgtggctacctatttaccataattaaattaatccttgtctgctatgtggccggattatttgtactaccgtgctttaattagtagtatctgacagctgctgcctccggggtttaacttagaggaggatatgtattgtggctagctgatgagtactgtaataagtgattttgacactctacatcactgaagtgtgatcactaaaaactgtaattctgtgcttgcttaattgattattctttagttaaacttaaaaaaaaaaaaa

SEQ ID NO: 5356 - DNA, 1193 bp, Pseudoroegneria spicata
  misc_feature (1162)..(1162): n is a, c, g, or t
gagcagtggcccactgggtcggtcgacatggattaccaccagcagcagcagcaccagttcctgatgcctccgcccgcgtcgctgccggcgcagcagcagcagctgtgcgcgccgatgatggacatggacatggacgagcagttgtgcttcgtggggaggggcggcgggggagcggcgaccgggaggggggcggagaggaagcggcggttcacggaggagcagatacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctcgagcacgacttcgccgccctccgcgccagctacgacgccctccactcccgcgtcgagtccctcaagcaggagaagctcgccctcgccgcacagttgcacgaactgagcgagaggctgagggagagggacggaggcagcggtggcgcggcgaccgccacagccagcagcagcagctgcaacggaggcagccgggagctggacgacgataagaggaacgtcgtcgccgggtgcgtcgacgtcgagccccccgagagctgcgtgctcggcgggacggcgtgcgccacgccggcggacgtctcggtgtcggtggagtccgagtgcgacgaccacctccactacgacggggcggtcttcccggagtccttctgcgccacgccggagctgtgggagccgtggccgtggccgcccgtcgagtggaacgcggtggcttgaagccgtggagtagtatacctagtacccacgtaggcggcttgtgttgtttgtagcttcacgtacgtgcatgttgtgctcgatttctcatcggcaatgtcgggtgggtcggtgtaagatcgaggatgatgcacttgaaggcaaccaccgagccaatggaggccgaagtgtaaagatagaggccgaagtgatgaaaccatggaggcaaccaccgagccaatgggatcactgattcggatgctgctaaaatgttgtcagttagtacttagtagagatcattggtagagtttgcatcagctgttctgtttgttgttgctcccgctgtgaattcaaatgttggaggcaggatcgatccatcaantgataatataaaacactgcttctcaacttta

SEQ ID NO: 5357 - DNA, 1183 bp, Secale cereale
ataggcctagggaggggatccatccagcagagcagaggagcgaccggtcggagcagagcagtggcccactgggtccgtcgacatggattaccaccagcagcagctgcagcagcggcagttcctgatgcccccgccgcgtcgctgccggcgcagcagcagcagctgtgcgcgccggtgatggagatggagatggacatggacatggacgagcagctgtgcttcgttgggagggcggcgggggcggggccggagaggaagcggcggttcacggaggagcagatacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctcgagcacgacttcgccgccctccgcgccgactacgacgccctccactcccgcgtcgagtcgctcaagcaggagaagctcgccctcgccgcacagttgcacgagctgagcgagaggctgagggagagggacggcggcgcggcgaccgccaccgccagcagcagcagctgcaacggagccgggcaggagctggacgacgacaagaggaacgtcgtcgacgtggagcccccgagagctgcgtgctcggcgggacggcgtgcggcacgcctgcggacgtctcggtgtcggtggagtccgagtgcgacgaccacctccactacgacggggcggccttcccggagtccttctgcgccacgccggagctgtgggagccgtggccgtggccgcccgtcgagtggaacgccgtggcctgaagccgtggaggtggactagtatatacgtagtgcccacgtaggcggcttgtgtttgtagcttcacgtacgtgcatgttgtgctcgatttctcgtctggttggggatagtacatgtgagagaggcggcaatggcgggtgggtctgtgtaagatagaggatgatgcactttgaatcaagagaagtgaccgaagtgatgaaaccatggaggcaaccacctagccggccaatgggatcagtgagtcggatgctgctaaaatgttgtcagttagtagagatcattggtagagtttgcatcagctgttctgtttgttgttgctcccgctgtgaattcaaatgttgaaggca

SEQ ID NO: 5358 - DNA, 1226 bp, Leymus cinereus x Leymus triticoides
  misc_feature (38)..(38): n is a, c, g, or t
  misc_feature (54)..(54): n is a, c, g, or t
  misc_feature (1105)..(1105): n is a, c, g, or t
  misc_feature (1111)..(1111): n is a, c, g, or t
  misc_feature (1123)..(1123): n is a, c, g, or t
catcaacagcatagcgtaggtaggggatcgagacagancagaggagcgaccggncggagcagagcagtggcccactgggtccgtcgatatggattaccaccagcagcagcagcagcagcaccggttcctgatgcctctgcccgcgtcgctgccggcgcagcagcagcagcagctgtgcgcgccgatggtggacatggacatggacgagcagctctgcttcatggggaggggcgggggagcggccgggaggggggcggagaggaagcggcggttcacggaggagcagatacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctcgagcacgacttcgccgccctccgcgccaactacgacgccctccactcccgcgtcgagtccctcaagcaggagaagctcaccctcgccgcacagttgcacgaactgagcgagaggctgagggagagggaaggcggcggtggctcgaccaccgccacagccagcagcagcagctgcaacggaggcggccaggagctggacgacgacaagaggaacgtcgacgtcgagccccccgagagctgcgtgctcggcgggacgacgtgcgccacgccggcagacgtctcggtgtcggtggagtccgagtgcgacgaccatctaaactacgacggggcggtcttcccggagtccttctgcgccacgccggagctgtgggagccgtggccgtggccgcctgtcgagtggaacgcggtggcttgaagccgtggagtagtatatatagtacccacgtaggcggcttgtgtttgtagcttcacgtacgtgcatgttgtgctcgatttctcatctggttggggatacatgtgagagaggcgagtggggacgcggcaatgtctggtgggtccgtgtaagataggaggatgatgcacttgaatcaagagaagtgaccgaagtgatgaaaccatggaggcaaccacctagccaatgggatcagtgattcggatgctgctaaaatgntgtcanttagagatcatnggtagagtttgcgtcagctgttctgtttgttgctcccgatgtgaattcaaatgttggaggcaggatcgattcatcaattgataatataaaatactgcttctca

SEQ ID NO: 5359 - DNA, 1292 bp, Hordeum vulgare
aacgaacgggcatcgacaacagcgtagcgtaggggatccaacagagcagaggagaggagcgaccggtcggagcagagcagtggcccactgggtccgtcgacatggattaccatcaccaccaccaccagcagcagcagcagttcctgatgcctccgcccgcgtcgctgccggcggcgcagcagcagcagcagcagcagcagcagatgtgcgcgccgatgatggacatggagatggaggagcaggtgtgcttcgtggggaggggcggcggcggcggtgggaggggggcggagaggaagcggcggttcacggaggagcagatacggtcgctggagtccatgttccatgcgcaccacgccaagctggagccccgggagaaggcggagctggcgcgcgagctgggcctgcagccgcgccaggtcgccatctggttccagaacaagcgcgcgcggtggcgctccaagcagctcgagcaagacttcgccgccctccgcgccagctacgacgccctccactcccgcgtcgagtccctcaagcacgacaagctcgccctcgccgcacagttgcaggagctgagcgagaggctgagggagagggacggcggcagcggtggcggtggcggtggcgcgacgatcgctgccgccagcagcagcagctgcaacggaggcggcagggagctggacgacgacaagaggaacggcgacgtcgagcaggagcccaccgagagctgcgtgctcgtcgggacggcgtgcgccacgccggcggacgtctcggtgtcggtggagtccgagtgcgacgaccacctccgctacgacggggcggtcttcccggagtccttctgcgccacgccggagctgtgggagccgtggccgtggccgcccgtcgagtggaacgcggtggcttgaagccgtggatacgtacctagtagtacccacgtagacttgtgttgtttgtagcttcacgtacgtgcatgttgtgctccatttctcatctggttgggtatacatgatgtgggaggggcgagtggggacgggcaatgtcgggtgggtccgtgtaagatagcactcgaatcaagagaagtgacccaagtgatggaaccatggagatggaggcaaccaccaagccaatgagatcagtgattcgaatgctgctagaaatgttgtgagttagtattagatatcattggtagagtttgcatcagctcttctgtttgttgttgctcttgctcccgcgttgtgaactcaaatgttgcaggggatcgatccatcaactgataatataaaatgttcttctca

SEQ ID NO: 5360 - DNA, 2007 bp, Triticum aestivum
acctgcctcaacatttgtggtagcactcgccgccggccgccgccatgtccaaagcattcaccaagtccctcctcttgtacaacaagatcctcatccggcggctcaagtctctcatcacccgtgcgccacccgcgccggcgtcggccaccgagaggctgccaccctcacacaagcacgagtcgtcgacggcgccgctggacgcgctcccggcgccagggacgacggacgatgacaacgataatggtggccgtgctggcggcggcaccatcgtgtgcgaggtggaaggcggcctgctgatgtcctcctccaccttcccctacttcatgctcgtggccctcgaggccggcgggcttctccgcggcctcctcctgctcctgctctaccctctcctccgcctcctcacggacgagctcgccatgaaggccatggtgatggtgaccttcgcggggctccggaggacgcgtttggccggctgggcatggccgtcatgcccaagctgttcctgcaggacgtgagcgccgaggtgttccacgcggccacgtctgctccagtgacgtcagggggcgcgcggcggcgaaggcgctgcgtctgcgtgagcagcatgccgagggcgatggtggagccgttcttgaaggagtacctcgccgtcgacgccgtcgtcgcgccggagctgagggagctcggagggtactacctgggtctcgtggaggatgaaggcgaggtggcgaggaggatggacgtggaggaggtcattggggccaagggcggcgccgtcgtcggcattggtggacaggggtgctcgtttcagcacatcttccaaaagtactgcaaggaggtgtacgtgccaacggagtcgacgcggcggcggcgcgaggcgctgcacccgcggcggtacccgaagcccctggttttccacgacggccgcaccgctttccggccgacgcccgccgccacgctcgccatgttcatgtggctcccgctcggtgcgccgctcgccgtgctccgcaccgccgtcttcctcctgctccctttctccctctcggtgccgctcctcgccagcctcggcatgcacaaccgcatgatcgcgtcctcgtcgccctctgccggggacaagagcaagagcaacctcttcgcgtgcaaccaccggtcgctgctggacccgctgtgcgtgtccgcggccgccggccggcgcgacctctccgcagccacctacagcatcagccgcctgtcggagatgctcgcgccgatccccacgttccgcctcacccgcgaccgcgccgccgaccgcgcggccatgcaggcacagctcgcccgccgcgggctggtggtgtgcccggaggggacgacgtgcagggagccgttcctgctgcggttcagcccgctgttcgcggagcttgccgccggcggcgtggacgtggtgcccgtggcgctgcacctggcggtggacatgttccacggcacgacggcgcggggcaggaagatgctggaccctctgtacctgctgatgaaccccgtgccgtcctacctcgtgcagttcctcgaccccgtcgagtgcggcggccagaggcgcgcgcggtggcgaacgaggtgcagcgccgggttgcggaggcgctcgggtacgagcgcaccgggctgacaaggagggacaagtacctcatcctcgccggcaacgaaggggtcgtcggcgccgcccaggacggcggcacgaagaattagctgcagctgatgccagcgcagtctattattgacgactagtggtgcaatccagtactatacaaaagctagcttgttgtcgctgctgatggtgtacagcgcatatgcgtctcttgtgttcgtcagggattatgtgtgctgtccggggtgctttgtgaaatacggagtatcacgctaatacagtgtgcgatttatttatttgtgcaatcataatatacagaggttttgcttgatttgttgttttggattgaatagtgagttttagtttacggttttgctaagtctcagtcgact

SEQ ID NO: 5361 - DNA, 2370 bp, Brachypodium distachyon
cctccgctcccgccgccgccatgccgccgcgccgcaagggaaggggcaggggcaggggcaaacctaagcccaaatccaccgctcccgagcccgtagacgagactgtcgagaccgaggtcgacgccgcggaggacgctaagcccgaagagcagtctgacgaggactccaagggggattcctctgagagcggagccgaggatatggatgccgaggacgccgaggaggaagccgccgacagcaaggcggaggagatggacgcggaggaagccgccgatgccaaggctaacggggccgaggtggagaccaaaggtgaggagatggatgccaaggccgaagcagaagcggaaggtgctgagagcgactccgagggcgaagcagatgctgacgctgatctagaagcggaagcagaggaaaccgacggtgagaatgaagagaaagccgctggcacaggcggcgagagtgaagaggaagccgccgagaccggcggcgagaatgaagaagaagctgacggaactgacggtgaggacggagaggaaggtgctgagactggtggtgagaacgaagacgacggggcggattccgatccagaaggtcagggcacagatgccgagcccgatgctgtcgaggaatcccctcctccctcccctctagcccgcagccgccgtcgtaagagagccaccacgcccgaccctgctcctgaggctgaggaccacgaggcagaggagacccctgtgccaccacgtcgtcggcggcggcgcaagtcaggggaccgcggtaactctccttcaccaccaccagaccacctccggtgccgccgaagtgacgggaagaagtggcgctgccaagctctggcactccccaccgtcagcttctgtgagtaccactatgcgagggctagcaagggcaagaagcctccagccgatggggaggtacttgctgtcgctctccagcggcagaagaagaacaggaggaagggaaggaggagcctgaatctgacgccagcatcacctccaaaggccacaaaggatctcccaaacggattgatgacaatctcgccagggagcagtggggctgcaggctcacctataacgatgaaggtgggagtggacattcctgtgccactccggcggtgctaccgttccaagaatgctgagccattgcctgttggccctgtgaaggttgttcctcgagcaatgggtatggcaaaggcagcagcacagaatgcatgccaccgttgcgggttgaaaaaggttgcacgcgttgtcaagtgcaagaactgtaacaaccagtacttctgcaacagttgcatcaataaatggtattctgggatgtccaagaaggatataaaaatgcaatgtccagtttgccgtggctcttgtgattgtgaagaatgcacccttggtcagtcaaggggtgctatgtctaagggatcagcaagtgatcacagtaaactagtcaggattaaaatctgcaaccaccaactgtacaagcttctaccattaaatcttaaccaggagcagcttgatgaattggaaatagaatctaaaatacaaggaacaaaaatatccaatatccgggtccaggtagctgaagatgaccatagtgggtcactttactgtaataactgtaagctgtccatgcaccaagccttgagaagctgcccgagatgcccttttaagctatgtttaagctgctgtcagaagatacgtgaaggaaatatgtcagacagcacccctgaagataaatttacacaacgattgctgcagcaggagtcggtccaggaggatggcagcataagttgcccttccattgagttgggtggttgtggcgactctctactcaacttgatatatgcacctccttctggccagtctgaggaattcagctcaggagatgagcaagatgctccaggcaatcattctggagataaggatgcccaacctcactcctcgcctttagccgagagtaatggaagccttgccagactatcaggtggtcagcaggaatccatgtccacataattgccggagatgttgcagataaccattcatctttcaggcatgaggtgtcataatttgcggagcaacgagagggctattcattcagaagcctgaaaaggtggggatatggtctgaagatggtagaagatagaatggcttatttagtttgattattggctaatatggccattgattttaggtctgtgacctggagtagttcttccgtgctattcatcttttgaattggactttatgctggctatcagcgtaaatagggtatgactttatctatcatcagtagaaaactgattcaggttgtatcggccgtgctctggttaatctagaactgtctgtactctgttggctattg

SEQ ID NO: 5362 - DNA, 2626 bp, Brachypodium distachyon
ggggcatattggcaggtcctcttaaccccaccccttctattctctccttgtagaaaccagtgacccgctgatctgccgatccctccccaaatcccactcgccggaaccctagcctccgctcccgccgccgccatgccgccgcgccgcaagggaaggggcaggggcaggggcaaacctaagcccaaatccaccgctcccgagcccgtagacgagactgtcgagaccgaggtcgacgccgcggaggacgctaagcccgaagagcagtctgacgaggactccaagggggattcctctgagagcggagccgaggatatggatgccgaggacgccgaggaggaagccgccgacagcaaggcggaggagatggacgcggaggaagccgccgatgccaaggctaacggggccgaggtggagaccaaaggtgaggagatggatgccaaggccgaagcagaagcggaaggtgctgagagcgactccgagggcgaagcagatgctgacgctgatctagaagcggaagcagaggaaaccgacggtgagaatgaagagaaagccgctggcacaggcggcgagagtgaagaggaagccgccgagaccggcggcgagaatgaagaagaagctgacggaactgacggtgaggacggagaggaaggtgctgagactggtggtgagaacgaagacgacggggcggattccgatccagaaggtcagggcacagatgccgagcccgatgctgtcgaggaatcccctcctccctcccctctagcccgcagccgccgtcgtaagagagccaccacgcccgaccctgctcctgaggctgaggaccacgaggcagaggagacccctgtgccaccacgtcgtcggcggcggcgcaagtcaggggaccgcggtaactctccttcaccaccaccagaccacctccggtgccgccgaagtgacgggaagaagtggcgctgccaagctctggcactccccaccgtcagcttctgtgagtaccactatgcgagggctagcaagggcaagaagcctccagccgatggggaggtacttgctgtcgctctccagcggcagaagaagaacaggaggaagggaaggaggagcctgaatctgacgccagcatcacctccaaaggccacaaaggatctcccaaacggattgatgacaatctcgccagggagcagtggggctgcaggctcacctataacgatgaaggtgggagtggacattcctgtgccactccggcggtgctaccgttccaagaatgctgagccattgcctgttggccctgtgaaggttgttcctcgagcaatgggtatggcaaaggcagcagcacagaatgcatgccaccgttgcgggttgaaaaaggttgcacgcgttgtcaagtgcaagaactgtaacaaccagtacttctgcaacagttgcatcaataaatggtattctgggatgtccaagaaggatataaaaatgcaatgtccagtttgccgtggctcttgtgattgtgaagaatgcacccttggtcagtcaaggggtgctatgtctaagggatcagcaagtgatcacagtaaactagtcaggattaaaatctgcaaccaccaactgtacaagcttctaccattaaatcttaaccaggagcagcttgatgaattggaaatagaatctaaaatacaaggaacaaaaatatccaatatccgggtccaggtagctgaagatgaccatagtgggtcactttactgtaataactgtaagctgtccatgcaccaagccttgagaagctgcccgagatgcccttttaagctatgtttaagctgctgtcagaagatacgtgaaggaaatatgtcagacagcacccctgaagataaatttacacaacgattgctgcagcaggagtcggtccaggaggatggcagcataagttgcccttccattgagttgggtggttgtggcgactctctactcaacttgatatatgcacctccttctggccagtctgaggaattcagctcaggagatgagcaagatgctccaggcaatcattctggagataaggatgcccaacctcactcctcgcctttagccgagagtaatggaagccttgccagactatcaggtggtcagcaggaatccatgtccacataattgccggagatgttgcagataaccattcatctttcaggcatgaggtgtcataatttgcggagcaacgagagggctattcattcagaagcctgaaaaggtggggatatggtctgaagatggtagaagatagaatggcttatttagtttgattattggctaatatggccattgattttaggtctgtgacctggagtagttcttccgtgctattcatcttttgaattggactttatgctggctatcagcgtaaatagggtatgactttatctatcatcagtagaaaactgattcaggttgtatcggccgtgctctggttaatctagaactgtctgtactctgttggctattgctgtgtgcgttgagtgtcgtatgctatgcgattagagtatttttgaataaaacgtggatgtcagatagtgaactgaatcttgtatgtcctgttcagatattgatattgagtcggtagaataatgcatgttctgttaggtgaacg

SEQ ID NO: 5363 - DNA, 2096 bp, Secale cereale
tcgggctacccgacgatgaccatggacgagcagaacgccctctgcgcggcgccgttcggcgacccggcgttcaacgccaccatccgccgccgcggcgtgcgcctggccgacgtcgcgtgcctgcccatctcccccgggtggtacggccccgccgaggacggcggccgccggctcatcaagagccagtgctactccacggagggcaccgccaacttctacatgcgccccatcgagggcctcaccgtgctcgtcgacatggacacccggaaggtcgtccacatctccgaccgcggcgccggcatccccatcccggccgccaagaacaccgactaccgccgcgccgccaacgacaacgacgacgacgccgataaattcgggtaccagacggtgcgggcgccgtcgatggagccggcgccggagggcccaggaatccagattgaggacgggcacacggtgcggtgggccgggtgggagttccacctcaaggcggacgcgcgcgccgggctgatcgtgtccagcgcgacggtgcaggacccggccaccggggcgcggagggaggtgatgtacaagggcatggcgtcggagctgttcgtgccctacatggacccgaccgaggcgtggtacttcaagacctacatggacgccggcgagtacggcttcggcctgcaggccatgccgctggtgccgctcaacgactgcccgcggcacgcgcggtacatggacggcgtcttcgtggccgccgacggccggccctacgtgcgggagaacatgatctgcgtcttcgagcggtacgccggcgacatcgcgtggcgacactccgagagccccatcaccggcatggacataagggagtctcgaccgaaggtgacgttggtggccaggatggcggcgtcggtggccaactacgactatatcgttgattgggagttccagacggacggcctcatacgcatcaaggtcgggctgagcggtatcctgatggtgaagggcacgccctactcccacatgaaccaggtccggcaaaacgaggagatgcacggcaccctcctctccgagaatgtcatcggtgtcatccacgaccactacgtcaccttccgtctcgacatggatgtcgacggtgccgacaactccttcgtccgcgtggagatggcccgccaggacaccacgcctggtgaatcccctcggagaagctacctcaaggccacacgccacgtcgcgagcacggagaaggacgcccgggtccggctgaagctctacgagccagccgagttccacgtcatcaacccgacgaagaagacccgggtcgggaacccggtgggctacaaggtggtccccgcgggcaccgccggcagcctgctggaccccgaggaccctccacagaagaggggcgcattcacaaacaatcagatttgggtcacgccctacaacaagagtgaagaatgggccggtgggctgttcgtgtaccagagcaaaggggaggacacgctggctacttggtcggagagggaccgtccgatcgataacaaggacctggtgttgtggtatacgctggggttccaccacatcccttgtcaggaggacttccccatcatgcccactgtgtcgtccagcttcgacctcaagccggtcaacttcttcgagagcaaccccatcctcaagcagcggccaaccatggagaaggacctccccgtctgtgcagctaccgcctgagaccatgcactaggatacatgtgtgctccacatggcacactgggttgttgcccgggacatgaggccgtgcgtaggcttccggcagcaccatgcattgccccgatcgagtcttacataatcctgcctccgccgcctagccaatagcctagtatgtatagctctatgtttgtgttgtatcgtgcttcccccttcatgaacatgaggtgtatttaggccttctaagaatcttggaccaacagtaataaattgggtgtcctacatgaagggaaattaaatttgtggcaagagtttaagctttggacaaccaaaatacatcctagcaaacggagaatggtcgtactaacattagcaataaaatccagcaatctgcatcttgtgtgcaaata

SEQ ID NO: 5364 - DNA, 1983 bp, Avena sativa
cggggcgagtcccacgtgctggccgtcgacctcgaagctgggacggtcactcctctgcctgcccctgcttccgggtacccgacgatgaccatggacgagcagagggcgctctgcgcggcgccgttcgggaacccggcgttcaacgccagcatccgccgccgcggcgtgcgcatggcggacgtggcgtgcctgcccatctcgccggggtggtacggccccgtggaggacggcgggcgccggctcatcaagagccagtgcttctcgaccgagggcacggccaacttctacatgcgccccatcgagggcctcacggtgctgatcgacatggacaccagggaggtggtccacctctccgaccgcggcgccggcatcccatcccggccgccaagaacaccgactaccgccgcgccgccgcagccgaagaagaagacgacgctggtggggctaagacgttcgggtaccaggccgtgcgtgcgccgtcgatggagccggcgccggagggtcccgggttcgaggtggaggacgggcacacggtgcggtgggccgggtgggagttccacctgaaggcggacgcgcgcgccgggctgatcgtgtcccgcgcgggcgtggaggacccgtcgacgggcgcgcgcagggaggtgatgtacaagggcatggcgtcggagctgttcgtgccgtacatggacccgacggaggcgtggtacttcaagacgtacatggacgcgggcgagtacgggttcgggctgcaggccatgccgctggtgccgctcaacgactgcccgcgccacgcgcggtacatggacggcgtgttcgtggccgccgacggccggccctacgtgcgggagaacatggtctgcgtcttcgagcgctacgccggcgacatcgcgtggcgccactccgagagccccatcaccggcatggacataagggagtcccggccgaaggtgacgctggtggctcgcatggcggcgtcggtggccaactacgactacatcatggactgggagttccagatggacggcctcatacgaatcaaggtcgggctcagcgggatcctgatggtgaagggcacgccctactcccacatgaaccaggtccggcggaacgaggagatgtacgggacgctcctttccgagaacgtcgtcggggtcatccacgaccactacgtcaccttccgcctcgacatggacgtcgacggcgccgacaactccttcgtccgggtcgagatggcccgccaggacaccgccccgggcgagtcaccccggaggagctacctcaaggccacccgccacgtggcgagcacggaaaacgacgcgaaggttcggatgaagctctacgagcccgccgagttccacgtcatcaacccaacgaagaagacgcgtgtcggtaacccggtgggctacaaggtcgtcgccgccggcaccgccgctagcttgctcgaccccgaggacccgccgcagaaaaggggtgcattcacaaacaatcagatttgggtcacgccctacaacaagagcgaagaatgggccggtgggctgttcgtgtaccagagcaaaggggaggacacacttgctacctggtcggagagggaccgtccgatcgagaacaaggacatcgtgctgtggtacacgctggggttccaccacgtgccgtgccaggaggacttccccatcatgcccacggtgtcgtccagcttcgacctcaagccggtcaacttcttcgagagcaacccgatcctcaggcagcggcccacccaggtgaacgacctcccggtctgtgccgctaccgcctgagatcgtcgaccattgattcgcgatgatgtagccgtatcatcatctgtgctagtatgtggctagctagtagcctggcagcacgtatggctctacgtttgtgttgtattgtgcttcctatgtccatgatatacaaggtgtattttgatcgacactggatgatgtgacctagtaataaatggatggcatatatgac

SEQ ID NO: 5365 - DNA, 2142 bp, Avena sativa
gtcgcttacccgccgttcgcgtcggcgccgtcgtccctggccgtgcacgagctcgcgctcgacgagccggacaagcccgtcgtccggcgctggcgcaaggacgacgggaacgcgctcccgccgcgccgcgccgtggcggtcgtccgcttccggggcgagtcccacgtgctcgccgtggacctcgaggccgggacggtcactcctctgcctgcccctgcttccgggtacccgacgatgaccatggacgagcagagagcgctctgcgcggcgccgttcggggacgcagcgttcaacgcgagcatccgccgccgcggcgtccgcttggcggacgtcgcatgcctgcccatctcgccggggtggtacggccccgtggaggacggcgggcgccggctcatcaagagccagtgcttctcgacggagggcacggccaacttctacatgcgccccatcgagggcctcacggtgctgatcgacatggacaccagggaggtggtccacctctccgaccgcggcgccggcatccccatcccggccgccaagaacaccgactaccgccgcgccgccgcagccgaagaagaagacgacgctggcggggctaagacgttcgggtaccaggccgtgcgtgcgccgtcgatggagccggcgccggaggggcccgggttcgaggtggaggacgggcacacggtgcggtgggccgggtgggagttccacctgaaggcggacgcgcgcgccgggctgatcgtgtcccgcgcgggcgtggaggacccgtcgacgggcgcgcgcagggaggtgatgtacaagggcatggcgtcggagctgttcgtgccgtacatggacccgacggaggcgtggtacttcaagacgtacatggacgcgggcgagtacgggttcgggctgcaggccatgccgctggtgccgctcaacgactgcccgcgccacgcgcggtacatggacggcgtgttcgtggccgccgacggccggccctacgtgcgggagaacatgatctgcgtcttcgagcggtacgccggcgacatcgcgtggcgccactccgagagccccatcaccggcatggacataagggagtcccggccgaaggtgacgctggtggctcgcatggcggcgtcggtggccaactacgactacatcatggactgggagttccagatggacggcctcatacgcatcaaggtcgggctcagcgggatcctgatggtgaagggcacgccctactcccacatgaaccaggtccggcggaacgaggagatgtacgggacgctcctctccgagaacgtcgtcggggtcatccacgaccactacgtcaccttccgcctcgacatggacgtcgacggcgccgacaactccttcgtccgggtcgagatggcccgccaggacaccgccccgggcgagtccccccggaggagctacctcaaggccacccgccacgtggcgagcacggagaacgacgcgaagatccggatgaaactctatgagcccgctgagttccacgtcatcaacccaacgaagaagacgcgtgtcggtaacccggtgggttacaaggtcgtcgccgccggcaccgccgctagcttgctcgaccccgaggacccgcctcagaaaaggggtgcattcacaaacaatcagatttgggtcacgccctacaacaaaagcgaggaatgggctggtgggctgttcgtgtaccagagcaaaggggaggacacacttgctacctggtcggagagggaccgtccgatcgagaacaaggacatcgtgctgtggtacacgctggggttccaccacgtgccgtgccaggaggacttccccatcatgcccacggtgtcgtccagcttcgacctcaagccggtcaacttcttcgagagcaacccgatcctcaggcagcggcccacccaggtgaacgacctcccggtctgtgccgctaccgcctgagatcgtcgaccattgattcgcgatgatgtagccgtatcatcatctgtgctagtatgtggctagctagtagcctggcagcacgtatggctctacgtttgtgttgtattgtgcttcctatgtccatgatatacaaggtgtattttgatcgacacgggatgatgtgacctagtaataaatggatggcatatatgataaaaaaaa

SEQ ID NO: 5366 - DNA, 1064 bp, Secale cereale
tggccaactacgactatatcgttgattgggagttccagacggacggcctcatacgcatcaaggtcgggctgagcggtatcctgatggtgaagggcacgccctactcccacatgaaccaggtccggcaaaacgaggagatgcacggcaccctcctctccgagaatgtcatcggcgtcatccacgaccactacgtcaccttccgtctcgacatggatgtcgacggtgccgacaactccttcgtccgcgtggagatggcccgtcaggacaccacgcctggtgaatcccctcggagaagctacctcaaggccacacaccacgtcgcgagcacggagaaggacgcccgggtccggctgaagctctacgagccagccgagttccacgtcatcaacccgacgaagaagacccgggtcgggaacccggtgggctacaaggtggtccccgcgggcaccgccggcagcctgctggaccccgaggaccctccacagaagaggggcgcattcacaaacaatcagatttgggtcacgccctacaacaagagtgaagaatgggccggtgggctgttcgtgtaccagagcaaaggggaagacacgctggctacatggtcggagagggaccgtccgatcgataacaaggacctggtgctgtggtatacgctggggttccaccacatcccttgtcaggaggacttccccatcatgcccactgtgtcgtccagcttcgacctcaagccggtcaacttcttcgagagcaaccccatcctgaagcagcggccaaccatggagaaggacctccccatctgtgcagctaccgcctgagaccatgcactaggatacatgtgtgctccacatggcacactgggttgttgcccgggacatgaggccgtgcgtaggcttccggcagcaccatgcattgccccgagtcttacataatcctgcctccgccgcctagccaatagcctagtatgtatagctctatgtttgtatcgtgcttcccccttctaagaatcttgtaccaacagtaataaattgggtgtcctacatgaagggaaattaaatttgtggcaa

SEQ ID NO: 5367 - DNA, 2661 bp, Brachypodium distachyon
ggcgttaagccgtacataagatccctcgatcactgagcttagctcacacagcactcactcagcacggccaaaacaagaacagaggcacgtcctgagcacggagcacctctagctccaatggatcactcgacctccctcctccggctcaccttcttcctcctcggcgcgtctctcctcgtcctcgtcgtccgctccgccttccgcctgcccatcgacgcatccctcttcgacgacgccgccggcagctgcacccgcttctccccatgggcctgccgccaacaaccatcgaagccatcaaagccaccttcccacgaccacaactccgacgtgccgcgccacccgctagacccgctcacggtcaccgaaatcaacctcgccgccgcgctcctccgcgcccacccgcccttctccgagtccccatcctccctcatcatccactccctcgccctcgacgagcccgagaagcccctcgtccgcgcctggcaaaaggccaacaaagctggcctcaacacgccgctccccgcgcgccgtgtcgtggccgtggtccgcttccatggcgagtcccacgtgctctccatcgaccttggccccaacggcgccatcgaggctctccccgtcccggcgtccgggtacccgacgatgaccatggacgagcaggtggcgctctgcgccgcgccgttcgcggacccggccttcaacgcctccatcgcgcgccgcggggtccggataaccgatgtcgcgtgcctgccgatttcctccggctggtacgggcccgacgaggaaggccggcgggtgatcaaggtgcagtgcttctccatggaaggcacggccaacttctacatgcggcccatcgaagggctcacgctcgtcctcgacatggacacccgggaagtcgtgcacatctccgaccgcggcgccggcatccctgtccccgacgccaagaacaccgactacagagtgcacgccggaaccggtgacgatgcaaagaagaagaagcgtggagcggcacaacaggcttcaatggaggagcttggattcgaggtgaaagggcacaaggtgaagtggggcggatgggagatgcacgtgaaggcggacgctagggcggggatggtggtgtccatggcggaagtgcaagggcgggaggtcatgtacaagggcatggcgtccgagctcttcgtcccctacatggatcccaccgaggcttggtacttcaagacgtacatggacgccggcgagtacggcttcgggctgcaggccatgccgctcgtgccgctcaacgactgcccgaggaacgcggcgtacttggacggcgtcttcgtcgccggcgacgggaagccctacgtcaaggagaacatcatctgcgtcttcgagcgctacgccggcgacgtcgcctggcgacactccgaggggcccatctccggcatggacataagggagtcgcgggcgaaggtgacgttggtggcgcggatggctgcgtcggttgccaattacgactacatcatggactgggagttccaaatggacggcctcatacgcatcaaggttggccttagcgggatcctgatggtgaagggcacgccctactcccacatgaaccaggtccgacggaacgaggagatgtatggcaccctgctctccgagaacgtcatcggcgttatccacgaccactacgtcaccttccgcctcgacatggacgtcgacggcgccgacaactctttcgtcaaggtggagatggcccgccataacactgctccgggcgagtcccctcggaagagctacctcaaggccacccgacacgtcgcgagcacagagaaggatgctcaggtccgtttgaaactttacgagccgtcagagttccacctcgttaacccgacgaagaagacacgtgtggggaacccggtaggctataagatcgtcccaggcggcactgccgccagcttgctggcccccgacgacccggcacaaaagaggggtgcattcacaaacaatcagatttgggtcacgccgtacaacaaaagcgaggaatgggctggtggcctgtttgtataccagagcaaaggggaggacacgctggctacatggtcggagagggaccgtccgatcgagaacaaggacctggtggtgtggtacacgctggggttccaccacgtcccgtgccaggaggacttccccatcatgcccaccgtctcggccagcttcgacctcaagccagtcaacttcttcgagagcaaccctatcctgaagcaacggcctgtcaaggaaaacgatctgcccgtctgcgctgcagcctctgccgctgcagcctgaggccgtcgatgacgatgaagttatatccatatatggtaattgttcatgcatgcgcgtccatttatgaatgaacagcgcaaagttccttaccgttgtactgtacttcaaattataaggaagtggtgcgtcggtcgtctggggagctcattcgtgaaggcgttggttaaactagtattggctgtttagtagctgtagtttggaatgttggttcttcctgttgatctgttctgacgttggctgtgtttgttggtggttgttttgcttttatcacaggtatccctagcgggatcttgtttcggctttctaataaagttgggcccaaaaagctttttatcgataaaaggacataatgga

SEQ ID NO: 5368 - DNA, 2680 bp, Brachypodium distachyon
gttaagccgtacataagatccctcgatcactgagcttagctcacacagcactcactcagcacggccaaaacaagaacagaggcacgtcctgagcacggagcacctctagctccaatggatcactcgacctccctcctccggctcaccttcttcctcctcggcgcgtctctcctcgtcctcgtcgtccgctccgccttccgcctgcccatcgacgcatccctcttcgacgacgccgccggcagctgcacccgcttctccccatgggcctgccgccaacaaccatcgaagccatcaaagccaccttcccacgaccacaactccgacgtgccgcgccacccgctagacccgctcacggtcaccgaaatcaacctcgccgccgcgctcctccgcgcccacccgcccttctccgagtccccatcctccctcatcatccactccctcgccctcgacgagcccgagaagcccctcgtccgcgcctggcaaaaggccaacaaagctggcctcaacacgccgctccccgcgcgccgtgtcgtggccgtggtccgcttccatggcgagtcccacgtgctctccatcgaccttggccccaacggcgccatcgaggctctccccgtcccggcgtccgggtacccgacgatgaccatggacgagcaggtggcgctctgcgccgcgccgttcgcggacccggccttcaacgcctccatcgcgcgccgcggggtccggataaccgatgtcgcgtgcctgccgatttcctccggctggtacgggcccgacgaggaaggccggcgggtgatcaaggtgcagtgcttctccatggaaggcacggccaacttctacatgcggcccatcgaagggctcacgctcgtcctcgacatggacacccgggaagtcgtgcacatctccgaccgcggcgccggcatccctgtccccgacgccaagaacaccgactacagagtgcacgccggaaccggtgacgatgcaaagaagaagaagcgtggagcggcacaacaggcttcaatggaggagcttggattcgaggtgaaagggcacaaggtgaagtggggcggatgggagatgcacgtgaaggcggacgctagggcggggatggtggtgtccatggcggaagtgcaagggcgggaggtcatgtacaagggcatggcgtccgagctcttcgtcccctacatggatcccaccgaggcttggtacttcaagacgtacatggacgccggcgagtacggcttcgggctgcaggccatgccgctcgtgccgctcaacgactgcccgaggaacgcggcgtacttggacggcgtcttcgtcgccggcgacgggaagccctacgtcaaggagaacatcatctgcgtcttcgagcgctacgccggcgacgtcgcctggcgacactccgaggggcccatctccggcatggacataagggagtcgcgggcgaaggtgacgttggtggcgcggatggctgcgtcggttgccaattacgactacatcatggactgggagttccaaatggacggcctcatacgcatcaaggttggccttagcgggatcctgatggtgaagggcacgccctactcccacatgaaccaggtccgacggaacgaggagatgtatggcaccctgctctccgagaacgtcatcggcgttatccacgaccactacgtcaccttccgcctcgacatggacgtcgacggcgccgacaactctttcgtcaaggtggagatggcccgccataacactgctccgggcgagtcccctcggaagagctacctcaaggccacccgacacgtcgcgagcacagagaaggatgctcaggtccgtttgaaactttacgagccgtcagagttccacctcgttaacccgacgaagaagacacgtgtggggaacccggtaggctataagatcgtcccaggcggcactgccgccagcttgctggcccccgacgacccggcacaaaagaggggtgcattcacaaacaatcagatttgggtcacgccgtacaacaaaagcgaggaatgggctggtggcctgtttgtataccagagcaaaggggaggacacgctggctacatggtcggagagggaccgtccgatcgagaacaaggacctggtggtgtggtacacgctggggttccaccacgtcccgtgccaggaggacttccccatcatgcccaccgtctcggccagcttcgacctcaagccagtcaacttcttcgagagcaaccctatcctgaagcaacggcctgtcaaggaaaacgatctgcccgtctgcgctgcagcctctgccgctgcagcctgaggccgtcgatgacgatgaagttatatccatatatggtaattgttcatgcatgcgcgtccatttatgaatgaacagcgcaaagttccttaccgttgtactgtacttcaaattataaggaagtggtgcgtcggtcgtctggggagctcattcgtgaaggcgttggttaaactagtattggctgtttagtagctgtagtttggaatgttggttcttcctgttgatctgttctgacgttggctgtgtttgttggtggttgttttgcttttatcacaggtatccctagcgggatcttgtttcggctttctaataaagttgggcccaaaaagctttttatcgataaaaggacataatggatgtccatactcatttgctacta

SEQ ID NO: 5369 - DNA, 1148 bp, Pennisetum glaucum
ggcgagactcggagagccccatcaccggcatgtacataagggagtcgcggccgaaggtgacgctggtggcgcggatggtagcgtccgtcgccaactacgactacatcatggactgggagttccagatggacggcctcgtccgcatcaaggttgggctcagcggcatcctcatggtgaagggcacggcctactcgcacctgaaccaggccaaggagaacgaggacatgcacggcacggtcctctccgagaacgtcatcggcgtcatccacgaccactacgtcaccttccgcctcgacatggacgtggacggcgccggcaactccttcgtgcgcgtcgagatggcgcgccaggagaccggccccggcgagtccccccggaggagctacctcaaggccacccgccacgtcgcgcgcaccgagaaggacgcccaggtgcgtctcaagctctaccagccggaggagttccacgtcgtgaacccgaccaagaagacgcgcgtcggcaaccccgtcggctacaaggtcgtccccgccggcaccgccgccagcttgctcgaccccgaggatccgccgcagaagagaggcgccttcacagacaatcagatatgggtgacaccctacaacaagagcgaggaatgggcaggtggtctgttcgtgtaccagagcaaaggggaggacacgctggccacttggtccgagagggaccgccccatcgagaacagggacctggtgctgtggtacacgctggggttccaccacatcccgtgccaggaggatttccccatcatgcccaccgtgtcctccagcttcgacctcaagcccgtcaacttcttcgagagcaaccccatcctcaagcagcgcccgacccaggaccacgacctgcccgtctgtgctcccgctacatgaggacgtgcgcgcacccgtccagcagcggccgtgcatggacgcgtgttcccctttcccacctgttatgtaccgtacgttgggatgtagccatgttatgcccttgcgtgctagtgctaccagctatatagtacgtgatgatgcagcttactgtcatctcctctctgccatgtatgaccaaattaaatgaggactttgggtacatgcatactccctctctccaaaaaaagcaattctcgcttttcgatg

SEQ ID NO: 5370 - DNA, 1020 bp, Triticum aestivum
tcaaggtcgggcgtcagcgggagtcctgatggtgaagggcacgccctactcccacaatgaaccaggtccggcgaaacgaggagatgcacgggaccctcctctctgagaacgtcatcggcgtcatccacgaccattacgtcaccttccgccttgacatggacgttgatggcgccgacaactccttcgtccgcgtcgatatggcccgccaggacaccgcgcccggcgagtccccccggaggagctacctcaaggccacacgccacgtcgcgagcacggagaaggacgcccgggtccggctgaagctctacgagccggccgagttccacgtcatcaacccgacgaagaagacgcgggtcgggaacccggtgggctacaaggttgtccccgccggcaccgccggcagcctgctcgaccctgaggacccgccacagaagagaggtgcattcacaaacaatcagatttgggtcacgccctacaacaagagtgaagagtgggccggtgggctgttcgtgtaccagagcaaaggggaggacacgctggctacttggtcggagagggaccgtccgatcgagaacaaggacctggtgctgtggtacacgctggggttccaccacatcccttgtcaggaggacttccccatcatgcccactgtgtcgtccagcttcgacctcaagccggtcaacttcttcgagagcaaccccatcctcaagcagcggcccaccatggagaaggacctccccgtctgtgccgctactgcctgagaccatgcaccaggatacatgtgtgctcgaagacaacccccgggcacactgggctgttgcccggggcatgaggccgtgcgtaggcttccggcagcaccatgcagtgcccctagccttacataatccgtcctctgcctctggctagccaatagccttagtatgtatagctctatgtttgtgttgtatggtgctccccccttcatgaatatgaggtgtatttaggctgtctacgaatcttggaccgatggtaataaattgg

SEQ ID NO: 5371 - DNA, 2779 bp, Oryza sativa
gctcatgacctgcagaactggttgggctctgatgcgcagaaattcgaattgactagcagatcagaatgcccatataaaaaaagggaaatgttagtgtgagaaattaaataagaaaatcggacaacgagcattccaccacgagctagcttcccaagtttacgaatcagcatatatagtggaccatttctcagttagctcactacaaagcacaaaggccagagcgaaggccactccaatggatcactccacctccctgctccggctcatcttcctcgccctcggcgcagccctcgtcgtccttgtcgttcgctccgcgttccgccttcccggcgacatcgacacgactacgacctctctgttcgatgatggcaacggcggcagctgcaccaggttctcgccgtgggcgtgccggcaagggcggggcgacccgaggtcgaagccgtccaagccgcggcgaccgtcgcacgagtccgacgtgccgcggcacccgctcgacccactcacggtgagggaggtgaaccgcgtccgcgagctcctccgcgcgcacccgctgtttgcgtcggcgccgtcgtccctgttcgtgcactcgctggagctcgacgagccggaaaagtccgtcgtcaagagctggcggaagggcgccgacccgctcccgcctcgccgcgccgtggccgtcgtccggttccgcggcgagtcccacgtcctcggcgtcgacctcagcgagggcgacggcgcggtgactcctctgcctgtccctgcctccggttacccgatgatgaacatggacgagcagaccagcctctgcttcgcgccgttcaaggacgaggcgttcaacgccagcctcctccgccgtggcgtcagggcctccgacgtcgcctgcctgcccatctccctcggctggtacggcccagcggaggagaaccggcgactcatcaagagccagtgcttctccaccgagggcacggccaacttctacatgcgccccatcgagggcctcaccgtgctggtcgacatggacacggcggaggtcctccacgtctccgaccgcggcgccggcatccccatccccgccgccgcgaacaccgactaccggcacggacactcggcgccgactccggcggaggcgcaagcgcaggggcggcacgggtaccagaccgtccgcgtgccgtcgatggagccgccggcgggcgggccgggttcgagctggtcgacgggcacacggtgcggtggggcgggtgggagttccacctgaagcccgacgcgcgcgccggcatggtggtgtcgcgggcgcgggtgcaggacccggcgaccggcgagcaccgcgacgtgatgtacaagggcatggcgtcggagctgttcgtgccgtacatggacccgacggaggcgtggtacttcaagacgtacatggacgccggcgagtacggcttcgggctgcaggccatgccgctcgtcccgctcaacgactgcccgcgccacgcccgctacctcgacgccgtcttcgtcgccgccgacggccgcccctacgtgcgcgagaacatgatctgcgtcttcgagcgctacgccggcgacatcgcgtggcgacactccgagagccccatcaccggcatggacataagggagtcgcggccgaaggtgacgctggtggcgcgcatggcggcgtcggtggccaactacgactatatcgtcgactgggagttccagatggacggcctcgttcgcatcaaggttgggctaagtgggatcctcatggtgaagggcacccagtactcccacatgaaccaggtccatcaaaatgacaatatgtacggcacccttctgtctgagaacgttattggcgtcatccatgaccactttgtcactttccggctcgacatggacattgacggcgccgacaactccttcgtcaaggtggcgatggcacgacagaacaccggcgccggcgaatcccctcgtaagagctacctgaaggctacccgacatgtcgcaaggacggagaaagatgcccaggtccgcctgaagctatatgagccatccgagttccacattgtcaaccccatgaagaagacacgagttgggaaccctgttggttataaggttgtcccagccggtactgcagctagcctgttggatccagaggacccacctcagaagaggggtgcattcacaaataatcagatttgggtgacaccctacaacaaaacagaggaatgggctggtggtctatttgtctaccagagcaaaggggaggacacacttgcaacttggtccgaaagggaccgtccgatcgagaacaaggacctggtgctgtggtacacgctggggtttcaccatgtcccgtgccaggaggacttccccatcatgcccacggtgtcgtccagcttcgaccttaagccagtgaacttctttgagagcaaccccatcctagggcagcgtccgacccaggagaacgacctgccggtgtgtgccgccgctgccacgacctcttgagacgacagcggatcaccgacatgtgtgcgtgcatggtcgatgcttcggtgtatcgatctactgatatggattgttcatagtgaaagaatgtatcggtacatctacggatttggagctagccatggctggctatctatgttgctctatatatgtatgagcggatgtatgtgcactgcagtggtatgaacataattgagaacctgaaaggagcaggcttcaaggctgcactcaagtttcccttggaactactatggcggaccattacaatacaaacccacaaaagggaagaagc

SEQ ID NO: 5372 - DNA, 1220 bp, Panicum virgatum
ctgggagttccagatggacggcctcatccgcatcaaggttggcctcagcggcatcctcatggtgaagggcacggcctactcccacctgaaccaggcccgcgacaacgaggacatgcacggcacgctcctctccgagaacgtcatcggcgtcatccacgaccacttcgtcaccttccggctggacatggacgtcgacggcgccgacaactccttcgtgcgggtcgacatggctcgccaggagacaagccccggcgagtctccccggaggagctacctcaaggccactcgccgcgtcgcccggaccgagaaggaggcccaggtgcgcctcaagctctacgagccggcagagttccatgtcgtcaacccaaccaagaagacgcgcgtcggcaaccccgtcggctacaaggtcgtccccgccggcactgccgccaccttgctcgaccccgaggatccgccgcagaagagaggcgccttcacgaacaatcagatatgggtgacaccctacaacaagagcgaggaatgggcaggcgggttgttcgtgtaccagagcaaaggggaggacacactggccagttgggctgacagggaccgtccgatcgagaacagggacctggtgctgtggtacacgctggggttccatcacatcccgtgccaggaggacttccccatcatgcccaccgtgtcctctggcttcgacctcaagccggtcaacttcttcgagagcaaccccatcctcaagcagcgaccgaccatggaggaggacctgccggtctgtgccgccgccaccactgcgtgagccccatagctggcaggcgaggtgatgctttagtgcatcatctatcagtggctctggagtagagcgtgttattatgtaccattgggcatatagggccgggccagggcaggactgatgattaattggagccatgtcctgtgtgctcttgctgctagtagctactccggatatatagtaagtatgtgatgataatgcagctgtgtgatctcatgatctgctgtactctatgtcaaaactaaatgaggacttccaattgctatgacatcagtagatagcccttggattatagaagagcgatagatctacgcggccatgctgtcagacaaaaataaggctgttcagttagaagtctttattgatgtgggcatgacgcgcatggatacgatcattcaacaaaaatatacggtgagcttgttcctataat

SEQ ID NO: 5373 - DNA, 1119 bp, Saccharum officinarum
gctggtagcgcggatggttgcgtccgtggccaactacgactacatcatggattgggagttccagatggacggcctcgtccgcatcaaggtcggcctgagcgggatcctgatggtgaagggcacggcctactcgcaccttgggcaggcccgcgagaacgaggacatgcacggcacgctgctctccgagaacgtcatcggcgtcatccacgaccactacgtgacgttccgcctggacatggacgtcgacggcgccgacaactcgttcgtgcgcgtggagatggcccggcaggagacggcccccggcgagtcgccccggaggagctacctcaaggccacccggcacgtggcgcggaccgagaaggacgcccaggtgcgcctcaagctctacgatccggcggagttccatgtcgtcaaccccgccaagaagacgcgggtcggcaaccccgttggctacaaggtcgtccctgccggcaccgccgccagcttgctggacccggaggatccgccgcagaagaggggtgctttcacaaacaatcagatctgggtgacaccctacaacaagagcgaggaatgggccggcggtctgttcgtgtaccagagcaaaggggaggacacactggctacttggtccgagagagaccgtccgatcgagaacaaggacctggtgctgtggtacacgctggggttccaccacatcccgtgccaggaggacttccccatcatgcccaccgtgtcctcaagcttcgacctcaagccagtcaacttcttcgagagcaaccccatcctcaagcagcggcccaccaaggaggatgatctgccgatctgtgccgccaccgccgcgtaatcgatcagtgccgcatgcgacgccatccatggacgacacggccggcggcgatgtttcggtgcatctatcgtgagtcggtgggcatggacgtgggcgcatatgtattccgtcctagcctaagagggcgaactgattaactggacccatccatgagcttgcaatactgttgtgtgttcttgctagctttaatacgtacctggggcagccgtatcgatctcatctgtgttatgttaaatcagaactttgatcagctaatgcatggagcatattggttg

SEQ ID NO: 5374 - DNA, 2253 bp, Amorphophallus konjac
gcacatcgcccagcccaggccgcaagctcccggcgctgccgccagaaaccccttccccaccaagcccgaccagctccgccggaccccccgtcacccgctagaccccctgacaatcggggagataaacaccgcccgcgcggcgctcctcgcccacccgcccttctcctcctcccccggctccgtcaccgtccactccctcgtgctggaggagcccgacaaggcccttgttctcgcatggcgccccggcgacccggtccctccccgagtcgcctcggtcatcgcgcggttccgcggccatacccacctactcaccgtcgagctggcgccagcgagggtcgcctcccacaccgagcccgaccccgacgcctcgtccgggtaccccgccatgaccatcgaggatatgacctccgcggtgtgggcccccctctcggacccggccttcaaccggaccgttctctcccgcggcgtccggctctccgacgtcgcctgcctccccatctccagcggctggttcggcgccgccgaggagcgccgccgcctcatcaaggtgcagtgctactccgccgaggacaccgccaacttctacatgcgccccatcgagggcctcacggtcctcctcgacatggacaccctccgcgtcgtctccatctccgaccgcggccgcgacatccccatccccaaggccgccggcacggactacctatactcggcctcctccgcctccgacgccgacggatccaggacccccgccgtgaaccccatctccatcgagcagcccaagggcccgagcttcacggtggaggacggccacatggtccggtgggcggggtgggagttccacctgaagccggacccccgagccggggttgtgctgtcgcgggtggccgtcgccgaccccgacacaggggagcttaggagcgtcatgtacaaggggatgacctcggagctgttcgtgccgtacatggacccgaccgaggcctggtacttcaagacctacatggacgccggcgagtacggcttcggcctgcaggccatgccgctagtccccctcaacgactgcccccgcaacgcctactacatggacggcgtgttcgcggcggcggacggtcgcccctacgtccgggagaacatggtgtgcgtcttcgagagctatgccggcgacatcgcttggcgccacgccgagagccccatcacgggcatggggataagggaggtgaggccgaaggtgacgttggtggtgcgcatggccgcctctgtggcgaattacgactacatagtggactgggagttccagatggacggccttatccggattaaggtggggctcagcgggatactaatggtgaagggcactccctacgtgaacaagaaccaggtgccgaccaacgaggagatgtacggaacgttgctgtcggagaacgtcgtcggcgttatccacgaccacttcatcaccttccggctggacatggacgtcgacggcgccgacaactcgttcgtcaaggtgggattggcgaggcagggcacggcaccgggggagtcaccccggacgagctacctcaaggcaacccggcgggtggcgaggacggagaaggacgcgcaggtgcggctcaagctgtacgacccggccgagttccacgtcgtcaacccggggaagacgacccgggtggggaaccccgtcggctacaaggtggtttccgccggcaccgccgccagcctgctcgaccccaacgaccccccgcagcggcggggcgccttcaccaacaaccagatatgggtgacgccttacaacaagagtgaggaatgggcaggcgggctcttcgtgtaccagagcaagggagaggacacactggccgtgtggtcggagagggaccggccgatcgagaacaaggacatcgtgctgtggtacactctagggttccaccacatcccctgccaggaggacttccccatcatgcccaccgtgacgtccagcttcgacctgaagcccgtcaacttcttcgagagcaaccccgtcctgcgcatggcgcccaacttcgccaaggacctcccctcctgcagggcgggcgcgacgccggcgtagtgtgtgtctggtctcgtggctgtgtgctgccgtactgcaaactacacacgacggctcccgtggagaacagccttgatgtgaatagacatatatggctttgacagactttaacgcttttaggaaagaagctaggcgagcaaaatggatctccgtgaatgttatcagaattgaat

SEQ ID NO: 5375 - DNA, 2228 bp, Silene vulgaris
catgtccatgaccatacatctgatgttccacgtcatcctttggacccactaacagtccaggagatgaaccgggtgcggaccattttgtcctcacacccgctctttaagaacgcaaagtcctacgccctgcataacgttgttgtcgaggagccttcgaagacacttgttgtgaaatggaaggaaggggactccttgccccctaggaaggcttcagtcgttgcacgtgtggatggggttaagcatgtgcttagtattgacttggggttgggtcgggttgtaagggttgatacgggtaggttgtctgggtacccgactatgactatcgaggatatgaggttggctacttttgctccgttgtcgagtgctgagtttaataagacgattttggaccgtggagttgacttggccgatttggcttgtttgcccatctcctcaggatggtttggcaagaaagtagaggaaaagaggaggttgatcaaggtacaatgctacacgatgaaagacacagccaacttctacatgagaccaatagaagggctcactgtactagttgatctggatactaatgaagttatagagatcactgatcatggcaaggaaatcccaattcccaaagctgctaacacagactaccgcctctcggctcagaccaacacccacaacaaaatcaagcctgtcaacccaatatcaattgagcagcctaggggcccaagcttcacagttgaaggacacatggttaaatgggcaaactgggagtttcacctcaaacctgacccaagagccggggtgatcatatcacgagccatggtccgggaccctgatagtggggagctaaggagtgttatgtacaaaggcatgagctctgagttatttgttccatacatggatcctacagatgcatggtatttcaaaacatatatggatgcgggtgaatacgggtttgggttacaagctatgcctcttgtacctcttaacgactgcccaaggaatgcatattacatggatggtgtgtttgcagctggtgatggaacgccttatgtgaggtccaacatggtttgtgtgtttgagagttatgcgggtgatattgggtggcggcactccgagagtccaattacaggattggagattcgtgaggcaaggccaaaggtgacgcttgttgcaagaatggctgcttcggtagctaactacgactatatagtggactgggaatttcaaactgacgggctaatcagaatcaaggttggactaagtggtatattgatggtgaaaggcacaccatacatgaacatgaaccaagttccaaaccaagaaaacttgcatggaaccttattgtccgaaaatgtcattggtgttatacatgaccattacatcacattctatctcgacatggacattgatgactcggataattcctttgtgaaagtgaacttgaagaggcaagatacctctccaggggagtcacctcgcaaaagctacttaaaagctgttagaaacgttgctaagacggagaaggatgctcaaataaagctcaagctctatgacccgcatgagttccacgtggttaacccgaacaagaaaaccagagtcggtaacccggttggatataaggtggttcctgctggtacagcggctagcctacttgatcctgaggatccgccccaaaagagaggggccttcaccaataaccagatatgggtcactccgtacaataaaagcgaggagtgggctggcgggacctttgtttaccaaaatgaaggcgaagataatctcgcttcatggtctaacagggatagggcaatagagaacaaagatatagtgttatggtacaccttaggatttcatcatataccatgtcaagaggatttcccaatcatgccaacagtgtcatcaagctttgatctgaagcctgtcaatttcttcgagagcaatcccatccttggagttcctccgaactttgaaaaggatctcccagtttgccaagctgccactgcttctgcttgaaacagaacaagtaagtcaattgtgtaaaaatttcggaattatgggaatatatgattcgccctttttcactgtcccttaggtgtaacttcagcatgatcctgtgtctcatcaaatatcccgagactcctaagtcccaattctgattgtagtctttttttccgttatttatacgtcattatgttccctgtattatatggacggtgcaaaagctactataatgatgtttt

SEQ ID NO: 5376 - DNA, 2645 bp, Elaeis guineensis
tccgcaaggctgacttcctcgactgcacacgctactcgccttggtgcaactccaagaaccgcatccaatccaaatcccgtccccacttgacccagtcctcctcccactccgccaccacctccacccgagaccacgagtacgacgtcccccgccacccactcgaccccctcaccgtccaagagatcaacaccgcccgctcaatcctccactcctaccctcccttctcctcctcgccctcctccctcgtcatccactccctctccctagacgaaccccctaagcccaccgttctcaagtggagtcccggcgacaccctcccccccgccgcgccgccgtcgtcgcccgcttccgcggagatccttatgtcctctccgtcgacctgtcctccggcaccgtcactcgccaccccgtcccggcttccggttttcccgtcatgaccgtcgacgacatgacctcctccatctgggcccccctcgccgaccctgccttcaaccgctccatcctggcccgaggcgtccgcctctccgacctcgcctgcctccctatctctctcggatggttcggcgccagggaagagggccgccgcctcatcaaggtccagtgctactccgccgagggcaccgccaacttctacatgcgccccatcgagggcctcaccgtcgtcctcgacatggacaagaaagaagtcgttaacatctccgacgttggccgtgacatccccatccccaagtcagccggcaccgattaccgctacgacctcgtcgcggcccagaacggggcacccaagatccggccgctgaacccaatatcgatggagcagccggccgggcccagcttcgtggtggagggggggcacgtggtgaagtgggcggggtgggagttccatctgaaggcggatgcgagggccgggctagtggtatcggcggcctcggcggtggacccggagactggggagaagagggcggtcatgtacaagggcttcacgtcggagctgttcgtgccatacatggaccccaccgacgcctggtacttcaagacgtatatggacgccggggagtacgggttcgggcttcaggcgatgccgctggtgccgcttaacgactgcccccggaacgcctactacatggatgcagtgttcccggcggccgacgggaggccatacgtccggtcgaacatggtgtgcctcttcgaaaggtacgcaggggatatcgggtggcgccactcggagagtcccatcaccggcatggagatacgggaggtcaggccgaaggtgacgttggtggcgaggatggcagcatctgtagcgaactacgactacatagtggactgggagttccagacggatgggctcatccgcgtcaaggttggactcagcgggattctaatggtgaaaggaacatcctactcgcacatgaaccaagtttcaccaaaacaggacatgtacggcaccctcttgtcggagaacgtgatcggcgtcatccacgaccactacatcaccttccacctcgacatggacgtcgatggcgtcgagaactcctttgttaaggtcgatatagcgaggcaggagaccatccccggggagtcccctcggatgagctacctcaaggccacccggcacgtcgccaagacggagaaggacgcacagatcaggcttaagctctatgcgccgaaggagttccacatcatcaatccattcaagaccaccaaagttggaaacccggtcgggtacaaggtggttccggccggcaccgccgccagcttgttggatcccaacgatcccccacaactcagaggcgcttttacaaacaatcagatttgggtgacaccatacaacaagagcgaggaatgggcgggagggttatttgcgtaccagagcaaaggggatgacacgctagccgtctggtctgagagggaccggccgatagagaacaaggacatcgtggtgtggtacacgatgggatttcaccacgtaccatgccaagaggacttcccgatcatgcccacggtcttctcgagctttgatctcaagcctgtcaacttcttcgagagaaatcccatccttgtggcgccgcccaacatggagaaggacctcccggtttgcacagcggctgccacggcctgaaagcgctgcgagcgccaatctgatccccgcgtgttatgggtggcagaaatctattcatacatttgtatgagttgatgaaaaattggacccacatgtaagacagctctggattatgtgtgccttatgaatgaaagaagcaacagaaagtaagtcttaatagttgaataggagcaaattaaggaaatggtatgtggatctcgcttgtagcactattatgctgctacccatctgtgtgcaatagtcagattgcctggtaataattctgtttgatgacatacgaccaatataatttgagggtaagcaattagagccaatataatatgggacgtaattaagggtagcaccatgctgctgccgccctgatgcttgttgtattccatgggtccaagttgtaagaatttgctatgtattaggcaataaaggatgtggtgtggaatatattggcatttgccatctagattgaacctaggaatcacaaagaatatgagaaaatttttgttgatgctttcctatgaaaaaaaaa

SEQ ID NO: 5377 - DNA, 2552 bp, Citrus sinensis
atctgcatagtactgtatacttcgcatactttcactctctgttctcccccatcacactgatccgcgatcggtcgctcactcaaaataataattcattcctaatcatttagtttatggaatcaagacactatattcgcttcctgtttttcttcgtcggcatagccactcttctagccatcacatggaacaatctcccctacgcgccgcccgacgcgactgaggatttcgactgcaccacctattcatcatggtgcacctccaagaatcgcttccaaagcaaaccccttaaagaacccgcaaaatccacaagccaccaccacgaccacgcttcagacacgcctcatcaccctttagacccgctcaccgtcaaagaaatcaatcgcgtccgtaccatcctcacctcccacgagctcttcaagaactcctttccctacgcgttccactccatcaccttgcaagaacccaaaaaatcacttgtcctgaactggaacaaaggtgactctttgttaccgaggaaagcctccgttgtcgcacgtgtgaaaaacatatcatacgtgttagctgtcgatttaacgaccgaagaggtaaccgtacacgagacagattcatcgtccggttatcctgccatgactatagaagacatgacgtcgtcaacatgggccccacttgcggacgaggagttcaaccgtacgatccttgagcgaggggttgatctgaaggacttggcgtgtcttccgatttcgttgggttggtatggagagaaagaggagaacaggaggttgattaaggtgcagtgctactccatgaaggatactgcaaacttttacatgcgaccaatcgaagggttgaccatactcctcgacatggacacgaaggaagtgttggaaattacggacaagggcaagaacataccaataccaaaggccgtcaacacggattatagatattccgctcaggggttgcaccaacgaatgaagctgataaatccaatatcattagagcagcccgaaggtccaagttttgtaattgaagatgagcatcttgttaaatgggcaaactgggaatttcacttgaaacccgacccgagagctgggttgattgtttctcaggctcgggtgagggacccggatagtggggagataaggaatgtgatgtataaagggtttacgagtgaattgtttgtgccttacatggaccccactgatgcatggtattttaagacttatatggatgcgggtgaatatgggtttgggttgcaggccatgccccttgacccgctaaatgattgtccgcggaacgcccactatatggatggtgtgtttccagctgctgatggaacgccgtacgttcgatcaaacatgatttgcatatttgagagctatgccggcgatattgggtggcgccacgcagagagtccgattacgggtatggggattaaagaagtaaggccaaaggtgacgttagtggttagaatggcagcatccgttgccaattatgattatattgttgattgggagtttcaaacagacggactaatcagaattaaggttggactaagtgggattctgatggtgaaaggcacagcctatgagaatatgaaccaaatttccaaccaagctgaaaatctatttggcacccttttgtccgaaaatgttatcggtgtaatccatgaccactttatcacattctacctcgatatggacatagatggctctgataattccttcgtgaaggtaaatattaagaggcaggaaacctcacctggagagtcaccaaggaggagttacttgaaagctgttagaaatgtggctaaaacggagaaagatgcacaaattaagcttaaactctacgacccagctgaattccatgtgatcaatccgactaagaagacacgggtggggaacccggttgggtacaaggtggttcctggtggcactgctgctagcttgcttgatcgtgaagatccacctcaaaagcggggcgcatttactaataatcagatatgggttaccccgtataacgagagcgagcaatgggctggtgggttgtttgtttatcaaagcaaaggtgaagacactcttgcagtttggtctgacagggatcgatcgattgagaataaggacattgttctctggtacacgcttgggttccatcatataccatgccaggaagattttcccattatgcctactgtatcctcaagctttgatttgaagccagtgaatttctttgagagtaaccccattcttcggatcccaccaaatgttgagaaggatcttcctgtttgcaaggcagctgcttcagcttgaaacccaattctctgtctctgttgtagaacttgcgtaattggtgggtaatgacggaatagaaaactttgcccacgtacatatatagtgtctcaacacatatcggtgactatcaccaataaaatcaaaatatcagggacactacacttggttctattgtagcttgttagttttgcttcttatctatgctctgtactgaaaacctactctttgacggaatcgactttttggaaattttacttggtt

SEQ ID NO: 5378 - DNA, 2885 bp, Citrus clementina
ataagggaagccagaccaaaggtgacgcttgtggctcgaatggcagcatcaaatgggaaactatgactgcatatttgactgggaacttcaaacggacggtttgattcttattaagaatttgtaccaggtgtccaagccgggatacatgtctgggcccctggtatgcgaaaatgttatcggcgtagttcatgatcacttcatcacgctccacctggacatggacattgatggggctaataattcatttgttgaggttcatctggagaagcaagagacctccccaggcgaatctccgagaaagagctatttaaaaattgagcagtgtcttaatctctatgatccatctgaatttcacgtaatcaatccctcaaggcggtctcggtcgggaaatccttcagggcacaaagctgtccctggaggaaatgctgctacgttgctcagaagtgctttcaccaacaaatagatacggcgaccccgtctgatcggaatgaacaatgggctggtgggcttttggtttatcaaagcagggaagatgaagcacttgctgtgtggtccgagatgtgtaataaaactgaaaacccgaagcttaggatgtgtttggtgccgttttacacatatcatttttcattttacaaaaatacaaaaaaaaaaaaaaaaaggtacacgcctcatcaccctttagacccgctcaccgtcaaagaaatcaatcgcgtccgtaccatcctcacctcccacgagctcttcaagaactcctttccctacgcgttccactccatcaccttgcaagaacccaaaaaatcacttgtcctgaactggaacaaaggtgactctttgttaccgaggaaagcctccgttgtcgcacgtgtgaaaaacatatcatacgtgttagctgtcgatttaacgaccgaagaggtaaccgtacacgagacagattcatcgtccggttatcctgccatgactatagaagacatgacgtcgtcaacatgggccccacttgcggacgaggagttcaaccgtacgatccttgagcgaggggttgatctgaaggacttggcgtgtcttccgatttcgttgggttggtatggagagaaagaggagaacaggaggttgattaaggtgcagtgctactccatgaaggatactgcaaacttttacatgcgaccaatcgaagggttgaccatactcctcgacatggacacgaaggaagtgttggaaattacggacaagggcaagaacataccaataccaaaggccgtcaacacggattatagatattccgctcaggggttgcaccaacgaatgaagctgataaatccaatatcattagagcagcccgaaggtccaagttttgtaattgaagatgagcatcttgttaaatgggcaaactgggaatttcacttgaaacccgacccgagagctggggcgattgtttctcaggctcgggtgagggacccggatagtggggagataaggaatgtgatgtataaagggtttacgagtgaattgtttgtgccttacatggaccccactgatgcatggtattttaagacttatatggatgcgggtgaatatgggtttgggttgcaggccatgccccttgacccgcttaatgattgtccgcggaacgcccactatatggatggtgtgtttccagctgctgatggaaggccgtacgttcgatcaaacatgatttgcatatttgagagctatgccggtgatattgggtggcgccacgcagagagtccgattacgggtatggggattaaagaagtaaggccaaaggtgacgttagtggttagaatggcagcatccgttgccaattatgattatattgttgattgggagtttcaaacagacggactaatcagaattaaggcaagttggactaagtgggattctgatggtgaaaggcacagcctatgagaatatgaaccaaatttccaaccaagctgaaaatctatttggcacccttttgtccgaaaatgttatcggtgtaatccatgaccactttatcacattctacctcgatatggacatagatggctctgataattccttcgtgaaggtaaatattaagaggcaggaaacctcacctggagagtcaccaaggaggagttacttgaaagctgttagaaatgtggctaaaacggagaaagatgcacaaattaagcttaaactctacgacccagctgaattccatgtgatcaatccgactaagaagacacgggtggggaacccggttgggtacaaggtggttcctggtggcactgctgctagcttgcttgatcgtgaagatccacctcaaaagcggggcgcatttactaataatcagatatgggttaccccgtataacgagagcgagcaatgggctggtgggttgtttgtttatcaaagcaaaggtgaagacactcttgcagtttggtctgacagggatcgatcgattgagaataaggacattgttctctggtacacgcttgggttccatcatataccatgccaggaagattttcccattatgcctactgtatcctcaagctttgatttgaagccagtgaatttctttgagagtaaccccattcttcggatcccaccaaatgttgagaaggatcttcctgtttgcaaggcagctgcttcagcttgaaacccaattctctgtctctgttgtagaacttgcgtaattggtgggtaacgacggaatagaaaactttgcccacgtacacatatagtgtctcaacacatatcggtgactatcaccaataaaatcaaaatatcagggacactacagttggttctattgtagcttgttagttttgcttcttatctatgctctgtactgaaaacctactctttgacggaatcgactttttggaaattttacttggtta

SEQ ID NO: 5379 - DNA, 2558 bp, Citrus sinensis
atctgcatagtactgtatacttcgcatactttcactctctgttctcccccatcacactgatcggcgatcggtcgctcactcaaaataataattcattcctaatcatttagtttatggaatcaagacactatattcgcttcctgtttttcttcgtcggcatagccactcttctagccatcacatggaacaatctcccctacgcgccgcccgacgcgactgaggatttcgactgcaccacctattcatcatggtgcacctccaagaatcgcttccaaagcaaaccccttaaagaacccgcaaaatccacaagccaccaccacgaccacgcttcagacacgcctcatcaccctttagacccgctcaccgtcaaagaaatcaatcgcgtccgtaccatcctcacctcccacgagctcttcaagaactcctttccctacgcgttccactccatcaccttgcaagaacccaaaaaatcacttgtcctgaactggaacaaaggtgactctttgttaccgaggaaagcctccgttgtcgcacgtgtgcaaaaacatatcatacgtgttagctgtcgatttaacgaccgaagaggtaaccgtacacgagacagattcatcgtccggttatcctgccatgactatagaagacatgacgtcgtcaacatgggccccacttgcggacgaggagttcaaccgtacgatccttgagcgaggggttgatctgaaggacttggcgtgtcttccgatttcgttgggttggtatggagagaaagaggagaacaggaggttgattaaggtgcagtgctactccatgaaggatactgcaaacttttacatgcgaccaatcgaagggttgaccatactcctcgacatggacacgaaggaagtgttggaaattacggacaagggcaagaacataccaataccaaaggccgtcaacacggattatagatattccgctcaggggttgcaccaacgaatgaagctgataaatccaatatcattagagcagcccgaaggtccaagttttgtaattgaagatgagcatcttgttaaatgggcaaactgggaatttcacttgaaacccgacccgagagctggggcgattgtttctcaggctcgggtgagggacccggatagtggggagataaggaatgtgatgtataaagggtttacgagtgaattgtttgtgccttacatggaccccactgatgcatggtattttaagacttatatggatgcgggtgaatatgggtttgggttgcaggccatgccccttgacccgcttaatgattgtccgcggaacgcccactatatggatggtgtgtttccagctgctgatggaacgccgtacgttcgatcaaacatgatttgcatatttgagagctatgccggtgatattgggtggcgccacgcagagagtccgattacgggtatggggattaaagaagtaaggccaaaggtgacgttagtggttagaatggcagcatccgttgccaattatgattatattgttgattgggagtttcaaacagacggactaatcagaattaaggcaagttggactaagtgggattctgatggtgaaaggcacagcctatgagaatatgaaccaaatttccaaccaagctgaaaatctatttggcacccttttgtccgaaaatgttatcggtgtaatccatgaccactttatcacattctacctcgatatggacatagatggctctgataattccttcgtgaaggtaaatattaagaggcaggaaacctcacctggagagtcaccaaggaggagttacttgaaagctgatagaaatgtggctaaaacggagaaagatgcacaaattaagcttaaactctacgacccagctgaattccatgtgatcaatccgactaagaagacacgggtggggaacccggttgggtacaaggtggttcctggtggcactgctgctagcttgcttgatcgtgaagatccacctcaaaagcggggcgcatttactaataatcagatatgggttaccccgtataacgagagcgagcaatgggctggtgggttgtttgtttatcaaagcaaaggtgaagacactcttgcagtttggtctgacagggatcgatcgattgagaataaggacattgttctctggtacacgcttgggttccatcatataccatgccaggaagattttcccattatgcctactgtatcctcaagctttgatttgaagccagtgaatttctttgagagtaaccccattcttcggatcccaccaaatgttgagaaggatcttcctgtttgcaaggcagctgcttcagcttgaaacccaattctctgtctccgttgtagaacttgcgtaattggtgggtaatgacggaatagaaaactttgcccacgtacatatatagtgtctcaacacatatcggtgactatcaccagtaaaatcaaaatatcagggacactacacttggttctattgtagcttgttagttttgcttcttatctatgctctgtactgaaaacctactctttgacggaatcgactttttggaaattttacttggtta

SEQ ID NO: 5380 - DNA, 2876 bp, Gossypium raimondii
gaatagtttttagttgtttttgataaatagcaaaagattttttatagtacaagtgtatatttaagacttagatttttaaaatcttctgtaaaatatattatatttacatacaccaaccacgtttgcatcgatcggcatgtaatccaaattgcaagcttgtccaatttcttaaggcagctttcatttgacactatatacaactggcttatcatctaccactgctcaaagtaaaaacacaaccatggaatcaaagccattctttcgtttcctctttttcttcatcgccatagctttcctcttcgcctggactcacctccattacgcgccatcccctggcgtcaccaccctcctcgactgtgccagcaactctccctggtgcacctcctccaagaaccggtttcagtccaaacaacccacactcacaaaaaccccacgtgcctccacctcccagcgtcgtcaccacgagtcagctgtccctcgccacccactcgaccccctcaccatccaagagttcaacaaggtccgcaaaatcctttcttcccacgcgctcttcaagtcctccaataactacgcgctccattccgtcgtcctagaagaacccaacaaagaacttgtccttaaatggaaaaaaggccaaccactcttcccacgaatagcctccgtcatcgcacgtgccaacggcgtctcgcacgtgctgactgtcaacttagaaaccgacgaagtcaccgttctaaacacggctcctccgaccggttacccgacgatgacggtggaagacatgacctcggctacgtgggctccactttcgaacgccaagttcaaccgtacgatcatcgaacgaggcgttaatcttaaagacgtgacatgcctgccgatatccttaggttggttcgggaaaaaggaggagaacaggaggttaattaaggtacagtgctactccatggaagacactgcaaacttttacatgagaccaatcgagggcttaactgttttactcgatatggacacaaaagaagtggtggaggtatcggatacgggtcggtccatccccatacccaaagccaccaacaccgattatcgtttctcggagcagaagctccagcaggatctcaactctataaaccccatatccattgaacagccaaagggtccaagttttgttatagaagatgaacatttggtgaaatgggcaaactgggaattccatttgaaacccgatacgagagcaggtgtgatggtttctcgggctaaggtccgggaccttgagagtggggtgttgagggatgtgatgtacaaaggctttacttcagaattgtttgttccatacatggaccccactgatgcatggtattttaagacttacatggatgcgggtgaatacgggttcgggctgcaagctatgccacttgacccgcttaatgattgtccaagaaatgcatattatatggatggggtgttcgccgccggtgatggtgtaccctatgtccgatcaaacatggtctgcgtgtttgagaggtacacaggtgatatagggtggcggcatgcagagagtccaattacgggtatggagattaaggaagtaaggccaaaggtgacattagtggttcgaatggctgcatcagtggctaactatgattatattgttgattgggagttccaaacagatggacttatcaggattaaggttggacttagcggcattttgatggtgaaagggactgcatatgagaacatgaatcaagtggaagggcaagaaaatctgttcggtacccttctgtctgaaaacgtcattggcgtcatccatgaccattacatcacattctacttggatatggacatagacggctctgataactcctttgttaacgtaaatatcaaaaggcaagaaacttctccaggagagtcaccaaggaaaagctatctaaaagctgttagaaatgtggctaaaacagagaaagatgctcaaattcaacttaaactctatgacccatcggagttccatgttatcaatccaactaaaaagacaagggttgggaaccctgtcgggtacaaggttgttcctggtggcacagcagctagtttgctggatcatgaggacccaccacagaaaagaggtgcattcacaaataaccaaatatgggtcactccatataacagaagtgagcaatgggctggtggattatttgtttaccagagccacggtgaagacacacttgatgtttggtctgaaagggatcgaccaatcgagaacaaggacattgtggtttggtatacattagggttccatcacataccatgccaggaggattttcctataatgccaacagtgtcatcaagctttgatttgaagccagttaatttcttcgagagcaacccgattcttagagctccaccctattttgaaaaggatttaccagtttgcaggcctgctgcttcagcatgaaaatagtcctatgtttatcttgggtaatgggcagttagaatttatagttgtagccgccaacaacctcttgacctatgacaagactattatgttaagtttgggtttgattccaagcaactcattcctcacccccagtaaagatggatgtagccgtgtaggaattaaagaagaaaccctggtttatatatgttcagaggtctaaatgaaaagagatccttgttttgattactttgcagaaacgtcactacatcgttgtggctttcaacttttaaaggtaatgcccaatgtgatggctgtttaatacagcatactaaagtaatgaaatcggaaagaatagtcgatgcttatctgtgtcatgcttccgttaataacatgatgtcgaattgaaattgttgtagaattttaatgaggtatccaatcataaaagccaaaa

SEQ ID NO: 5381 - DNA, 2860 bp, Gossypium hirsutum
gtgaatagtttttagttgtttttgataaatagcaaaagattttttatagtacaagagtgtatatttaagacttagatttttaaaatcttctgtaaaatatattatatgtacatacaccaaccacgtttgcatcgatcagcatgtaatccaaattgctagcttgtccaatttcttaaggcagctttcatttgacactataaacaactggcttatcatctatcgctgctcaaagtaaaaacacacccatggaatcaaagccattctttcgtttcctctttttcttcatcgccatagctttcctcttcgcctggactcacctccattacgcgccatcccctggcgtcaccaccctcctcgactgtgccagcaactctccctggtgcacctcctccaagaaccggcttcagtccaaacaacccacactcacaaaaaccccacgtgcctccacctcccagcgtcgccaccacgagtcagctgtccctcgccacccactcgaccccctcaccatccaagagttcaacaaggtccgcaaaatcctttcttcccacgcgctcttcaagtcctccaataactacgcgctccattccgtcgtcctagaagaacccaacaaagaacttgtccttaaatggaaaaaaggccaaccactcttcccaagaatagcctccgtcatcgcacgtgccaacggcgtctcgcacgtgctgactgtcaacttagaaaccgacgaagtcaccgttctaaacacggctcctccgaccggttacccgacgatgacgatggaagacatgacctcggctacgtgggctccactttcgaacgccaagttcaaccgtacgatcatcgaacgaggcgttaatcttaaagacgtggcatgcctgccgatatccttaggttggttcgggaaaaaggaggagaacaggaggttaattaaggtacagtgctactccatggaagacactgcaaacttttacatgagaccaatcgagggcttaactgttttactcgatatggacacaaaagaagtggtggaggtatcggatacgggtcggtccatccccatacccaaagccaccaacaccgattatcgtttctcggagcagaagctccagcaggatctcaactctataaaccccatatccattgaacagccaaagggtccaagttttgttatagaagatgaacatttggtgaaatgggcaaactgggaattccatttgaaacccgatacgagagcaggtgtgatggtttctcgggctaaggtccgggaccttgagagtggggtgttgagggatgtgatgtacaaaggctttacttcagaattgtttgttccatacatggaccccactgatgcatggtattttaagacttacatggatgcgggtgaatacgggttcgggctgcaagctatgccacttgacccgcttaatgattgtccaagaaatgcatattatatggatggggtgttcgccgccggtgatggtgtaccctatgtccgatcaaacatggtctgcatgtttgagaggtacacaggtgatatagggtggcggcatgcagagagtccaattacgggtatggagattaaggaagtaaggccaaaggtgacattagtggttcgaatggctgcatcggtggctaactatgattatattgttgactgggagttccaaacagatggacttatcaggattaaggttggacttagcggcattttgatggtgaaagggactgcatatgagaacatgaatcaagtggaagggcaagaaaatctgttcggtacccttctgtctgaaaacgtcattggcgtcatccatgatcattacatcacattctacttggatatggacatagacggctctgataattcctttgttaacgtaaatatcaaaaggcaagaaacttctccaggagagtcaccaaggaaaagctatctaaaagctgttagaaatgtggctaaaacagagaaagatgctcaaattcaacttaaactctatgacccatcggagttccatgttatcaatccaactaaaaagacaagggttgggaaccctgtcgggtacaaggttgttcctggtggcacagcagctagtttgctggatcatgaggacccaccacagaaaagaggtgcattcacaaataaccaaatatgggtcactccatataacagaagtgagcaatgggctggtggattatttgtttaccagagccacggtgaagacacacttgatgtttggtctgaaagggatcgaccaatcgagaacaaggacattgtggtttggtatacattagggttccatcacataccatgccaggaggattttcctataatgccaacagtgtcatcaagctttgatttgaagccagttaatttcttcgagagcaacccgattcttagagctccaccctattttgaaaaggatttaccagtttgcaggcctgctgcttcagcatgaaaatagtcctatgtttatcttgggtaatgggcagttagaatttatagttgtagccgccaacaacctcttgacctatgacaagactattatgttatgggtatgaaagtttgggtttgatcccaagcaactcattcctcacccccaataaattaagtggatgtagccgtgtaggaatattaaagaagaaaccctggtttatatatgttcagaggtctaaatgaaaagagatccttgttttgattactttgcagaaacgtcactacatcgttgtggctttcaacttttaaaggtaatgcccaatgtgatggctgtttaatacagcatacgaaagtaatgaaatcggaaagaatagtcgatgcttatctgtgtcatgcttccgttaataacatgatgtcgaattgaaattgttgtag

SEQ ID NO: 5382 - DNA, 2862 bp, Gossypium hirsutum
gtgaatagtttttagttgtttttgataaatagcaaaagattttttatagtacaagagtgtatatttaagacttagatttttaaaatcttctgtaaaatatattatatgtacatacaccaaccacgtttgcatcgatcagcatgtaatccaaattgctagcttgtccaatttcttaaggcagctttcatttgacactataaacaactggcttatcatctatcgctgctcaaagtaaaaacacacccatggaatcaaagccattctttcgtttcctctttttcttcatcgccatagctttcctcttcgcctggactcacctccattacgcgccatcccctggcgtcaccaccctcctcgactgtgccagcaactctccctggtgcacctcctccaagaaccggtttcagtccaaacaacccacactcacaaaaaccccacgtgcctccacctcccagcgtcgtcaccacgagtcagctgtccctcgccacccactcgaccccctcaccatccaagagttcaacaaggtccgcaaaatcctttcttcccacgcgctcttcaagtcctccaataactacgcgctccattccgtcgtcctagaagaacccaacaaagaacttgtccttaaatggaaaaaaggccaaccactcttcccacgaatagcctccgtcatcgcacgtgccaacggcgtctcgcacgtgctgactgtcaacttagaaaccgacgaagtcaccgttctaaacacggctcctccgaccggttacccgacgatgacgatggaagacatgacctcggctacgtgggctccactttcgaacgccaagttcaaccgtacgatcatcgaacgaggcgttaatcttaaagacgtggcatgcctgccgatatccttaggttggttcgggaaaaaggaggagaacaggaggttaattaaggtacagtgctactccatggaagacactgcaaacttttacatgagaccaatcgagggcttaactgttttactcgatatggacacaaaagaagtggtggaggtatcggatacgggtcggtccatccccatacccaaagccaccaacaccgattatcgtttctcggagcagaagctccagcaggatctcaactctataaaccccatatccattgaacagccaaagggtccaagttttgttatagaagatgaacatttggtgaaatgggcaaactgggaattccatttgaaacccgatacgagagcaggtgtggtggtttctcgggctaaggtccgggaccttgagagtggggtgttgagggatgtgatgtacaaaggctttacttcagaattgtttgttccatacatggaccccactgatgcatggtattttaagacttacatggatgcgggtgaatacgggttcgggctgcaagctatgccacttgacccgcttaatgattgtccaagaaatgcatattatatggatggggtgttcgccgccggtgatggtgtaccctatgtccgatcaaacatggtctgcatgtttgagaggtacacaggtgatatagggtggcggcatgcagagagtccaattacgggtatggagattaaggaagtaaggccaaaggtgacattagtggttcgaatggctgcatcggtggctaactatgattatattgttgactgggagttccaaacagatggacttatcaggattaaggttggacttagcggcattttgatggtgaaagggactgcatatgagaacatgaatcaagtggaagggcaagaaaatctgttcggtacccttctgtctgaaaacgtcattggcgtcatccatgatcattacatcacattctacttggatatggacatagacggctctgataattcctttgttaacgtaaatatcaaaaggcaagaaacttctccaggagagtcaccaaggaaaagctatctaaaagctgttagaaatgtggctaaaacagagaaagatgctcaaattcaacttaaactctatgacccatcggagttccatgttatcaatccaactaaaaagacaagggttgggaaccctgtcgggtacaaggttgttcctggtggcacagcagctagtttgctggatcatgaggacccaccacagaaaagaggtgcattcacaaataaccaaatatgggtcactccatataacagaagtgagcaatgggctggtggattatttgtttaccagagccacggtgaagacacacttgatgtttggtctgaaagggatcgaccaatcgagaacaaggacattgtggtttggtatacattagggttccatcacataccatgccaggaggattttcctataatgccaacagtgtcatcaagctttgatttgaagccagttaatttcttcgagagcaacccgattcttagagctccaccctattttgaaaaggatttaccagtttgcaggcctgctgcttcagcatgaaaatagtcctatgtttatcttgggtaatgggcagttagaatttatagttgtagccgccaacaacctcttgacctatgacaagactattatgttatgggtatgaaagtttgggtttgatcccaagcaactcattcctcacccccaataaattaagtggatgtagccgtgtaggaatattaaagaagaaaccctggtttatatatgttcagaggtctaaatgaaaagagatccttgttttgattactttgcagaaacgtcactacatcgttgtggctttcaacttttaaaggtaatgcccaatgtgatggctgtttaatacagcatacgaaagtaatgaaatcggaaagaatagtcgatgcttatctgtgtcatgcttccgttaataacatgatgtcgaattgaaattgttgtagaa

SEQ ID NO: 5383 - DNA, 4313 bp, Theobroma cacao
tcacatcaaagcaaagacaagacggataaaatcaggcggcttgttctgttggatggacataaatatatacgcccttggaaagctcaattgtcaatactcgaaacccataagctctctctcatcctcacttctcggaagggagataatggagaaaaccccatggcttcatctctgtctcatttcatgcttaatcttattctttctggtgcgttcttggtaccctccacgcaaaccagaactgcctgattgctctctgcatgccccatggtgcacctctaagaaccgaattttctccaactccaaggcgggttcagcgttacatacccaagttcaagaatcgacagaccactcagccgagagccctcgacacccactagaccctcttactatacaggaaatcaacagggtccggaccatcctctcgtcctatgaacccttttcatctaccttccctactattaacaccttactgcttgatgaaccagataagctgcaggttatcgggtggagaaaaggtgacccacttccaccaagaaaagcagctgttctggctctgttaaatggccaatcccacgtgctttcagtggacttggattctagccgtgtcactagccatgccatcaatccaacctcagggtatcctatgctatccatgaacgatattttgggtgcgtccaaagtgccgttttctagtgcagaatttaacaaatccatgaccgcccgagcgatctctttatcgaatttggtgtgcttgacgccttcagccggctggtttgggcctaaagaagatggcaaaagggtcataagggtccagtgctactctggtgaaggcacgtccaacttctacatgaggcccattgaagggctcacggtgacagtggacctggacaaaatggaggtggtgaaaatatatgatgcaggccgacgtatccctgttccgaaaagtaccgacactgattaccggtctgaccaacgagctggtttggtgatttcgcgagccatggtgcgggactcggagacgggtgagctcaggaatgtgatgtacaaagggttctcttcagaattgttcgtgccgtacatggaccttgacgagtcttggtattttaagtcgtatatggacgctggggagtttgggttagggacaacagccctttcactcgtgccactaaacgattgtccgaggtactcttactacatggatggggtttttgcggcctcggacggcatgcaatttgttcagccgagcatgatatgcctctttgagagctatgccggtgacatcagttggcggcattctgaaacccaagttttcggttttcagattagggaggcgagaccaaaagtaacccttgtcgctcgtatggcagcatcagtgggaaattacgattacatcttcgattgggagtttcaaacagatggtctgataaggattaaggtaggactctcgggaatgctgatggtgaaagaagtcctcatcagaatgtatatcaggtgcctaatcaaggtgacatgtccggtcctcttatttcggagaatgttattggagtagttcacgatcacttcattaccttccacctggacatggatattgatggggctaataattcgtttgtgaatgttaatctcgtgaaggaagagagtttacccggagaatcccctaggaagagctacttgaaagttgagagaaaaacagcgaagacagaaaaagatgcacaaattaagcttaagttgtatgatccatcagaatttcacatgatcaatccttccaggaggtctaggctgggaaatccaaccggatacaaacttgttcctggaggaactgcagctagtttgcttgatggtgacgatcctccacaactcagaagtgcgttcacgaacaaccagatatgggtgacccccttcaataagagtgaacaatgggctggtgggcttctagtgtatcagagcaggggagaggacactcttgctgtgtggtctgaaaggaatcgtcctattgaaagtaaggatattgtgttatggtacaccatgggattccatcacattccatgccaagaagatttccctgtaatgccaacagtgacatcaggctttgagctcaagcctgtcaatttcttcgaaagcaatccaattcttcgagctgccccagcctttgagaaagacttaattgtccgcaccatcctttcttcccacccgctcttcaaatcctccaaaaactacgcgctccattccgtcgtcttagaagaaccagacaaagacctcgtcttgcgatggacaaaaggccaaccgctcttcccaagaatagcctccgtcatcgcacgtgccaatggcgagtcacacgtgctgacggtcaacttggaaaccaacgaagtcaacgttctcaacacggctcctccgaccggttacccgatgatgacgatggaggacatgacatccgctacctgggctccactttcgaaccccaagttcaaccgtacgatcatcgaacaaggtgttaatcttgatgacgtggcgtgcctgccgatttcgttggggtggttcggggaaaacgaggagaacaggaggttaattaaggtacagtgctactccatgaaagacactgcaaacttttacatgagaccaatcgaagggttaactgttttactcgatttggacacaaaagaagtggtggagatatcggatacgggtcgggccatcccggttccaaaagccacgaacacggattatcgttactcggagcagaagatgcagcaggaactcaacttgataaaccccatatccattgaacagccgaagggtccgagttttgtcattgaagatgaacatttggtgaaatgggcaaattgggaattccatttaaaagccgaccccagagctggtgtggtggtttccggagctaaggtctgggacccggatagtggcgtgatgagggatgtgatgtacaaagggtttacgtctgaattgtttgtgccttacatggaccccaccgatgcatggtattttaagacttatatggatgcgggtgaatacgggttcgggttgcaggctatgccacttgacccccttaatgattgtccaagaaatgcatattatatggatggtgtgtttgccgccggtgatggtgtaccttatgtccgatcaaacatgatctgcgtgtttgagagctacaccggtgatatagggtggcggcattcggagagtccaatcacgggtatggagattaaggaagtgaggccaaaggtgacgttagtggtcagaatggctgcatcagtggctaactatgactatattcttgattgggagttccaaacagacgggctaatcaggattaaggttggacttagcggcattctgatggtgaaaggtaccacctatgaaaacatgaaacaagtggaagggcaagaacatctcttcggcacgcttttgtctgaaaacgttattggcgttatccatgatcattacatcacattctacttggatatggacatagatggctccgataattcctttgttaaagtaaatatcaagaagcaagatacctctccaggagagtcaccaagaaaaagctatttgaaagctgtcagaaatgtggctaaaacagagaaagatgcacaagttcagcttaaactatatgacccatctgagttccatgtgatcaatccaactaagaagacaagggttgggaacccggttggatataaggtagttcctggcggtaccgccgctagcttgctggatcatgaagatccaccacagagaagaggtgcattcacaaataaccagatatgggtcactccatataacaaaagcgagcaatgggcaggtggattatttgtttaccagagccagggtgaagacactcttgcagtttggtctgatagggaccgatcaattgagaacaaggatattgtgctgtggtatactctaggcttccatcacataccatgccaagaggactttcctattatgccaactgtgtcctcaagctttgatttgaagccagttaatttcttcgagagcaacccaattcttcggattccacccaattttgaaaaggatttacctgtttgcaagcctgctggttcagcatgaaacgctagtttgagaaccaggtctaggacctacaaagcaaatctaagtttctgaatggtcagaggtgtaaatagtaattatccaggaactggttctatttccttgtcaagattaattagagtttactttgtcttaatcactttaaagaaacatcattacgatgggcttttaacagtggccacgtttaaaggatccaataagtttaaaaaaggttgaaactgtca

SEQ ID NO: 5384 - DNA, 2436 bp, Manihot esculenta
gaagctagcaaacacttgttgagtaagaaaaaaaactagtgagtcatggaatccagaaaattttttcgcttcctcttcatcttgctgtgtggagctcttgtcttattcttcacctggattcatatcccatacgctccaccaccaagcaccaccgaattcctcgactgcgccaccaactctccttggtgcacctccagaaatcgcttcctatctaagaaaccacccaccatcaatattctcaagaaacccccaagacagacgcgccaccatcatgagtcagacgtcccccaccaccctctggatccccttaccattcgagaactcaacaaagtccgtacaatcctatcctcgcaccacctcttcaagtcatctccctttgctctacactccgtagtcttggaagagcccgacaagccacttgttctcagatggcgaaagggggaccccatgttatccagaaaggctgccgtcgtggcacgtgtgagcggccagtcacacgtgctaacggtggatatagataccagcgaggttaacgtacaagaaaccaatccgctttccgggtacccaacgatgacgatagaggacatgacttcatccacgtgggccccactgtcgaacggtgatttcaaccgtacgatcatcgagcgtggagtagatctgaaggacctggcttgcttacccatctccttaggttggtatggtgcgagggaagagaacaggagattaattaaggtacagtgctattctatggagggcactgcaaacttctacatgaggccaatagaagggttgactgtgctgcttgatttggacactaaacaagtagtggagatagcagataaagggaagaccatacccataccaaaggccgccaacacagattatcgctactcagctcagggcgtcgatcaacagaagaaactgatcaatccgatttccatagagcaaccaaaagggcctagctttactgtggaagatgagcacatggtgaaatgggcaaactgggaatttcatctcaaacccgacccgagagctggggtgatcatttctcgcgctagagtccaggacccggatactggggaggtgagaaatgttatgtacaaaggcctgacttcggagttatttgtgccttacatggaccctacagatgcatggtactttaagacttacatggatgcgggtgaatacgggttcgggttgcaggccatgccgcttgacccacttaatgattgtccgcgaaatgcgtattacatggacggagtgtttgccgccggtgatggatctccatacgtccgatcaaacatgatctgtgtgttcgagagttatgctggtgatatcgggtggcggcacgctgagagtccgattacgggtatggggattagggaagtaaggccaaaggtgacgcttgtggttagaatggcagcatcagtggctaactatgattacatcgttgattgggagttccagactgatgggctaatcagaatcaaggtaggacttagtgggattctgatggtgaaaggcacctcatacgtgaacatgaaccaagtgccaggccaagaaaatctctacggcacactgttatcagaaaacgtcatcggtgtcatccatgaccacttcatcacgttttaccttgacatggacatcgacggatctgataattccttcgtaaaagtaaatcttcaaaggaaacagacctctcctggagaatccccaaggagaagttacttaaaagctacaagaaacgttgcaaagacagagaaagatgcacagattcagctcaaactttacgaaccatccgagttccatgtgatcaacccgactaaaaagacacgggtagggaaccctgtggggtataaggtggttcccggcggcacggctgctagcttgcttgatcatgatgatccgccacagaaacggggagcatttacaaataatcaaatatgggtcaccccatataatcggaccgaggaatgggcgggtgggttatatgtttaccagagtcaaggtgaagacactctcgcagtatggtctgaaagggaccgtccgattgagaacaaggacattgtggtgtggtacacgttaggctttcatcacataccatgtcaggaagatttccctataatgccaacagtatcgtcgagctttgatctgaagcctgtcaatttctttgaaagcaaccctattcttcggttcccacctaatcttgaggaagatttgcctgtttgtaagccttcagacagtgcttgaatggcatatgttgttttagttttagtttttttttttcctcttttactacatgtagcctatgttgagaagaagacttttcggttcgcaagccatgctacgtgttgtggcttggttggggcagaaatttctggtctgatttgtacaaatattgaatggaagagaataatcttatcacttattatatac

SEQ ID NO: 5385 - DNA, 1039 bp, Mesembryanthemum crystallinum
gggagcgccttatatccggtcgaatatggtttgtatctttgagagttataggggtgatatcgggtggcgacactcggagagtccaattacagggatggagatacgtgaagtccggccgaaggtgaccttagtggttaggatggcagcatcggtggctaactatgattacattgtggattgggaatttcaaaatgatggactcatcaaaataaaggtcggactaagtggtatcttgatggtgaaaggcacaccgtacatgaacactaaccaaataccgaaccaggaaaacatgtacggtaccctattgtccgaaaacgtcattggggttatccatgaccactatgtgacgttctatctcgacatggatgtggatgggtcggacaattccttcgtcaaggtgaacctccaacggcaacaaacctcgcaagaggagtcaccccgtaggagttatttgaaaaccactagaaacgttgccaagacggagaaagatgcacaaatcaagctcaagctttatgacccgtctgaattccacatggtcaacccgaataaaaagactcgggtggggaacccggttggatacaaggtggtccctgctggcacagcggctagcctacttgatctagaggatccacctcaaaagagaggggcttttactaacaaccaaatatgggtcaccccatataaccaaagtgaggaatgggccggtgggttatttacttaccaaagccaaggtgaagacacccttgcaacatggtctgagagggatcgatcgatagagaacaaggatatcgtgttatggtacaccttgggtttccatcatgtaccatgccaagaggacttcccaattatgccaacagtatcagcaagctttgatttgaagcctgtcaatttctttgagagcaatcccatccttggaatcccaccaaattttgaaaaggatctaccagtttgccaagctgctgcttcttctgcttgactgtgcaacatggggagtaaattgcctgtcttgctatatgttctatgactgtgcaacatcatc

SEQ ID NO: 5386 - DNA, 1151 bp, Platanus occidentalis
gcggccgatgggaaaccgtttgttcgatcggacatggtttgtgtgtttgaaagctatgccggagatattggatggcggcacgccgagagccccatcaccggaatggagattaaagaggtgaggccgaaggtgacgctggtggttaggatggctgcatcggtggctaactatgactatattgtggattgggagttccagacagatgggcttattaggatcaaggttggactcagtggtattctaatggtgaagggtacaccctatgagaacatgaaccaggtgaccagacaagacagtctctatggcaccctcttatccgaaaacgtcattggtgtcatccatgatcactacgtcacattttacttggacatggacatcgatgggtcccaaaattcttttgtcaaggtgaaccttgcaaggcagaaaacctcgccaggacaatcaccaaggaagagctacttgaaagctacaaggcacatcgctaagacagagaaggatgcacagatcaagttgaagctctatgatccctcggaattccatgttatcaactctgtcaagaagactagagtcggcaacccggtcggatataaggttgtgccggcgggtacagctgctagcttacttgatccccaagaccctccacaaatgcgaggagcattcacaaacaaccagatatgggtaactccatataaccggagcgagcaatgggctggtgggctttttgtgtaccagagccagggggaggacactcttgctgtctggtctgacaggaatcgtcctatcgagaacaaagatattgtgctgtggtacacattaggatttcatcatataccatgccaggaagatttccccatcatgccaactgtgtcatcacatttcgatctgaagccggtcaatttcttcgagagcaatccaatcctccagatgccgccaaattttgagagcgatttaccggtttgcagggcagatgcatcagcttgatgaagtgtatttctatgaaaccaatagtttttaatgaatgtccatgtatgtgtatctatgaatccatacctacacatacatgtgtacatgcagtacatgtataaagaatgaacttctctttatagtcagacaatactaaataaataggtaagtaggatagtgacatatag

SEQ ID NO: 5387 - DNA, 2809 bp, Ricinus communis
tagacatataatggagggtttacattattgccaaattgtttttttcttttcttttttaaatcatgaaaagaatgtagaggtttaaaattgagaattccatcaggactaaagaagtataatcacatcttactttgttaaaagacaaactaaaacatttgtcttaaatttaaagtactattttgccaatcatttaaagttaatacataagatgcagcaagtcttttccctgccctgaattcttattacaggttttccttgctcttatccatttgttagaatgtagctccttatatacttgagtatcaacacatatacacacataaactaacaaactaggcagccagtagagaaagaaaccaaaataacaaacataagcgatggaatcgagaaacttcatccgcttcctcttaatctttctaagtggttctcttctcttactcttcacctggattaacctcccctacactccaccaccgctcacttccaccactgactttctcgactcatgcgccgccaattcccgttggtgcacccgcttccaacaacccaagaacatcctcaagaaacccccgaaacccacgcgccaccgccacgaatcagatcttcctacccaccctttagaccccttaaccatccaagaattcaacaaagtccgtacaatcctaaaatcacacgaccttttcaaatcatctcctttctctcttcactccgtagtcttggaggagcccgagaaaacccttgttctcaaatggcgaaaaggagaccccatgttaccgagaaaggcagaagtcatcgcacgtgtcaacggccaatcacacgtgctcacggttgacataaacacaagcgatgttgctgtacaagaaaccaatcctctctctggttatccgaccatgacaatagaggacatgactacagcaacatgggctccattatctaacgctgatttcaaccgtacgatcattgaccgaggtgtcgatcttaaggacttggcttgcttgcctatttctttaggttggtttggcaagaatgaagagaacaagagattgatcaaggtacagtgctactccatgaaaggcactgcaaatttctatatgagaccaatagaaggtttgactgtattacttgatatggatactaaagaagtggtggagatatcggataaaggcaagaatatacctataccaaaggctgccaacacagattatcgttattcttctgtagatgtcaatcaagaaaagcaactgatcaatcctatttctatagagcaaccaaaaggaccgagttttactgtagaagatgagcatatggtgaaatgggcaaattgggaatttcatctcaaacccgacccgagagctggtgtgataatttctagtgccagagtcaaggacccggatagtggagagataaggaatgttatgtacaaagggttcacttcagaattatttgtgccttatatggaccctactgatgcatggtattttaagacttatatggatgcgggtgaatatgggttcgggttacaggccatgccacttgacccacttaacgattgtccccggaatgcctattacatggatggtgtttttgcggcgggtgatgggactccgtatgtccggtcaaacatggtttgcatattcgagagttatgctggtgacattgggtggcggcacgctgaaagtccgattacaggtatggagattagagaagtgaggccaaaggtgacgcttgtggttagaatggcagcgtcagtagcaaactacgactacatagttgattgggagttccagactgatggcttaatcagaattaaggttggacttagtgggattttgatggtgaaaggcacatcatacgagaacatgaatcaagtgactggccaagaaaatctctatggcactctattagcagaaaatgttatcggtgtcattcatgatcattacatcacattttaccttgacatggacatagatggctccgataattcttttgtgaaggtaaatatccacaggcaacagacttcacccggagaatccccaagaagaagctacttgaaagctacaagaaatgttgctaagacagaaaaggatgcacagattaagctcaaactttatgatccctccgagtttcatgtgattaacccaactaaaaaaactcgggtgggaaaccccgtcgggtataaggtggttcctggtggcactgccgctagtttgcttaatcatgatgatcctccacagaaacgtggagcatttacaaataatcagatatgggtcaccccatataatcggacagagcaatgggcgggtgggctatttgtttatcagagtcacggagaagacactctagcagtttggtctgacagggatcgtccaattgagaacaaggacattgtggtgtggtacacactaggattccatcacataccatgccaagaggatttccctataatgccaacagtatcttccagctttgatttaaagccggtgaatttctttgaaagcaatcctattcttcggatcccgcctaatgtcgagaaagatttgcctgtttgcaggccctttgatactgcttgagggtccaaatatgcctatgttctttttgtaaaagtttatgcgccacatagttgatgttaagaaaaatgatgcctgtagtgtatgcaagccctgctactgtggactgtacaaattgctagtgctaacaacaatcggtgttatcagaataaataagatataaaaacgatggtcactcatttatgactagtgattaccatgtctaaaattttcaattgggtagttgcattgttggaagtttc

SEQ ID NO: 5388 - DNA, 2381 bp, Fagus grandifolia
cctaactgagtcactgtgctaaacctacacagagagtctgagtccgagacctcttttctacgtagtcactgagagagatagagagagaaagataggctatggaaacaagaatctctttacgctttctgcttctttttctcagtatcgcacttgtccttctcttcacctgggttcacctcccctacgcgccacccaacacaactgagcttctcgactgcaccaccaactcaccatggtgcacctccaagaaccgcttccaatccaaactaaccaacctcctacaaaaacgcccccgaaacccactcgccaccacaaccacgcgtctgacacaccccaccaccctctagaccccctgaccatccaagaagtcatcgaggtccgctccatcctctcctcccacgcgctcttcaagtcgtcagcctacgcgctccactccatcgacctcgaagagcccgagaaaccgcttgtcctgaagtggaaaaaaggcgaccctttgtttcccagaaaggcctccgtggtcgcacgtgtggacggcaagtcacacgtgttaaccatcgacctcagcacccgccaggtgacagtacaggaaaccggctcgcataccggttatcccacgatgacgatggaggagatgaccgctgccacgttagctctacttgctaacgcggagttcaaccgcacgatcatccagcgtgggattgatctaaaggatctggcgtgcctgccgatttcgagtgggtggtacggaaagtccgaggaaaacaggaggttgattaagatactgtgctattccatgaaggaggacactccgaattcctacatgagaccaatcgaagggttgacagtgctccttgatgtggacactaaacaagtgctggagatatttgataaaggcaagagcataccgattccaaaagccgcaaacacagactatcgttactcagctcaggagtgccttcaagtaatgaataaaccgaacccgatatccattgagcaacccaaggctccgagttttacaattgaagatgagcacttggtgaaatgggcaaactgggaatttcacgtaaaacccgatgcaagagccggtgtgataatttctcgggccaagttccaggacccggataccggggagctaagaaatgtgatgtacaaaggatttacttctgaattgtttgtgccttatatggaccccaccgatgactggtactttaagacgtatatggatgctggcgaatacgggttcgggttgcaggccatgccacttgacccgctcaatgattgtccgcggaacgcgtattatatggatggtgtgtttgtggcagctgatggaacaccgtacgtccgatcacacatgatttgcgtgttcgagagttatgcgggcgatattggatggcgtcactcagagagtccaatcactgaattggagattagagaagcacgacccaaggtgacattggtggttagaatggtagcgtcggttgcgaactatgattacattgttgactgggagttccagacagatggactaatcagagctaaggttggacttagtggtattttgatggtgaaaggtaccacctacgaccacataaaccagattcctaaagaagaaaatctatatggtacccttttgtccgaaaacgttatcggtgtaatccatgaccactacatcatattctatttagatatggacgtcgatggctcagataattccttgttaaggttgacattaagaaggagcagacctcacctgatgagtcaccgagaaaaagctacttgaaagccataagaaatgtggctaagacagagaaggatgcacaaattaagcttaaactctatgaaccgtctgagttccacgtgattaacccatcgaagaagacacgggttgggaacccggttggatataaggtggttcctggtggcacagctgctagtttgcttgatcttgaagaccctccccagaagcgaggggcttttacaaacaatcaaatatgggtcactccctataaccggagtgagcaatgggcaggcgggttgtttgtttaccaaagccatggtgaagacactcttgcaacatggtccgacagggatcgaccaattgagaataaggacattgtgctatggtacacgctaggcttccatcacataccatgtcaggaggatttcccagttatgccaactgtttcatcaagctttgatctaaagcccgtcaatttctttgagagcaaccctattctacggatcccacctaatgttgagaaggacctccctgtttgcgaggcagctgcttcagtttgaagaagtaatcccacttctttcttataggatgtgcaatatgtagtagtaaatatttgtatcttaatcaattatttacatatttg

SEQ ID NO: 5389 - DNA, 2545 bp, Quercus alba
atgggaaataaacaaattgggtacagacccaaacaccaccacacgcgccccattagatactctttaagctcgtccttcacaccctcacttacatagccagtcggatcagtctggactctggagacccttcatttcacgtattcacagagagagagagagagagagagagagagagagataggccatggaagctagaaacctcctccgctttctggttctttttctcagtatcgctcttgtccttatcttcacctgggttcacctaccctctacaccacccaacccgactgagcttctcgactgcaccaccaactcaccatggtgcatctccaagaaccgcttccaacccaaacaacccaacctcctcaaaaagtcaccgaaacccacgcgccgccacaaccacgcctctgacaaacctcaccaccctctagaccccctgaccatccaagaactcaacgaactccgctccatcctcacctcccacgcgctcttcaagtcgtcaagctacgcgctccactccatcgaactcgaagagcccgagaaaccccttgtcctcaagtggaaaaaaggcgaccccttgttacccagaaaggccaccgtggtcgcacgtgtggacggcaagtcacacgtgttaactgtccacctcggcacccgcgaagtcaccgttcacgaaaccagctctcactccggttaccccacgatgacgatcgaggacatgaccactgccacgctggcaccactcgctaacgctgacttcaaccgcacgatcatccagcgtggggttgatctaacggacctcgcctgtttgccgatttcgaccggttggtacggcgagtccgaggaaaccaggaggttgattaaggtacagtgctattccatgaagggcactgcaaacttttacatgagaccaatcgaagggttgactgtgctcgttgacttagacacgaaacaagtggtggagatttcagacaaaggcaagaacataccgattccaaaatcggcaaacacagattaccgttactcagctcaggagctccatcaagtaataaacttattcaacccgatatccattgagcaacccaaaggtccgagttttaccattgaagatgagcacttggtgaaatgggcgaactgggaatttcacctgaaacccgacgcaagagccggtgtgatagtttctcgggccaaggtccgagatccggatacaggggagctcagaaatgtgatgtacaaaggtttcacatctgagttgtttgtgccttacatggaccccaccgatgcatggtactttaaaacgtatatggatgctggcgaatacgggttcgggttgcaagccatggcacttgacccgcttaatgattgtccgcggaacgcgtattatatggacggtgtgtttgtggcagctgatggaacaccgtacgtccgatcaaacatgatttgtgtgttcgagaaatatgcgggtgatattggatggcgtcactcagagagtcccatcactggcatggagattagagaagcaaggccgaaggtgacgttggtggttagaatggcagcatcggtcgctaactatgattatattgttgattgggagttccaaactgatgggctaatcagaattaaggttggacttagcggtattttgatggtgaaaggtaccacctacgacaacataaaccagattcccaaccaagaaaatctatacggtacccttttgtccgaaaatgttataggtgttatccatgaccactacatcacattctatctagatatggacatcgatggctcagataattcctttgttaatgtaaacattaagaagcagcagacctcacccggtgagtcacctaggaggagctacttgaaagccataagaaatgtggctaagacagagaaggatgcacaaattaagcttaaactctatgacccgtctgagttccacgtgattaacccgtcaaagaagacacgggtcgggaacccagttggatataaggtggttcctggtggcacagctgctagtatgcttgatcttgatgaccctccccagaagcgtggtgcctttacaaacaaccaaatatgggtcactccctataaccaaagtgagcaatgggcaggcgggttgtttgtttaccagagccaaggtgaagacactcttgcaacatggtccgaaagggatagaccaattgaaaataaggacattgtgctatggtacacgctaggcttccatcatataccatgtcaagaggatttccctataatgccaacagtttcatcaagctttgatctaaagcccgtcaatttctttgagagcaaccctattcttcggatcccacctaatcttgagaaagacctccctgtttgtgagcctgctgattcagtttgaagaagtattcctacctcttcattatagggtctgcaaatatgaagcagcatatttgtaccttaattcatatatatgtacatattttcaaagtttgacgaacaaatggtaattatctgtctaaaacgagcaatatcagtatctttaaaggaaatgtgagtttttgaa

SEQ ID NO: 5390 - DNA, 1225 bp, Sarracenia psittacina
ggatggagttttccggctgctgatgggtctccgtatgtccgatccgacatgatctgcgtgttcgagagatatgcgggtgatatcgggtggcgccactcggagagtccgatcaccggcttggagattagggaggtgaggccaaaggtgacgttggtagtgagaatggcagcatcagtcgcaaactacgattatatcgtggattgggaattccagacggatggacttatcagagtcaaggttgggctgagtggaatcctgatggtgaaaggctctccttacgtaaacatggaccaagtgaaccaacaagaaaccctctacggcacccttctgtcggaaaatgtgatcggcgtcattcacgaccactacgtcaccttctatctcgacatggacgtcgatggtgccgacaattccttcgtgaaagtaaatctccggagagagcaaacttcctccggagagtcacccaggaaaagctacttgaaagctgagaggagcgtggccaagaccgagaaagatgctcaagttaagttcaagctctacgaaccatccgaatttcacgtgatcaaccaggccaagaagacccgggtcgggaatccggttgggtacaaggtggttcccggcggcacggctgctagcttgcttgacgtcgacgatcctccacagaagcggggcgcatttacaaacaaccaaatatgggtcactccgtataaccaatcggagcaatgggcaggtggcttgtttgtgtaccaaagtcaaggtgaagacacgcttgcagtgtggtccgaaaggaatcgggagatagagaacaaggacattgtggtgtggtacacattagggttccatcacgtaccatgccaagaagacttccccataatgccgacggtgtcctccagcttcgacctaaaacccgtcaatttcttcgagagcaatccaattctaaggacccctccaaacgccgaaaaagaccttccaaattgcaaggctgctgcttctgtctgatccacaaattaataatgttagagatacgagtttattttattaaattaatatctcaaatgattcatcacaatcataactattgatatattgggtttcaaatgtactattatatttggttgtgatcgtgatacattacttaagatatcaatttaaattgatatcaatctaatagaacaagtttgtataaataatattgttgatgtgattaatgtacatattaattattcgc

SEQ ID NO: 5391 - DNA, 2526 bp, Fagus grandifolia
ttactttagaagatattaaagatgtatgatctatccctaacataactcttaaattagtatctcatcaaaaaacataactcttaaattagtaatatctctatcatcatcgctcatttactttctcatcctcagcttttctacgcactagcttcaagtttgtcttcaaacctctctgagtcactgtgctcaaaacctcactgagattctgagtccgagacccttcttttcacgtagtcactgagagagatagagagagaaagataggctatggaaacaagaatctctttacgctttctgcttctttttctcagtatcgcacttgtccttctcttcacctgggttcacctcccctacgcgccacccaacacaactgagcttctcgactgcaccaccaactcaccatggtgcacctccaagaaccgcttccaatccaaactaaccaacctcctcaaaaagccaccgaaacccactcgccaccacaaccacgcgtctgacacaccccaccaccctctagaccccctgaccatccaagaagtcaacgaggtccgctccatcctctcctcccacgcgctcttcaagtcgtcagcctacgcgctccactccatcgacctcgaagagcccgagaaaccgcttgtcctgaagtggaaaaaaggcgaccctttgtttcccagaaaggcctccgtggtcgcacgtgtggatggcaagtcacacgtgttgaccatcgacctcagcacccgccaggtgacagtacaggaaaccggctcgcataccggttatcccacgatgacgatggaggatatgaccgctgccacgttagctccacttgctaacgcggagttcaaccgcacgatcatccagcgtgggattgatctaaaggatctggcgtgcctgccgatttcgagtgggtggtacgggaagtccgaggaaaacaggaggttgattaagatacagtgctattccatgaaggacactgcaaatttctacatgagaccaatcgaagggttgacagtgctccttgatttggacactaaacaagtgctggagatttttgataaaggcaagagcataccgattccaaaagccgcaaacacagactatcgttactcagctcaggagttccatcaagtaatgaacaaactgaacccgatatccattgagcaacccaagggtccgagttttacaattgaagatgagcacttggtgaaatgggcaaactgggaatttcacgtaaaacccgatgcaagagccggtatgataatttctcgggccaagttccaggacccggataccggggagctaagaaatgtgatgtacaaaggatttacttctgaattgtttgtgccttatatggaccccaccgatgactggtactttaagacgtacatggatgctggcgaatacgggttcgggttgcaggccatgccacttgacccgctcaatgattgtccgcggaacgcgtattatatggatggtgtgtttgtggcagctgatggaacaccgtacgtccgatcaaacatgatttgcgtgttcgagagttatgcgggcgatattggatggcgtcactcagagagtccaatcactgaattggagattagagaagcacgacccaaggtgacattggtggttagaatggtagcgtcggttgcgaactatgattacattgttgactgggagttccagacagatggactaatcagagctaaggttggacttagtggtattttgatggtgaaaggtaccacctacgaccacataaaccagattcctaaagaagaaaatctatatggtacccttttgtccgaaaacgttatcggtgtaatccatgaccactacatcatattctatttagatatggacgtcgatggctcagataattccttgttaaggtgacattaagaaggagcagacctcacctgatgagtcaccgagaaaaagctacttgaaagccataagaaatgtggctaagacggagaaggatgcacaaattaagcttaaactctatgaaccgtctgagttccacgtgattaacccatcgaagaagacacgggttgggaacccggttggatataaggtggttcctggtggcacagctgctagtttgcttgatcttgaagaccctccccagaagcgaggggcttttacaaacaatcaaatatgggtcactccctataaccggagtgagcaatgggcaggcgggttgtttgtttaccaaagccatggtgaagacactcttgcaacatggtccgacagggatcgaccaattgagaataaggacattgtgctatggtacacactaggcttccatcacataccatgtcaggaggatttcccagttatgccaactgtttcatcaagctttgatctaaagcccgtcaatttctttgagagcaaccctattctacggatcccacctaatgttgagaaggacctccctgtttgcgaggcagctgcttcagtttgaagaagtaatcccacttctttcttataggatgtgcaatatgtagtagtaaatatttgtatcttaat

SEQ ID NO: 5392 - DNA, 1234 bp, Amaranthus tuberculatus
ggagattcgtgaggctaggccgaaggtgacactagtcgttagaatggcagcatctgtagcaaactatgactatattgtggactgggaatttcagactgatggactcattaacattaaggttggactaagtggtatattgatggttaaaggcacaccatatacaaacacgaaccaaatcccgaaccaagaagacctctatggaaccttgctatcagaaaatgttatcggggttatccatgaccattacatcacattttatctcgatatggatattgatggatcggataattccttcgtgaaagtgaacttgcaaaggcaacaaacccctcctggagagtcaccaaggtcaagctacttgaaagctacaaaaagtgttgcgaagaccgaaaaagaagcacaaatcaagctcaagctttacgatccatacgagtttcacatggttaacccgaataagaaaactcgagtagggaacccggttgggtacaaggtagtccctgctggcactgccgctagcttacttgatcttgacgatccaccccaaaagagaggggcattcaccaacaaccaaatatgggttactccttataatagaagtgaggaatgggctggtgggttgtttgtttaccagagtaaaggtgaagacacccttgcaacatggtctgaaagggacagggatatagagaacaaggacattgtgttgtggtacaccttaggatttcatcacataccatgtcaagaagattttccgattatgccaacagtgtcatcgagtttttcattgaaaccggttaacttttttgagaagaatcccattcttggaatttcgccgaactttgaaaaggatcttccagtttgccaagcatcttcttcaacttcttgatgggtcacactgcttcaaacctaatcctgagtttgctactgaatgttgtatgattgtatgatcatacagtagttcccagaatccccaagtctttagattatgcataggggagtttacttcaataattatatggaatgttcaaatgaatgaactttattggagttcactaattgaatgcatcattgatcaaacaataatgcttcaactcatttgagtggtattgattgtacagataatttaagctcattttagcgataaacttgtcaaggaaaaactttgttagtggttgtcatatttccatctatacggatcaccgagattcaggggcggagtaaagataaataatagttttca

SEQ ID NO: 5393 - DNA, 4155 bp, Aquilegia formosa
ctctctcatttgaaatggccatggaagctactacaactcttcctttcttgttgtttctcttccttggtctccttctcatactctttacaagttcacgctacccatctctcaatacccatcttaagttcatcagaattcaagccaaagaacctagtcccactagtcatttagaccatttaactgaaatccctcaacacccactagacccacttaccttgcaagaaatcaccaaggttcaaactattctctcatcatattcacccttcacttcatccttccctactatccacacagtatgtcttcatgagccagataaatcacttgtatggaattggaacaaaggagaccctcttcctccaaggcaagcctttgtcattgcttacttagatggcaagtccaatgtgcttgtagtcgacatagggtcaagccaggttgtgagtcatgttctgaatccttattcaggatatccaatcctaatcccagaagacatggaaagcgcgataaaaataccatttagggatgcaagattcaacaagtcaatcatggatcgcggggttaatttatcggatgtaatttgtggaccacttgcagctggatggtatggacctaatgaagaagggagaaggcttgttaaggttgaatgcttctcacaccaaggaactgtgaatttctacatgaggcctattgaaggactcatagtcatggttgacgtcgacaagaaagaagtggtacattttacagattatggacatggtatcccgatagcagaatctacgaacactgattatcgatactcagcagtacagaacaagccattaaacatgaatccaatcaatccaatatccatggagcaaccaaaaggaccgagtttcaaggtagatggacatatggttaagtgggctaactgggaattccatctgaagcctcatccaagagctggtgtggtaatttcacaagccatggtccgggattcggaatctggtaagcttaggagagttatgtacagaggatttccttctgaactatttgtaccatatatggatccaagcgatgcttggtattttaagacctacatggatgctggtgagtatggaatgggattatcagctttgccacttgtaccacttaatgactgtccgcgaaatgcatattacatggatgctgtttttggcgcgtcagatgggaagccttatgttcgatccaatatgatctgtattttcgagcgttatgcaggtgatattgcttggcggcattcagagagctcattttctaacatggaggttcgagaagctagagcaaagattactctggtggttagaatggcagcatcagttggaaactatgactacatcattgattgggaatttcaaatggatggtttaattcgcgtcaaggtgatcctttcaggaatgttaatggtaaagggaacaccttatcagactcttgatcaagcaccagacggccagaatatgtctggcacattggtgtcggagaatttaattggtgttgtccatgatcatttcattgcatttcacctagacatggacatagatggatcagataattcttttgtaaatgtgcatctcaaaaagcaagaaacatcaccaggtgaatcaccaaggaagagttacttgaaagttgagagacaagtggccaaaaccgaaaaggatgcgcagattaagttcaagctctatgatccatcggaatatcatgttgtgaatcccaataaaaaatctagggtgggaaatccggttgggtacaaagttgtacctggagggaatgcagctagtttacttgacctgcatgatcctcctcaaataagaggagcattcacaaacaatcagatatgggtgactccatataacagaagtgaagaatgggcaggtggacttcttgtgttccagggaaaaggggaggatacactagctgtatggtctgaaagggaccgtccgattgagaacaaagacattgtgttatggtacactcttggattccatcacataccttgccaagaagactttcccataatgccttctgtatcctcaagttttgatctaaagcctgtgaatttttttgaaagcaatcctattcttcgggtagcacctaatgtgcaagaagacctacctgtttttcttgaagaacctgataaagaacttgttcttaattggaaaaaaggtgatccacttttacctagacaagcttcagtaatagttcttctcaaagggaaatctcacgtgcttattattgatttggattcgggtcaggttattaatcatgttaccagttcatcaaatgggtacccggttatgactattgaagatatgagttcatcaacatgggcacctttatctgatgcaactttcaaccgtacgatcgttgatcgagggatcaatttagctgatcttgcttgtttaccaatctcaacagggtggttcggtaaaaaggaagaaaatcggaggttaattaaggtacaatgttactctttacaaggtactgctaatttttacatgagacctattgaagggttaactgtcctactagatatggataccaagaaggttgtgggtatatcagatatgggtcgggatatacccataccgaaagctgaaaataccgactaccggtattccaaggtaaacaaatacagtaaagtgagacttatgaaaccaatatctatagagcaaccaaaaggtccaagttttgaaattgaagatgggcatttggtaaaatgggttaattgggagtttcatttgaaacccgacccgagagctggtgtgatcatatcaagagccatggtgcgcgacccggatacaggagagctaaggaatgtgatgtataaaggcatgacttctgaattgtttgtgccttatatggatcctactgatgcttggtactttaagacctatatggatgcaggcgaatacgggtttggactccaggctatgccacttgacccactaaatgactgtcctcgtaatgcgtattatatggatggtgtatttccaaccgctgatgggataccctatgtaagatcaaatatgatttgtgtgtttgagagatatgcaggtgatattgggtggagacatgcagagagtccaatcactggaatggagattcgagaagtcaggccgaaggtgacgttggtggttagaatggcagcgtccgtagctaattatgattacatagtggattgggagtttcagacagatggtcttattcgaatcaaggtaggactgagtgggattctcatggtgaaaggtaccccttatgtgaacatgaaccaagtgcctgaagaagagaaactttatggtaccttattgtctgaaaatgtgattggtgtcattcatgatcactatgtcacattctacctagatatggatgtagatggctcaaataactcttttgtgaaagttaaccttgtgagagaagaaacttcaccaggtgaatcaccaagaagaagttacttgaaagctaatagacatgttgctaagactgagaaggatgcacagatcaagttcaagctctatgacccttcagagcttcatgtcatcaatccatccaagttgactagaataggcaacccggttgggtataaagttgttcctgcaggtactgctgctagtatacttgatccaaaagatcctccacaaatgcgaggggcatttacaaacaatcaggtatgggtgacgccgtacaaccgaaatgagcaatgggctggtggtctgtttgtctaccagagccatggagaagatacacttgctgtgtggtctgagaagaatcgacctattgagaacaaagacattgtgttatggtacacattaggattccaccatgtaccatgccaggaagacttccctatcatgcctactgtatcgtccagctttgatctaaagcctgtaaatttctttgagagcaatcccattctcaatataccaccaaattttgaaaaggacttgcctgtttgcagagctgctgcttcggcttgatagttgtatatatgttaaactgtgcaatattagttagacctaagtctctattaacaacttatctgaataaagtgtgttcaatcgaagcaatccaagttgcgtgaaagtggtgatgtatgactgggtttgtaatctacgagttattggtattctcatccaagacctagtt

SEQ ID NO: 5394 - DNA, 2412 bp, Artemisia annua
ctagtatttgtactcttcatttcaacctcaaccactgcacccacactaaaaatggatgcaagaatcctcattagattcctcgttttcacatgcatcatcgccttacttcttctcctcactttcaccaacctcccttaccctctcccattcaccaccaacgccaactgctccgtcgactcaccacggtgcaacaccatcaaaaaaccaccaaaaccaaaacaacccataaacaatcttcacacatccgatgtaccacatcacccacttgacccactcactcttagtgagcttaataaggttcgtgagatccttttatccaatacccttttcagaaatacgggtaaatacgcgttgcactctgttgtccttgaagaaccagataagtctgtggtgctaaggtggaagtatggagatgagcttccggctaggaaggcttctgttattgcacgtgtcaatggtgtgacgcatgtgttgtgtgttgatataggtaccggagaggtgactccagtagacgttggagaacactctggttacccgacaatgactatcgaagacatgacatcggcaacatgggcaccgctagggaaccttgagtttaaccgtacaattatggcacgtggtattgatgtaaaggatcttgcatgtttaccgatatcactaggatggttcggaaaaaaagaggaaaaccgtaggttaattaaggtacaatgttattctatggaaggtaccgtgaacttttatatgagacctatcgaagggttgactgttgttctagatatggatacgaaagaagtgatcgagattaacgataatgggaagaacatccctatacctaaggctgcgggtaccgactaccgtttctcggtccaaaatgcaaaaattaatctaattaacccgatatctatcgaacaaccaaagggtccaagttttgttgtagatggtcatttagtgaaatgggctaattgggaatttcacctgaaacccgaccctagagcgggtgtggtgatctctcgggctatggttcaggacccgaatagtggagagatgaggaatgtgatgtataaagggtttacttcggagctatttgttccgtatatggatcctacagatgcatggtattttaagacatatatggatgcgggtgaatacggattcgggcttcaggcgatgcctcttgacccgctcaatgattgcccgcgcaatgcttattatatggacggtgtttttgccgcaggtgatggaataccttatgtccgatcgaatatggtgtgtgtttttgagagttatgctggcgatattggatggagacactccgagagtccgatcactggaatggagatacgggaggtgagaccaaaggtgacgcttgttgtaaggatggcagcctccgtcgctaattatgattatattgtcgattgggagtttcaaactgatggattgattcgagtcaaggttgggctcagtggaatcttgatggtgaaaggcactccttatatcaatatgaaccaagtaaatgaggtagaaaatcttcacggcaccctcttgtccgaaaatgttattggcgtcatccacgaccactacatcaccttctaccttgacatggacgttgatggacccgacaactcttttgtcaaagtaaacattaagagggaaacaaccactccagaagagtctcctaggttaagttacttgaaagcagttagaaatgtggcaaaaacagaaaaggatgcgcaagttaagctaaagttgtatgatccgtccgagtaccatatggttaacccatctaagaaaacacgtgtaggtaacccggtagggtataagttggtccctggtggcactgctgcaagcttgctggatcttaatgatccaccacaaaagcgtggtgccttcacgaataatcaaatatgggtcacgccgtataacaaaagtgaggagtgggccgggggattatttacgtatcagagccaaggggacgacactcttgcagtctggtccgaaagggaccgagctattgaaaacaaggacattgtaatgtggtacacattggggttccatcatgttccatgccaagaggatttcccaatcatgccaaccgtatcatcgagttttgatctaaaacccgttaacttttatgagagcaatcctattttgaacatcccaccaaacatggagaaagatttgcccgtctgcaacgctgctgcttctgcttaatttcctagtcttaagaatgacctttgtagatatttatgaaccttaggaaatcagaatgttgtagaacttaaacgttcgatctttaataatggttcaaggcacttttccttcttggtcgttattcaatgcatgtgtttacggctttgataagactaattggaaattgatatgtttggacaagatggcgattcactttttgtt

SEQ ID NO: 5395 - DNA, 2530 bp, Tropaeolum majus
ttacttcaactgggttaagctaagcttgtcgttacttataaaaccactccttcttcatcaacaacctcttcactcacactctgtaattccgaacaaagagtaaacgaaaccatggaatccaaaaaacttcttcgttttctcttcctctttcttatcgttggtatagtcttgatcttcacatggtatgttgaccttcacgcgccaccttccacgactgagcttctagagtgcgatggttactctccgtggtgcagcacctccaaaaaccgcctccagtccaagcaaaacaaaactgtaaaaaatcttttgaaaaatccgaataaactcacgcgcctccgtgatcacttgacagacacgccccaccacccgctggacccactcaccgttcaggagattaacaaagttcgtagtatcctctcctcgtacgcgcttatcgaatcggcgaaatcatacgcgcttcactctattgtactcgaagagcctgaaaagcacctcgtacagaaatggaaaaagaaggacccacttttaacgagaaaggccgccgtgatcacacgtgtcgacggagattctcacgtgctggttgttgatctgaccaccggtgaggtcaccgtgcaggactccggtccacactccggttacccgatgatgacgattgaagatatgacgtcagctacctgggcgccgctttcgagcgcggagtttaaccgcacgatcgtttcacgtggagtggatctgacagacctggcttgtcttccgttgacgacgggttggtacggcgaggaagaagagaaccggagattaatcaaggtgcagtgctacaccatgaaggacactgcaaatttttacatgagaccgatcgaagggttaaccgtgcttctcgatatggacactaaagaagtggtggggatatccgatcggggtaaaaccatacccgtaccaaaggccaccaacaccgaatacagatacctttccattcaaaagctcaatcgagtaatggatctcgtgaacccgatatcaatcgagcaacctagaggtccgagtttcgtcgtggaagatgaccacatggttaaatgggcgaactgggagtttcatttgaaacccgaccctagagccggagtcgttatctcccgggctaaggtccgtgacccggatagtggggagatgagagatgtgatgtacaaaggattcacttctgaattgtttgttccttacatggaccctacagatgcttggtacttcaagacttatatggatgcgggtgaatacgggttcgggttaacagctatgcctcttgacccgcttaacgattgccctcgaaatgcacactatatggacggcgtcttcgcggccgccgatggaaaaccatacgttcgatctaacatgatatgcgtctttgaaagctacaccggtgatatcggatggcgacactccgagagtccgattacgggtatggagattagagaagtgaggccaaaggtgaatctagtggttagaatggcagcatcagttgcaaactatgattatattgtagattgggaatttcaaacagatgggctaatcagagttaaggttggtcttagtggtatactgatggtgaaaggaagcccctacgagaacatgaaccaagtaccaaatcaagagaatctctacggcactttattgtcggaaaatgttataggtgtaattcacgaccattacgtcacgtttcacctcgacatggacatcgacggctccgatgacaactcatttgttaaggtaaacattcaaaggcaagaaacttcaccaggagaatcatcaccgaggagaagttaccttaaagcagtacggaatgtggctaaaactgaaaaagatgcacaaatcaagctcaaactctacgacccatctgagtttcatgtaatcaatccaaacaaaaagactcgggttgggaatccggttgggtataaaattgtccctgctgccactgctgctagtttgcttgacccacaagatccaccacagaaaagaggggcttttactaataaccagatatgggtaactccttataaccggagcgagcaatgggcgggtgggttgttcgtttatcagagcaaaggtgaagatactcttgccgagtggtcaaacagggatcgagctatagagaataaggacatagtcgtgtggtacacgctagggttccatcatgtaccatgtcaagaagattttccgatcatgccgacggtgtcagcaagcttcgatattaaaccggtaaatttctttgagagcaatcctattcttcgggttccgccaaacctcgagaaaaacttgcctgtttgtaagcctgctgcttcagcttgagatggtggttatggatccatcatgtctttaggtctcttaaaaatccatgtttgaagttgcaaagttgtttaggaactgttaatgcatagggaagatctttgggataataataaaatcaatcatacctaacgagagattggttgtgtttggtgacgcttcacagatgttaataactttataattttactcgggtcta

SEQ ID NO: 5396 - DNA, 1530 bp, Tropaeolum majus
accgaatacagatacctttccattcaaaagctcaatcgagtaatggatctcgtgaacccgatatcaatcgagcaacctagaggtccgagtttcgtcgtggaagatgaccacatggttaaatgggcgaactgggagtttcatttgaaacccgaccctagagccggagtcgttatctcccgggctaaggtccgtgacccggatagtggggagatgagagatgtgatgtacaaaggattcacttctgaattgtttgttccttacatggaccctacagatgcttggtacttcaagacttatatggatgcgggtgaatacgggttcgggttaacagctatgcctcttgacccgcttaacgattgccctcgaaatgcacactatatggacggcgtcttcgcggccgccgatggaaaaccatacgttcgatctaacatgatatgcgtctttgaaagctacaccggtgatatcggatggcgacactccgagagtccgattacgggtatggagattagagaagtgaggccaaaggtgaatctagtggttagaatggcagcatcagttgcaaactatgattatattgtagattgggaatttcaaacagatgggctaatcagagttaaggttggtcttagtggtatactgatggtgaaaggaagcccctacgagaacatgaaccaagtaccaaatcaagagaatctctacggcactttattgtcggaaaatgttataggtgtaattcacgaccattacgtcacgtttcacctcgacatggacatcgacggctccgatgacaactcatttgttaaggtaaacattcaaaggcaagaaacttcaccaggagaatcatcaccgaggagaagttaccttaaagcagtacggaatgtggctaaaactgaaaaagatgcacaaatcaagctcaaactctacgacccatctgagtttcatgtaatcaatccaaacaaaaagactcgggttgggaatccggttgggtataaaattgtccctgctgccactgctgctagtttgcttgacccacaagatccaccacagaaaagaggggcttttactaataaccagatatgggtaactccttataaccggagcgagcaatgggcgggtgggttgttcgtttatcagagcaaaggtgaagatactcttgccgagtggtcaaacagggatcgagctatagagaataaggacatagtcgtgtggtacacgctagggttccatcatgtaccatgtcaagaagattttccgatcatgccgacggtgtcagcaagcttcgatattaaaccggtaaatttctttgagagcaatcctattcttcgggttccgccaaacctcgagaaaaacttgcctgtttgtaagcctgctgcttcagcttgagatggtggttatggatccatcatgtctttaggtctcttaaaaatccatgtttgaagttgcaaagttgtttaggaactgttaatgcatagggaagatctttgggataataataaaatcaatcatacctaacgagagattggttgtgtt

SEQ ID NO: 5397 - DNA, 1589 bp, Oryza sativa
gcacattaccttcagaacagataaggcgccccacccgtcagtctcacggtttctgctttccacatccgccgcggccatggcgctcgtcaccgtccacgcgcgcctcgccgccgccgcctcctccgcctcgccgccgcttcgctccgccgcctcctgcacccgcctccgtgccctcagtacagtcaccggaacccgcctcagcattcggcaccaacagcgccggcgctggcggcggccgaggcgcgccgccgccatcgccgcgtcgctcgacctcaacgaggacaacgtccgcctcgccatcgacgaagccaaggccgagctgggtcagctgttcgacacatcggtgggaatcacagggcaagttgatctcgcggagctggacgggccgttcgtgaagctccggctcaagggcaagttctggcacacccgcgccaccgtgctcgcgcggatcggcaactacctcaagaaccgcatcccggaaatcttggaagtggagatagaagatgagaagcagcttgatgatagccctgcagccttctgagtggcattcaccagtcaatggctccctccaatgcacattgcacaaacctgaatttctgaagttaagctgaagaaccaagtctgctggaatgcactatcctacattcctaccttacttttctggtcaacatcgcacaaattcagggatctccaattcccctacattttgattgtggagatgcgtatgatttgagactattctattttactagcactcacgagtcgcaagaacctgaaaactgtactgacgggacctacttacggagaggtttattagacgcttttcctgattctgagcttgttggtatcacctttatgtgtatttatttaaaaaaagggtgtagcaatgatgtgctgctattctgagtactatatttgtgttcactctttcgaatgatgtttactccatccgtcccaaaatatagcaaccttgaactggatggaacacattctagtacaacgaatctggacaggggtatgttacatttgaaataccactgcatcagtgtgctcctgtggacagtactctggtagaggtataagttggctgctcgttcacgaaatgtactggtcatccatccaatgagcgtcatggtaattcaaattcttcaatttgaaattctgatatcctgattttctcagttcttacccatttgagtcatattttttatgttttgtgaactcattaaatagggttcttggaatgttgtggcaacgcagctgtggccatttcagtgctcttgtcaatctgtcaaatgtttgggcagcaatgaactaggagtatctgaagagaaagcagtttgcaaccctaggctctagctccgtggaacaaaccatttcgacaatcttgtactgaaatgtactgaaatcaaatactactatattcgctcttttcctttgagaaaaagttgtttgaggccacttctggttcctactccgatgtacttattggatggtgcaattgatgatgctggaaactgttgctttcaaattacagggagaagttgggcttgtctatcagagtaggtacaatagcaggctataagcca

SEQ ID NO: 5398 - DNA, 1319 bp, Oryza sativa
aaggcgccccacccgtcagtctcacggtttctgctttccacatccgccgcggccatggcgctcgtcaccgtccacgcgcgcctcgccgccgccgcctcctccgcctcgccgccgcttcgctccgccgcctcctgcacccgcctccgtgccctcagtacagtcaccggaacccgcctcagcattcggcaccaacagcgccggcgctggcggcggccgaggcgcgccgccgccatcgccgcgtcgctcgacctcaacgaggacaacgtccgcctcgccatcgacgaagccaaggccgagctgggtcagctgttcgacacatcggtgggaatcacagggcaagttgatctcgcggagctggacgggccgttcgtgaagctccggctcaagggcaagttctggcacacccgcgccaccgtgctcgcgcggatcggcaactacctcaagaaccgcatcccggaaatcttggaagtggagatagaagatgagaagcagcttgatgatagccctgcagccttctgagtggcattcaccagtcaatggctccctccaatgcacattgcacaaacctgaatttctgaagttaagctgaagaaccaagtctgctggaatgcactatcctacattcctaccttacttttctggtcaacatcgcacaaattcagggatctccaattcccctacattttgattgtggagatgcgtatgatttgagactattctattttactagcactcacgagtcgcaagaacctgaaaactgtactgacgggacctacttacggagaggtttattagacgcttttcctgattctgagcttgttggtatcacctttatgtgtatttatttaaaaaaagggtgtagcaatgatgtgctgctattctgagtactatatttgtgttcactctttcgaatgatgtttactccatccgtcccaaaatatagcaaccttgaactggatggaacacattctagtacaacgaatctggacaggggtatgttacatttgaaataccactgcatcagtgtgctcctgtggacagtactctggtagaggtataagttggctgctcgttcacgaaatgtactggtcatccatccaatgagcgtcatgggttcttggaatgttgtggcaacgcagctgtggccatttcagtgctcttgtcaatctgtcaaatgtttgggcagcaatgaactaggagtatctgaagagaaagcagtttgcaaccctaggctctagctccgtggaacaaaccatttcgacaatcttgtactgaaatgtactgaaatcaaatactactatattcgctcttttcctttg

SEQ ID NO: 5399 - DNA, 550 bp, Secale cereale
gtctctctgctccacccctccccgcatccgtctccagcctctcagaacctcaaccggacacatcttccgcagcccgcggtgcaggcgccggccgtgtcgcgctcgcgccgcctccatcaccgcgtcgctcgacctcaccgaggacaacgtccggcaggccatcgtcgacgccaaagcagagctggcccagctgttcgacacgtcggtcggcataacagggcaagttgatctggcggagctggacgggccgttcgtgaagctccggctgaagggcaagttctggcacacccgggccaccgtcgtcgcgcggataggcaactacctcaagaaccgtatcccggaaatcttggaggtggagatcgaagatgaggaccagcttgacgacagccccgccgcttactgagggtaaagaacatgcaagctgttgctgagggtgcctactttttcagtaccgggtttgttaggcgtaggatcatcttttttgtgagcggaaacgatgcggcaatgatgttgtatatttatgcactagctaactcctgccaactccccc

SEQ ID NO: 5400 - DNA, 776 bp, Panicum virgatum
ttcctgtggaggaagaatgccacttttgcgatatctaggcattacaaacgctttgatgtgtttgaagaagcagaagcaaataaagctgctggaaaatatgacaacgcgtcaattgattaccagatagagttttacagaaatgagggcctgtcacattattctcctgctaagtttcccatcacaagtgatgtccctgaaggttgtgtgatcatcagagaacatatccccatcacgaacctcttcacatgcctatggttcaatgaagttgaccgcttcacctccagggatcagataagtttcagcaccgtccgagacaaaatcagggccagggttggctggatgcctgaaatgttcctggactgcgaaaggcgcaactttgtcgttcaggcgtaccacagggagctactggagcaaatgattgcatccggtaggaggcccccctcaacgaccgacgcaccaccgtcccgaaagcttcggccgggcagcaggaaagctcccccgtcgaagaagccctccgtgaagcggaaaaaggagaagaagtcgagctcacggaggcgtgttcccaagcccgtcgccgcggggatgggtgctatgtgacgcaaagtttttcggcggagtctggactcccacacacttatacaagcgtgtaccggaatacaagctgattcgattagggccggggcctgtaattgcgccccggcgaaagttgtccatagttattcttcattgttgttgtacataacagcgcaaatcaatattcaattctgttcattgag

SEQ ID NO: 5401 - DNA, 664 bp, Leymus cinereus x Leymus triticoides
taataaagctgctggaaagtatgacaatgcttcaatcgatgaacaaatagatttttacagaaatgagggcctaacacattattctcccgccaaacttcctatcacaagtgacgtccctgaaggctgtgtgatcatcagagaacacgtccccatctcgaacctcttcacatgcctttggttcaatgaagttgaccgtttcaccgccagggatcagattagtttcagcaccgtccgggacaaaataagggctaaagtcggctggatgccccagatgttcctggactgcgaaaggcgcaactttgttgtccaggcataccacagggagctgctagagcaaatgattgcgtccggtaggaacacgcctccgatcgccgtcgaaccatcacggaaaatcagaccgggtagtagcaggagagctcccccgtcgaagaagcctgtcgtgaagcggaaaaaggagaagaaatcgagctcgcggaggcggatcctcaagccggttacctgggcgatggatgctgtgtgacgaaggttcgccaggatggacggagtcctgtcactcgatagttgggtatggccgtatggcagctggtgccactaggggggaaagagagagggaagggaggattgtaattttttccggccacgaagtgaaatttgttcatagtca

SEQ ID NO: 5402 - DNA, 1136 bp, Pennisetum glaucum
tgacaaagccgcagtggacgttcatcgattcactaatatcaaaagatttattcctttgctccagaggaaagaaacctggccaaggtactggatttgacatcaaggatgatgacctgatagagatggagcaatgccgcgaactagtcgtagcttccgctatttttggaaattatgacatgattcaacatccgaggaacatcagtgattttgcaaaggcaaacgcatgcttttacatgttcgtagatgaagaaacagaagcttatgtcaagaatactagttctttgtacaataataataaaattggactatggaggttagtggttgtccgtaacctcccttatgaagacccaaggcgtacgggaaagattccgaaacttctactccataggctttttccaaatgtgagattttcagtttggatagatgcaaaacttgagcttgttgctgatccctatcttctgcttgagaggttcctgtggaggaagaatgccacttttgcgatctctcggcattacaaacgttttgatgtgtttgaagaagcagaagctaataaagctgccggaaagtatgacaatgcatcaattgattaccagatagagttttacagaaacgagggcctatcacattattctcctgctaagttccccatcacgagtgatgtccctgaaggttgtgtgatcatcagagaacacatccccatcacgaatctcttcacatgcctatggttcaatgaagttgaccgcttcacctccagggatcagataagtttcagcactgtccgtgacaaaatcagggccagagttggctggatgcctcaaatgttcctggactgcgaaaggcgcaacttcgtcgttcaggcgtaccacagggagctgctggagcaaatgattgcgtccggtaggaggcccccctcaacgaccgacgcaccaccgtctcgaaaacttcggccaggcagcaggaaagcgccgccgtcgaagaagccctccgtgaagcggaaaaaggagaagaaatcgagctcgcggaggcgtgtccccaagcccccgccggtcgctggggggatgggtgctatgtgacgcaaagtttttcggcggaggctggactcccacacttatacgaggctgtaacggaatacaagc

SEQ ID NO: 5403 - DNA, 1260 bp, Saccharum officinarum
agagaaacgattctttcaacattaatgaatcaatgactgtacactgcggctttgtcagaggaaagaaacctggccaaggtactggattcgatatcaaggatgatgatctgctagagatggaacaatgccgtgagctagtcgtagcttctgctatttttggaaattatgatatgattcaacatccgaggaacatcagtgaattttcaaaggcaaatgcatgtttctatatgtttgtagatgaagaaacagaggcttatgtcaagaattctagttctctgtacaataataataaagttggactgtggaggctggtggttgtccgaaacctcccttatgaagacccaaggcgtacaggaaagattccaaaacttctgctccataggctttttccaaatgtgagattttcagtttggatagatgcaaaacttgagcttgttgcggatccctatctcctgcttgagagattcctgtggaggaagaataccacttttgcaatctctcggcattacaaacgctttgatgtgtttgaagaagcagaagctaataaagctgctggaaagtatgacaacgcgtcaattgattaccaaatagagttttacagaaatgaaggcctaacacattattctcctgctaagcttcccatcacaagtgatgtccctgaaggctgtgtgatcatcagagaacacatccccatcacgaacctcttcacgtgcctgtggttcaatgaagttgaccgcttcacctccagggaccaaataagcttcagcaccgtccgggacaaaatcagagctagagttggctggatgcctgaaatgttcttggactgcgaaaggcgcaactttgtcgttcaggcataccacagggagctactggagcagatgattgcgtccggtaggatgcccccttcggcggtggaggcgaccgacgcaccaccatctcggaaagtccgggcaggtagcaggaaagctcctccgtcgaagaagccctccgtgaagcggaaaaaggagaagaaatcgagctcgcgacggcgtctcccgaaacccgtcgccggggggttgggtgcgatgtgacagtaagttttcctcggtagcagagtctggatactcgacacaatcacacttatacagcgtgtaccggaatacaaacaatgttccattagggctggggcttgtaatcgtgccccgtcgaaatttgttcatagtttattcttcatcattgttgtacataataactgcgccaaaccaatattcaattttgttc

SEQ ID NO: 5404 - DNA, 930 bp, Secale cereale
ccctatgttgttgtcaccgacccgcctgacggctctcgcaacatcgaggtgtcgatccccactggaacgatattcgggatatacgataggctggtggaactcgaccagctccctgtggaggagaaagctcagctcaattcgctgcagagcggttctcgcttggtcgcagcaggatatgtcctgtattcatctgccactatcttctgcatcagtttcggggcaggaacccatggcttcacgttggatcggtcgacaggagaatttgttctgacgcatccgtccatgcaaataccccccagaggacagatatattcagtgaatgatgctcggtatttcgactggccagagggcctgaagaagtacattgacacgatcagacaaggcaaggggcagcatcccaagaagtactcggctcggtacgtgtgctcactggtcgctgattttcatcggacgatcatatacggtggagtcgcaatgaacccaagggatcaccttcggttggtttacgaggcaaatcctctcagtttccttgccgagcaggcaggggggcgaggctcggatggcaaaaccagaatcctgtccattcagcctgtgaagctgcaccagaggctgccattgttcctggggagcatggatgacatgcttgagctagaaagctatggagatgtccagcagaaggtcaatccaggatacgatgtttaatgttgcacaggaggtaaaatcttcaggtgctgtagtttacaatgaggtaacgaatgtatatggcagtctatatttgcaagcacaatgttatctatgtgtatcgtttccttttctttcttttgcctgcttgtctgtgcaactgcagagtactgcatagtgtgctgttgttcactgtgacaaaacaaaatatgcaacattgcttatttttctagtaaaagaaaaaaaaaa

SEQ ID NO: 5405 - DNA, 973 bp, Panicum virgatum
  misc_feature (6)..(7): n is a, c, g, or t
  misc_feature (311)..(311): n is a, c, g, or t
  misc_feature (341)..(341): n is a, c, g, or t
  misc_feature (791)..(791): n is a, c, g, or t
gaattnngaatgatatcatcttgtcatcggtcaaaagttctggaaaggttgcagtgcttgcatccgaagaaaacgatcagcccatttggatatccgatgacggtccatatgttgttgttaccgatccgcttgatggttctcgtaacattgaggtctccatacctacgggaacaatatttgggatatataataggctggtggagctcgaccatctgcctttggaggagagggctcagctcaattcgctgcaaagtggaactcgccttgtcgctgctgggtatgtcctttactcatctgccaccatcttgtgnatcagcttcggtgcaggtattcatgccttnacattggattggtcaactggagaattcattcttacacatccgtcactccaaataccgcctagaggacaaatatattccgtgaatgatgcacggtattttgattggcctgagggcctaaggaagtacattgacacaatcagacaaggcaaaggacagcacccgaagaagtactcagcacgctacgtttgctcactggttgctgatttccaccggacgctcatatatggtggagtagctatgaacccaagggatcatctgcggttggtttatgaggcgaatcctctcagtttccttgctgagcaggctggtggtagagggtcagatggcaagaacagaatcctctcgattcagcctgtgaagctgcaccagaggttgccattgttcttggggagcatggaggacatgcttgagttggaaagctatggggatgtccaacagaaggttaatccnggatatgaagtttagccatatgtgaaattattcacattttcaggtgttgtagcaatacaatgaggtaaagcacatgtggtaatcctgtctttacatgaccgatattaatttctctccctctccctgtgccaaaactcattgtacttctctgtgaatgcaagtattatgaatttttttttaga

SEQ ID NO: 5406 - DNA, 1580 bp, Oryza sativa
caaccaaccaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcgaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacctgtcaggttttctgtttttgtctccgcgactatgcggtttcactgtgtaatatagcagaaaaattaggctgcatttctcccggtacgaaatggaagggacaacacaaatttatatgtaatgcatcctttggctacatggacacttttatctgcaacgtgttctgaaatttcttttgtctctgcagtctgtacacttctctgcaatgtggtccggttagttcgatttaagagcag

SEQ ID NO: 5407 - DNA, 1507 bp, Oryza sativa
accaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcgaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacctgtcaggttttctgtttttgtctccgcgactatgcggtttcactgtgtaatatagcagaaaaattaggctgcatttctcccggtacgaaatggaagggacaacacaaatttatatgtaatgcatcctttggctacatggacacttttatctgcaacgtgttctgaaa

SEQ ID NO: 5408 - DNA, 1348 bp, Tropaeolum majus
cggccgggggagttcgcgggaaagggagggattgatgtgggagatgatctgttggtgttgctttgccatattcagtatgcttgcaaaagaattgctgctcttgtagcttctcctttcagttccagtactcttggtaaacagaaaggcatcaatggcggtgatggtgagtctggtagggataagccgaagccgctcgatatcgtatctgatgaaattatcttgacctcgcttcgaaactctggaaaagttgcagtaatggcttcggaagaaaatgatattcccgtctggttaaatgatgatggcccgtacgtggtggttacagaccctctagatggttcaagaaacatagacgcctccataccaaccggaacaatatttggaatttataagcgccttgcggaagtcgatcacttaccaacggaggagaaggctttgttgaattctctccaaagcggaagtaggcttgtggctgctggatatgttctttattcatcagccacgatactgtccgttagctttggttccgggacccatgcttttacgctagatcattcgacaggagatttcgttctcacacatcgaagcattcagattcctcgacgaggtcaaatctattcggtcaacgatgcacgatatttcgattggcctgaaggtctaagaaagtacatagacaccgtaagacaagggaaaggacaatacccgaagaaatattcggcacgctacatctgttctttggttgctgatttccatcgcactatgttgtacggtggagtggctatgaaccctagagatcatcttcgtttagtgtacgaggcaaacccgcttagctttcttgcggagcaaggcggtggaagagggtcggatggtaaaactcggattctttcgattcagccggtgaagctgcaccagagactacctctgtttttagggagtgtggaggatgttgtggagttggagagttatggcgatgttcaacagaaagtaaatcctggatacgatgtttgatgtttgatgctcgatgatgtccggatgctcgatgttcgattaatgtaaaaaaaaaaacgagcaaaataagagaggttgatcattcaaagttgattgccgatgcgaccgggaagaaaccaaattaacagaaaactaaaatcggttaatcgattatgacttgtaaaaacacagaaactaatgtaaccggtttaaatttgtaattatgttttcgtgtgtatatatatatatattatttgtgatttatatggatgaataatgggcaaacttcattttgtccatttaacttattattgtaaagtacaaataatatctttctagactattgtgtcattagaaaaaaaaa

SEQ ID NO: 5409 - DNA, 1432 bp, Setaria italica
gccttcgccgatcaacacgagccatccaaccgtgggctgaactatgccgttatcgtcgtctctctcctccttcctcgtcctccgccaccacccgccgcgctcgctcccgccaacttcaaatcgcccgccgctgcacctccgcctcctcctccctccgttcgcacggcgccgcgccttcgtctgccagccgctcgccgcggcggccacggacgacatggctgctgcggccgcggcggcgtcgcctcccacgctgctcgagcacatgggccaggccggcgcggccgcggacctcaccgtcctcgtggcccacatccagagcgcgtgcaagcgcatcgcttccctcgtggcgtcccccggcaacgccgagctgtcgagggcgaaggcggccggcggagggggcgtggcggccgaccgggacgcgcccaagccgctcgacgaattgtcgaatgatatcatcttgtcatcgctcaaaagttctggaaaggttgcagtcctcgcgtctgaagaaaatgatctgcctatttggatatccgatgatggtccatatgttgttgttaccgatccgcttgatggttctcgcaacattgaggtctccatacctactggaacaatatttggaatatataacaggctagtggagctcgatcatctccctttggaggagagagctcagctcaattcgctgcaaagtggaactcgccttgttgctgctgggtatgtcctgtattcgtctgccaccatcttgtgtatcagctttggtgcaggtacccatgccttcacattggattggtcgactggagaattcattcttacacatccttccctccagataccacctagaggacaaatatattcagtgaatgatgcacggtattttgattggcctgagggcctaaggaagtacattgacacaatcagacaaggcaaaggacagcacccaaagaagtactcagctcgctatgtttgctcactggttgctgatttccaccggacgctcatatatggtggagttgctatgaacccaagggatcatctgcggttggtttatgaggcgaatcctctcagtttccttgctgaacaggctggtggtagagggtccgatggcaagaacagaatcctcttgattcagcccatcaagctgcaccagaggttgccattgttcttggggagcatggaggacatgcttgagttggaaagctacggagatgtccagcagaaggttaatcctggatatgaagtttaacaatatgtaaaaatactcagattttctggtgttctagcaatacagtaagctaaaagtaaaacacttacagcaatcctgtctttgcatgaccagaatttgttatatttcgctgtgaatgtaagtattatgaatttttttaggcagattgcacaaccctacaccctatttgattacaggatgcctgtttgt

SEQ ID NO: 5410 - DNA, 1589 bp, Zea mays
cagatggatgcaatgcaaccttttccggtttcctctcctatatgcattcgccgaccaagtgaccaacacgcgccatccattccaacctggggctgaaccgccgaactatgccgttgtcgtctttctccttcctccgccaccacctgccgctccctcttcagctcccgccaacttcaaatcgtcagccaccacacccccgcctcttccacctcctcctccctccgttcacaccgcgccgcaccttcgtctgccagccgctcaccgcggccacggacgatatggctgctgcggccgcggcggcgtcgccccccacactgctcgagcacatgggccaggcgggcacggccgctgacctcactgtccttgtggcccatatccagagcgcgtgcaagcgcatcgcggctctcgtggcgtcccccggcaacgccgagctgtcgcgggccaaggcgaggggtggggctatggcggcagggcgtgacgcgcctaagccgctcgacgaattgtcgaatgatatcatcttgtcagcgctccaaagttctggaaaggttgcagcgctagcatctgaagaaaacgatctgcccatttggatatctgatggcggtccatatgttgttgttactgatccgcttgatggttctcgcaacattgaggtctccatacctaccggaacaatatttgggatctacaataggctggtggaggtcgaccatctccctttggaggagagagctcagctcaactcactgcaaagtggaactcgccttgttgctgctggatatgtcctgtactcatctgccaccatcttgtgtatcagctttggtgcaggtacccatgccttcacattggattggtcgactggagaattcatccttacacatccttccatccaaataccacctagagggcagatatattcagtgaacgacgctaggtattttgactggcccgagggcttaaggaagtacattgacacaatcagacaaggcaaaggacagcatccgaagaagtactcagctcgctacgtgtgctcactggtggctgatttccaccggacgctcatatatggcggggtcgctatgaacccaagggaccatctgcggctggtttatgaggcgaaccctctcagtttccttgctgaacaggctgggggtagagggtcagatggcaagaacagaatcctcaccattcagcctgtgaagttgcaccagaggctgcctttgttcttaggaagcatggatgacatgcttgagttggaaagctacggagatgtgcagcagaaggtcaatcctggatatgaagtttaacgatatgtaaaaaaaggttcagattttttcaagcgcccaagcagaaaataaggtaacactcgtgtggcaaccctgtatctgccgatactataccttgtcttttcctctcggtttttagcccaccgcaacttgattgggactaaatccagttgttgttattgttgttcactcttttctgccaaaaattgctgtacttctcagtgaatgtaagttttatgattggcagcttcctcaaccctgcacgcttatatgtgaataatagaaagcttctaaagtctaaggcta

SEQ ID NO: 5411 - DNA, 1252 bp, Tropaeolum majus
cggccgggggagttcgcgggaaagggagggattgatgtgggagatgatctgttggtgttgctttgccatattcagtatgcttgcaaaagaattgctgctcttgtagcttctcctttcagttccagtactcttggtaaacagaaaggcatcaatggcggtgatggtgagtctggtagggataagccgaagccgctcgatatcgtatctgatgaaattatcttgacctcgcttcgaaactctggaaaagttgcagtaatggcttcggaagaaaatgatattcccgtctggttaaatgatgatggcccgtacgtggtggttacagaccctctagatggttcaagaaacatagacgcctccataccaaccggaacaatatttggaatttataagcgccttgcggaagtcgatcacttaccaacggaggagaaggctttgttgaattctctccaaagcggaagtaggcttgtggctgctggatatgttctttattcatcagccacgatactgtccgttagctttggttccgggacccatgcttttacgctagatcattcgacaggagatttcgttctcacacatcgaagcattcagattcctcgacgaggtcaaatctattcggtcaacgatgcacgatatttcgattggcctgaaggtctaagaaagtacatagacaccgtaagacaagggaaaggacaatacccgaagaaatattcggcacgctacatctgttctttggttgctgatttccatcgcactatgttgtacggtggagtggctatgaaccctagagatcatcttcgtttagtgtacgaggcaaacccgcttagctttcttgcggagcaaggcggtggaagagggtcggatggtaaaactcggattctttcgattcagccggtgaagctgcaccagagactacctctgtttttagggagtgtggaggatgttgtggagttggagagttatggcgatgttcaacagaaagtaaatcctggatacgatgtttgatgtttgatgctcgatgatgtccggatgctcgatgttcgattaatgtaaaaaaaaaaaacgagacaaaataagagaggttgatcattcaaagttgattgccgatgcgacccggggaagaaaaccaaattaacagaaaactaaaaatcggttaatcgattatgacttgtaaaaacacagaaactaatgtaaccggtttaaattagtaattatgtttcgtgtgtatatatatatatattatttgtgatcc

SEQ ID NO: 5412 - DNA, 1529 bp, Sorghum bicolor
cagttggatgcaaccattatcggttttttcctcctccaagttatgccttcgccgaccccgacaaacaggaaccatccaaacacgggctgagctatgccgttatcatctctctccctcctccgccaccacccgccgcgccctctcccgccaacttcaaatcgtcagccgccaccgccacaaccccgcctactcctccctccgttcacagggcgccgcgccttcgtctgccagccgctcgccgcggccacggacgacatggctgctgcggccgcggcggcgtcgccccccacgctgctcgagcacatgggccaggcgggcacggccgctgacctcactgtcctcgtggcgcatatccagagcgcatgcaagcgcatcgcggctctcgtagcgtcccccggcaacgccgaactgtcgcggtctaataaggcggggcgtgggaccgtggcggccgggcgtgacgcgcctaagccgctcgacgaattgtcgaatgatatcatcttgtcatcgctccaaagttctggaaaggttgcagtgctagcatccgaagaaaatgatcttcccatttggatatctaatgacggtccatatgttgttgttactgatccgcttgatggttctcgcaacattgaggtctccatacctactggaacaatatttgggatctacaataggctggtggagctggaccatctccctttggaggagagagctcagctcaattcactgcaaagtggaactcgccttgttgctgctgggtatgtcctgtactcatctgccaccatcttgtgtatcagcttcggtgcaggtacccatgccttcacattggattggtcgaccggagaattcatccttacacatccttccatccaaataccccctagagggcagatatattcggtgaatgacgctaggtattttgactggcctgagggcttaaggaagtacattgacacaatcagacaaggcaagggacagcatccgaagaagtactcagctcgctacgtgtgctcactggttgctgatttccaccggacgctcatatatggtggggttgctatgaacccaagggatcatctgcggctggtttatgaggcaaatcctctcagtttccttgctgagcaggctgggggtagagggtcagatggaaagaacagaatcctcaacattcagcctgtgaagttgcaccagaggctgcccttgttcttagggagcatagatgacatgcttgagctggaaagctatggagatgtgcagcagaaggttaatcctggatatgaagtttaacgatatgtaaaaagcttcagatttttcaggtgccgaagcatacaataaggtaacagacgtgtggcaaccctatatttgcatacaataaggtagcccaccacaacttgcttgggactaaacgctttgttgttgttctcttttctgccaaaatttgctgtacctttgagtgaagtattatgattttttttggcagctacacaaccctgcaccctatttgtgaataatagaaagtttctaaaatctaa

SEQ ID NO: 5413 - DNA, 1532 bp, Sorghum bicolor
cgacagttggatgcaaccattatcggttttttcctcctccaagttatgccttcgccgaccccgacaaacaggaaccatccaaacacgggctgagctatgccgttatcatctctctccctcctccgccaccacccgccgcgccctctcccgccaacttcaaatcgtcagccgccaccgccacaaccccgcctactcctccctccgttcacagggcgccgcgccttcgtctgccagccgctcgccgcggccacggacgacatggctgctgcggccgcggcggcgtcgccccccacgctgctcgagcacatgggccaggcgggcacggccgctgacctcactgtcctcgtggcgcatatccagagcgcatgcaagcgcatcgcggctctcgtagcgtcccccggcaacgccgaactgtcgcggtctaataaggcggggcgtgggaccgtggcggccgggcgtgacgcgcctaagccgctcgacgaattgtcgaatgatatcatcttgtcatcgctccaaagttctggaaaggttgcagtgctagcatccgaagaaaatgatcttcccatttggatatctaatgacggtccatatgttgttgttactgatccgcttgatggttctcgcaacattgaggtctccatacctactggaacaatatttgggatctacaataggctggtggagctggaccatctccctttggaggagagagctcagctcaattcactgcaaagtggaactcgccttgttgctgctgggtatgtcctgtactcatctgccaccatcttgtgtatcagcttcggtgcaggtacccatgccttcacattggattggtcgaccggagaattcatccttacacatccttccatccaaataccccctagagggcagatatattcggtgaatgacgctaggtattttgactggcctgagggcttaaggaagtacattgacacaatcagacaaggcaagggacagcatccgaagaagtactcagctcgctacgtgtgctcactggttgctgatttccaccggacgctcatatatggtggggttgctatgaacccaagggatcatctgcggctggtttatgaggcaaatcctctcagtttccttgctgagcaggctgggggtagagggtcagatggaaagaacagaatcctcaacattcagcctgtgaagttgcaccagaggctgcccttgttcttagggagcatagatgacatgcttgagctggaaagctatggagatgtgcagcagaaggttaatcctggatatgaagtttaacgatatgtaaaaagcttcagatttttcaggtgccgaagcatacaataaggtaacagacgtgtggcaaccctatatttgcatacaataaggtagcccaccacaacttgcttgggactaaacgctttgttgttgttctcttttctgccaaaatttgctgtacctttgagtgaagtattatgattttttttggcagctacacaaccctgcaccctatttgtgaataatagaaagtttctaaaatctaa

SEQ ID NO: 5414 - DNA, 616 bp, Fagus grandifolia
acactgtgagacaaggaaaaggaagatacgccaagaagtactcagcccgttatatttgttctctggtggctgatctccatcggactctaatgtatggaggggtggcaatgaatccaagggaccatcttcgtctggtttatgaggcaaaccctcttagttttcttgtagagcaagctggggggagagggtctgatggtaaaagtagaattctttcgattcaaccagttaagctgcatcagagacttcctctgtttcttggaagtttggatgacatggaagagttggagagttatggtgatgttcaacagaaagtaaatcctggttatgaagtttgatcctatagaaaactcaaaattccattgattatagtgtaaatcaacctggggttcctttgtgtcactgaagatctccatctatcaagaatttagagtttacatcacaagtatgtttaatctagtcactccaactattgagagttagtaaaaatttgaactgtcctttctttacgctgtctatcatacccatcttcttaggaactaaaagtagcttgaagagtttagatgtgaaaaactagaagcctagaagaggtctttcttcctcctttagtggtaaaaaa

SEQ ID NO: 5415 - DNA, 1768 bp, Malus domestica
tatatgctttgctgcctattttcttgaatgatatacagcaaatcccttatcccctttccttggaaactcaatcaagtccaaaaatggcaccactctaatcaaaggctcaaagcccccaaacccaaactcaatatatattatcatgccattacccaccacaatcataaccataacaccaccgcccacctcctgccctgctccaattttcccaccaaatcgccctcatttcccgcccagaaatctgtttactacaaaagccatcctccacaaccacagaccaacaatggcaaatctttctgggttcggtttcagtattgggtcccgactggtggcttcttccggtactagtggcagtgttgccgatgatgaggtgcgcaccctgattgagtatgcgtccggcgagggaggtgccactgtaggagatgatctggtgcttctgttccaccacttacagtacgcctgcaagagaatcgcagctcttgtagcttctcctttcaattccagccttggaaagcacaagggtctcgctggcggcggcgcttcggctgctgggtcaggccgggatgcaccgaagcctctcgatatcgtttcgaatgaaatcatcttgtcatctcttaaaaattctggaaaagtagctgtcatggcttcagaagaagatgatactccaatttggataaccgatgatggcccatttgtggtggtaacggatcctctagatggttctcgaaatattgatgcgtccattcccactggaaccatttttgggatttataaacgccttccggagctggatcatctaccaaaggaggagaaggctttgctgaattcactccagaagggaactaatcttgttgctgccggctatgttctttattcatctgccacaatattctgcaccagctttggttcaggaacacatgcattcacactggatcattcaacaggagatttcattctcacacacccaagcttaaaaattcctcctcaagggcaaatatattctgtaaatgatgctcgatattttgactggcccaacggattaaggcaatacatagacactgtgagacaagggaaaggcagataccccaagaagtactctgcacgttatatctgttctctggtagcagattttcatcgaactctactgtatggtggagtgacaatgaatccaagggaccaccttcgtctggtttacgaagccaaccctcttagttttctggtggagcaagccgggggcaaaggttctgatggtaaaagtagaattctatcgattcagccagtcaagctgcaccaaaggctgcctctgttcttggggagtttggaggacatggaagagttagagagttacggagatgtgcaacagaaagtgaacccgggatacgaggtttgacaacatcaataggctgatctcacaaaatccagtggatatatcgtctgagtaaaacctgggaatggcttattttcttggtcacaaaggtcttaactgtgatttctgaagctgtgtgattcctcgtttcctcggaaactaaatgtcatgaagagtgtagctgtgaaaaaccaggtgacatgaatatcttctgtatgtgatttatcatgtaaagaagactagtttgtatgatatcttcctgtaattaagaagtcctgtttgagcaaaaagttgcccagaattgatgactctttctttatctcattgaagtgcagcaggtaaatgatttttggctaaagtattagtgaatgaaataaattcatgaggaccaaaaaacaaaaa

SEQ ID NO: 5416 - DNA, 1966 bp, Ricinus communis
tgttcaattacctcagaatgagttaaatttatttgtcgtctcctcaaaataaaattgccccccttgtatcttcattataggtagtgctcaatgcttgacccacccagctaaccagctctagaaacccaggccagcataaagataacgaattactggcttagagatttgggcccatattctctctcactcgcagaaactattctcgtgtgctgattcctctaccagactgattttgacttcatttcttccattttttgttcattatccgcttaatttcttaaccgagaaatctgaacgtctgatgattcacccttacaaaacccaaaaaagaactacttgctgataattttcaatgctatcacttgccactacctatctaatcaactctaataagctaaatatataattaatatgcaatcatctacaattcccatatactcagcttcactttatccactaaaattccattcattacccccagaattcaatctttttccctcaaaaagttcagttcctcttggaagctgttgctattccaggcctaaaatggcttctctaggtgggtttagtgtaaaatctcaaatgagtacttctgcaagtgttgatgataatgggttttgtacgttgatagattatatgggtaaaggaggaattgacgtgggtgatgatttagtagtgttgtttagccatatacaatatgcttccaaaaagattgcagctcttgtagcatctcctttcaattctgctcttggtaagcaaagtagcatagctagtggtgctagtgggtcagacagggacgcaccgaagccacttgatattgtctcgaatgaaatcatcttggcttctcttagaaattctggaaaagtggctgtcatggcctcagaagaagatgatgctccaatatggataaatgatgatggtccttttgtggtggtaacagatccccttgatggttctcgtaatattgatgcatctattcctacaggaacaatttttggggtatataaacgccttgtggaactggatcatctacctcaggacgagaaggctatgctaaattctctgcagagtggagctaggcttgtagctgctggttatgtgctatattcatcggccacaatactctgctccacctttggttctggaacacatgcatttacactggatcgttcaacaggagattttattctcacccacccaggaattaagattccttctcgaggtcaaatctattctgtaaatgatgcacgatattttgactggccggaaggattaaggcaatatatcgacactgttagacaaggaaaaggcagataccctaaaaagtactctgcccgctatatatgttcacttgtagctgattttcatcgaacattgatgtatggtggagtcgcgatgaacccaagggaccaccttcgcctggtatatgaggcaaatcctcttagttttcttgcagagcaagctgggggcagaggttctgatgggaagcataggattctctcaatgcaacctgttaagttacatcagagacttcctctatttctaggtagtccagaggatatagaagagctagagagttatggagacgttcaacagaaagtaaatcctggttatgaagtttgatgctatcagtgatcccaaattacagaggaattatgattggacgtataacactcaccttccatatttcattggcagtcaagtgcggaatgaagagttctgtcatgaaaggctggaagatgatgtgggatgtcttgctcctttgtgcctttactcataatatcatgtaaaaaaaatgattcttccgaatgtgacatgagtacctccccgatctagcgattcaatccctgtaaacatgttctccttgttgataatatcatttccaaaatatcagttacagtaccagcaaaatcatgttttcattgctatattctaatgtctctagtgatatggcaaatatagacca

SEQ ID NO: 5417 - DNA, 939 bp, Castanea mollissima
ctggagctaggcttgttgcctccggctatgttctctattcatcagctacaatactctgcaccagctttggttcggggacacatgcatttacattggatcattcaacaggagatttcattctcacacatccaagcattaaaattcctccacgaggacaaatctattcagtaaatgatgcacgatatttcgactggcctgaagggttgaggcggtatattgacactgtgagacaaggaaaggtagataccccaagaagtactcggcccgttatatttgttctctggtagctgatctccatcggactctaatgtatgaggggtggcaatgaatccaagggaccatcttcgtctggtttatgaggcaaaccctctaagttttcttgtagagcaagctgggggtagaggatctgatggtaagattaggattctttcaattcaaccagttaagctgcatcaaagacttcctctgtttcttggaagtttggaggacatggaggagttggagagttacagggatgttcaacagaaagtaaatcctggttatgaagtttaatgctatagtaatccccaaattccgttggttatggtgtaaatcaatctggggttcctttgtgtgactaaagctctccatctatcaagaattcaaacttctcattacaagtatgtataatctagccaatccaaccatcaagatttgtaaaattcttaactgttgtttgtttctgctattcatcatacctgtcttctcaggaaattaaagtaacttgaagagtttagatatgaaaaactagaagcctagaagagatctttcttcctctttccatggtaaaaaaatgtgttgtttaaattttcaagttcactatagcatgtaaagattgtatactctttatgatctgtgtaatttgttttctgtaataaaagtattctattttgacatagt

SEQ ID NO: 5418 - DNA, 487 bp, Humulus lupulus
tagcattaaaattcctcctcgaggccaaatatattctgtaacgacgctcggtactttgactggcctgaaggattaagaaaatacatagacactgtaaggcaagggaaaggcaagtaccctaagaagtactcgctcgttacatctgttctttagtggctgatctccatagaacactcttatatggtggaattgccatgaatccaagagaccatcttcgattagtatacgaagcaaaccctcttagcttccttgtggagcaagcaggaggccgaggatccgatggtaagcaccggattctctcgattcagccagtgaagctacaccagaggctgcctctctttctggggagcccagaggacatagaagagttggagagttatggagatgtgcagcagaaagtgaatcctggatatgaagtttgaactcaggacattagagttgaccataaatttatcaactagtaatacgtgcactcaaatatcacact

SEQ ID NO: 5419 - DNA, 1973 bp, Quercus alba
atggggatccttttcctttggtttccaatccaagtacaaaactctgcagagtagcagacccgatcagtcagcaccgagcactgcatctcaaatgacacagctcctaaaattccaaccttggaaccactctctgccataatatgcaaacacccacaatacctctcaacccatcttcaaccttccctccaaaatcccaccatacccagttgaagttgcttccaaaacttcatctccttcctcaaagcttattctatagaccaccaaaaatggcttctcttggtgggtttggttttggtgtgaggtcacaagtagtgggtggtggtgcttcttcttcttcttcaagtggggttgatactaatgggttgtgtactttgacagagtatgtgggtaaggaaggattgaatgtgggagatgatatggtggtcttgcttcatcatattcagtatgcttgcaagagaattgcagctttggtggcctctcctttcaattccagccttgggaaacagaacactcttgctggcactggtattgggtctggcagggatgctccaaaaccacttgatattgtctcaaatgaaatcatcttgtcgtctcttcgcagttctggaaaagttgcagtcatggcttcagaagaagatgatgctccgatctggttaactgatgatggaccatttgtagtggtaacggatccccttgatggttctcgaaatattgatgcatcaattccaactggaacaatttttggaatttataatcgccttgtggaagtagatcatctacccaaggaggagaaggctttgctgaattcactccaagctggagctaggcttgtagctgctggctatgttctctattcatcagctacaattctctgcaccagctttggttcggggacacatgcatttacactggatcattcaacaggagatttcattctcacacatccaagcattaaaattcctcctcgaggacaaatctattcagtaaatgatgcacgatatttcgactggccggaagggttaaggcgatacattgacactgtgagacaaggaaaaggcagataccccaagaagtactcggcccgttatatttgttctctggtagctgatctccatcggactctaatgtatggaggggtggcaatgaatccaagggaccatcttcgtctggtttatgaggcaaaccctctaagttttcttgtagagcaagctgggggcagaggatctgatggtaaaagtaggattctttcaattcaaccagttaagctgcatcaaagacttccactgtttcttggaagtttggaggacatggaagagttggagagttacggggatgtacaacagagagtaaatcctggttatgaagtttgatgctacagtaatcccaaaatttcattggttattgtgtaaatcaacctgggtttgctttgtgtcactaaaactctctgtctatcaagaattcagacctctcatcacaagtatgtataatctagccactccaactatcaagaattgtaaaattcttaactgttgtttgtttctgctattcatcatacccatcttctcaggaaattaaagtaacttgaagagtttagatgtgaaaaactagaagcctagaagaggtctttcttcctctttccatggtcaaaaaatgtattgtgtaaatttttaagttcactcatgtaaagattgtatactctttatgatctgtgtaatttgttttctgtaataaaaatattctattttgacatgtatttgcaaagttctgtccagtatcaaacaagagcttgtacaaatgatattgaaattcttaaaacttaagagattattgccatctctagagattatgatgagcaacatggtgtaataatctttggttggctaagtcaacttataattcataacactatcatatagtagtaaggattaagatgtcatgagggatacatgcattagaagtgaacaatggcccat

SEQ ID NO: 5420 - DNA, 1737 bp, Populus trichocarpa
tttatctgtttatttttgtcgtgttccactcctgctgcaaactatctaagccaagaacctctgatccttccccagaagaaaaccccaaaagcaaaaacttctaatcatctccaatgaaaccattgaccacaaatctccctttcaagtcacccgtaacttttccactctaaatatgcaatcatctaccatacccacattcccaacttcaccttttcctccaaaaaccctccttttctcttcaaaaacccagtcttttccatcaaaaagctcacttcttgcccaaagttgtcatcttttcaggccaaaaatggcttctctaagtgggtttattgtaagatcacaaacgggtacttcttcaagtggtgaaaaggggttttctactttgaatgaatatatggggaagggagggattgatgtgagagatgagttagtggtgttgtatgatcatatacaatatgcctgtaagagaattgcagctcttgtggcttctcctttcaactctagtctcagtaaacagagtaattttgctggaggtgacagtggttcaggcagagacgcaccaaaacctcttgatattgtctcaaatgaaatcatcttatcttcccttaaaaattctggaaaagttgctgttatggcttcagaagaagatgatgctccagtttggattaatgatgatggtccatttgtggtggtaacagatcctcttgatgggtctcgaaatatcgatgcctccattcctacaggaacaatttttgggatatacaggcgccttgttgaactggatcatctaccccaggaggaaaaagctacgctgaattcattgcaaagtggagccaagcttgtagctgctgggtatgttctctattcatcagccactatactgtgcaccagctttggttctggaacgcatgcatttacactggatcattccacaggagacttcattcagactcatatagacattaagattcctcctcgagggcaaatttattctgtaaatgatgcgcgatactttgactggcctgaaggattaaggcaatatattgacactgttagacaggggaaaggcagataccccaagaagtactctgctcgttatatatgttctctcgtagctgatttccatcgaacgctgttgtatggtggtgtcgcaatgaatccaaggaaccatcttcgtctagtttatgaggcaaatcctcttagttttcttgttgagcaagctgggggcagaggttctgatggtaaaagcaggattctctctatgcaaccagtcaaattgcatcaaagactgcctttatttttaggaagtttagaagacatggaagagttagagagttatggagatgttcaacagaaagtaaaccctggatatgaagtttgattctatgctgatcctttaacagttgtgataagaattgacttcagttgttctgctgctagtttcctattcattaacaatctgcaattttcaagtccctgtagaccgttccaaattcagagtgctgacagttgcatgacgctcatctttcctacccaattgacaaacatagcttggagagttttggcatgaaaaattggaaggccatgtgggatttaatgttgttccttcttgatgttcttccctttccctgtttgaagggtcagctttttttattacaaatgtataccttcttcttgtaccattacatcaaataatcacccgttgcaaattattgtataaaaaatcgtgtcttgtat

SEQ ID NO: 5421 - DNA, 708 bp, Rhizophora mangle
cctgagcaggagaaggctttgctgaattcattgcaatgtggaaccagacttctagctgctggctatgtcctctattcatcagccacgatactgtgcaccagctttggtaccggaactcatgcatttacgctagatcgctccacaggagactttattctaacccatccggacatgaagattccttctcgaggacaaatctactctgtaaatgatgcccgatattttgactggcctgaagggttaaggcaatatattgacactgttagacaagggaagggcagttatcctaagaagtactctgctcggtacatatgttctcttgtagccgattttcaccggactttaatgtatggtggagtggcaatgaaccctagagaccatctccgtctggtctatgaggcaaatccccttagtttccttgtagaacaggctggaggcagaggttctgatggtaaaagtaggattctctcaatccagccagtgaagctgcatcagagacttcctttatttctaggaagtctgaaggatatggaagagttagagagttacggagatgttcagcagaaggtaaaccctggctatgaagtttgatgctgcattggaccccccatatcctagcaatggaatgcgtgagcaaggaagaagcttgtctgcaggtttgatcctttaaagccgttgagtgtaagactctcccctctcctatcttca

SEQ ID NO: 5422 - DNA, 1513 bp, Solanum lycopersicum
agaaaagaattgcggataaatgaggaattttttttaaaaaataggatgcttcttctgtaccaaagttgcctgcggtagagcataaagatgctatcatcgaccatttcttccctaaattttccaccaagaaccaaactctcctcaccaaaccctgcaatttttcctcaaaactacaattttgtacctttttgtactgaaaatatggcttcttctccattttctggagggttaattaactccagggttgattcaccaattgcaattggctgtaaaaatgcttcagtagattctgctaatagtgggttttcaacactgatggagtatatgggtaaaggaggggttgatgtgggtgatgacttggtgttattgtttggtcacttagaatatgcctccaagaaaattgctgctcttgttgcttgccctttcaattccagcctcaacaacaatgttgccattggaaatacggggacttcttctgatagagataagcccaagcctcttgatattgtttcgaatgagattatattgtcgtctcttagaaattcgggaaaagttgctgtaatggcctcagaagaagatgagtgtcctgtgtggataactgatgatggcccgtttgtggttgtcatggatcctttagatggttcccgaaatatagatgcctcaatacccactgggacgatatttgggatttacagacgtcttgtggaaattgatcatttgccggtggaggaaaaggctttactaaactgccttcagagtggatcaaagcttgttgcagcagcttatgttctctattcgtcagccacaatactctgtgctagctttggttctggaacacatgcattcacattggatcatacaaccggagatttcctcttgacacatcctaacatcaacattcctcctcgagggcaaatttattcagttaatgatgctcggtattttgactggcctgaaggattaaggcagtatattgatacgataagacaagggaaaggacaacatcctaagaagtactcagccaggtatatatgttctctagtggctgattttcatcggactctgttatatggtggcgtagcaatgaatccaagaaaccaccttcgacttgtttatgaagcaaatcctctgagtttcttagcggaaaaggctggaggtagaggttcagatggtaaaaatagaattttatctattcaacctgtcaagctacaccaaagacttcctctatttttgggaagtttggaggatatagaagaattacagagttatggagatgttcagcagaaagtgaaccctggttatgatgtttaatgcccttgtccctctttcatgcagtttgctcatctctctttgacatgtaaatttttttgcttgttagctagtaaatatgctcttcactagaataaacatgtgattttctatacctactcttgaatattgtcatatgatgtatctttagagcaccttaattttactgtttaaattaaaaatttaacatattacttaattaatc

SEQ ID NO: 5423 - DNA, 1018 bp, Vaccinium corymbosum
cgaccaactactggttaactgagtgggtcggccctattttggttggttggtcgacggactcctcttgatggggtcccggaatatagatgcgtcgactccgcggatatttgtaattacaaccgacttgtaaggaataagatcatctacctgtggaggagaaggcattgcgtaattcgctccagagtggcaccaggcttatagctgctggctatgtactctattcatcagcaacaatactctgcaccagctttggttcaggaacacatgcattcacactggaccattcaacgggagacttcatcctcacgcatccaagcattaaaattcctcctcgaggacaaatctattctgtaaatgatgcgcgctattttgattggcccaatggtttaaggcgatatattgacaccgtgagacaaggcaaaggtaggtaccctaagaagtactcagcacgttacatatgttctcttgttgctgatttccatcggactctcatgtatggtggagtggcaatgaatccgagggaccatcttcgtcttgtctatgaagcaaaccctcttagttttctggtagaacatgctgggggtaggggttctgatggtaaaagtagaatcttatcccttcagccagtgaagctgcatcaaagactcccattgtttttggggagttcagaggatatggaagagttagagagttatggagatgttcaacagaaagtaaatcctggttatgaagtctaatttttggtgacattcggaggttatcgtattgccacttcacaagtatgcgataaatgagacacgcagatggatatgtgatgtaattgctctcttttttcttcaacttttatgagaatcaaactcagtatgacactttggcataaaatggcagattcaaagtggaatagttcctccgtttgtgagatatgtgtctcctgtattagaactgttacattacagcaaaattttgtatggtttgcgtatcctgctaaatttaaagggtctacagataaattatatac

SEQ ID NO: 5424 - DNA, 1313 bp, Gossypium hirsutum
acttcctgtcctaacccacaggttgagctttacccccaccaaaatggctcttttctgggttttggctaagtctcagatgggcatgactgctggtggtggtggtggtgatggtgcaaatgggttctcttcactgatggactatgttgggaaaggaggactagatgtaggagatgatttacttgttttgctttatcatatacagtttgcttgcaagagaattgctgctcttgtggcttctccctttaattctgctctcgggaaacattcagctctcactggtgccacatccggggccgctgcttctgatagggataagccaaagccgcttgatattgtggcaaatgaaatcatattgtcatctcttagaaattcaggaaaagtttcagtgatggcttcagaagaagatgatgctccaatttggatcaatgatgatggtccctttgtggttgtattggatccccttgatggttctcgaaatatagatgcttctattcccactggaacaatctttggggtatataaccggctcacagagctagataatcaaccgacggaagagaaggcattgctgaattcgctacagagcggaagaaagcttgtagctgctggctatgtcctctattcatctgccacaatcctatgtgctagctttggctcaggaacacatgcatttaccttagatcattcaacgggagactttattctcacacatccaagcattagaattccgcctcgaggtcaaatatattctgtcaatgatgcaaggtatttcgattggcctgaaggtctaaggcaatacattgatacagtaagacaaggcaaaggcaaattccctaagaaatattcagctcggtatatatgttcgttggttgctgatttccataggaccgtgttgtacggtggaatagcaatgaatccaagggaccatctgcggctggtttacgaggcaaaccctctaagttatcttgcagagcaagctggaggcaaaggttcggatggtaaaagtaggatactttcgatccaaccggtgaaactgcatcaaagattgcctctgtttttgggtagtttggaagatatagatgagttggaaagttatggagatgttcaacagaaagtaaaccctgggtatgaagtttaatcactttcgttgttttaaacagattcattgctctgtttctctaaagttcactcttgtttcgcgttgttaatacttttagcctgaagatcacatcacaaaataaaatcttcaaatgatgtaagttctctaaaactatctccaaaggctgcttaatctccagccttttcactcatct

SEQ ID NO: 5425 - DNA, 3183 bp, Gossypium raimondii
aaaaaataaaagtgactgttttgatagtttacccttatttaaatgatattgggatatttttagaaaaaaaatggaatagtaccttaaaaaagaaaacagctacagaaccgagccttcataacagacgtttttccgtatcactacactgtttcctaatcacgttctcacactgctacgctatatccacccaaaaccaagccaaatcccaccttaaattcctttgaaacgttcaatcctcaatcttcaggttctgatatgatcccatgattccatttcccattaccagttcttttcacctctttactcttccaacacattaaagcaacctcttatactaatatgcgacaattattgtctcccaccatctcctacccatctccacttctccatctaacttcccatcctttccctccaaaaccccacttctgtcctacccacaggttgagcttttaccccccaccaaaaatggcttctttttctgggtttttggctaagtctcagatgggcatgactgctgctgctgctgctggtgatggtgcaaatgggttctcttcactgatggactatgttgggaaaggaggactagatgtaggagatgatttacttgttttgctttatcatatacagtttgcttgcaagagaattgctgctcttgtggcttctcccttcaattctgctctcgggaaacattcagctctcactggtgccacatccggggccgctgcttctgatagggataagccaaagccgcttgatattgtggcaaatgaaatcatattgtcatctcttagaaattcaggaaaagtttcagtgatggcttcagaagaagatgatgctccaatttggatcaatgatgatggtccctttgtggttgtattggatccccttgatggttctcgaaatatagatgcttctattcccactggaacaatctttggggtatataaccggctcacagagctagataatcaaccgacggaagagaaggcattgctgaattcgctacagagcggaagaaagcttgtagctgctggctatgtcctctattcatctgccacaatcctatgtgctagctttggctcaggaacacatgcatttaccttagatcattcaacgggagactttattctcacacatccaagcattagaattccgcctcgaggtcaaatatattctgtcaatgatgcaaggtatttcgattggcctgaaggtctaaggcaatacattgatacagtaagacaaggcaaaggcaaattccctaagaaatattcagctcggtatatatgttcgttggttgctgatttccataggaccgtgttgtacggtggaatagcaatgaatccaagggaccatctgcggctggtttacgaggcaaaccctctaagttatcttgcagagcaagctggaggcaaaggttcggatggtaaaagtaggatactttcgatccaaccggtgaaactgcatcaaagattgcctctgtttttgggtagtttggaagatatagatgagttggaaagttatggagatgttcaacagaaagtaaaccctgggtatgaagtttaatcactttcgttgttttaaacagattcattgctctgtttctctaaagttcactcttgtttcacgttgttaatacttttagcctgaagatcacatcacaaaataaaatcttcaaatgatgtaagttctctaaaactatctccaaaggctgcttaatctccagccttttcactcatcttgtctcctataggaatcatggttcagtgacagcaaaatgtgctgttattacaatgtcaacagtcatggttaattgtgaaaggcaataggctctatgatttgagacaaatttgacaagcttttaacccacaacgtccacaacctgatgtcctgcactatcgcacgtaaaccgaatctcgataacataaatgccaaaggttgcatgtcctcatctagatacggatcgggtttgttgttttgatgcgtattaccatgaattgccattctatgacctactcctcaattaatgtcgaatatagggtattgaatgttgccagaaatcaatggaggggcaaattgatacagattatccgaaggtaaattaaactgaagatcgtccctctagagatgctgatgatatatccgtgtaaagcttgcaaaatctcgacactagtgggaaaatattcacaggcagtttgggtgaacttggaactttagctaccacatttccctgctcagcatgatccaactccacgtacaactctgctgccatatttttagatttgcaattaactggtaatttgtctggacatctttcatcatcaataagcttaagccggttatacatgacggatttgatgatactgaaaatctataaaagattgtggataatatctttccgtactgagctgcgattttagtgctaatttttaatttcaactcatcaagtttgaaatatttttcaaacttcatactaatttgacgtcagattcgaacacaatgacattttcagtgtaacaaatttattagttcggtaattataaaaaatgaaatcaatattaaatttaactgaacttaaatagtagaagtttagacagaggaaaagtggaaaactgaccgcaagacctagggaatggggcggcagcaattgctattgctagggccaccaagaaagtcaggtttcgagatgaagagagctcttctatcgccgatgggctagcgtcgacagcgggggactaatgctccgttggggagtagtggatgaatgagactaccaaatgagagggtaattgaagatgaagatatcgcactcaaggatagggatgtggttactgagactatgaatgggtgtcgtcgatcaaattctcgtcgcgggttcatcagttaatagaggagagtatgagtaggtcgattattattaaactactaggtcgacgaattggttatagtgcatttcacaataaattttatgccctatggaagccatctcgacactttaggttgatggatttcgataatgaatacttcttggtgcgatttcaagcgaatgaggattagctggctagagggccgtgggttatctttaggaaatatttaatggtgcaaccatggcggatggggtttgatccgtagctcttttgacagaggtgatggcttggattctgttttcagggctattaggtaatt

SEQ ID NO: 5426 - DNA, 1442 bp, Lactuca sativa
aataaaccaatttcccaacttgaatatcatcaaaataaatcaattccgaagatgttcccttttcaattccacccatcaccccaaaacgccacagccatagaatgcaatcacccaccaccacaatcacagccgcaatacaaaatctcaatctcacccccaatttcctaccaaaattcccgccaaacccacttcgcatcctcccggaattcgtcaaccaccgtagcactgcaagtatggcttccactttcggtaggtttaaggttaattcaaaattggataacagttccggtgagtttcttactattaccgagtacgccggcaagggaggcgcgaacgtaggtgacgatctggtggtgttgtttagtcacttggagtatgcgttcaagagaattgcagctctcgttgcttctccggtcaattccagcctcggaaaaagctccggcggtagccaagatgtggacgccggtagagataaacctaagccgctcgacattgtttctaatgaaatcatattgtcttctttgaaaaactccggaaaagttgcagttatggcttccgaagaagacgatgctcccgtttggataaccgataacgccccatttgtggtggtaacagatcccctcgatggttctcgtaacatcgacgcttcaatccccaccggaaccattttcgggatctacaatcgcttaacagaactcgataatcttccaacggaggagaaggcgttgctgaattcattacagagcggcaatcgcctcgtcgccgccggctatgttctttactcctccgccaccatactctgcaccaccttcggttccggcgcacacgcctttactctcgatcattccactggagacttcgttctcacacacccagacattaaaatccctcctcgaggtcagatctattcagtaaacgatgcacgatactttgattggccggagggtttgaggcgatacattgatacaatcagacaagggaaagggaagtttccgaagaagtattctgcgcgttatatttgttcgttggttgctgattttcacagaactttgatgtatggtggagtggcgatgaaccctagagaccatcttcggcttgtttatgaggcgaatccgctgagttttgtggcggagcaagccggcgggaaagggtcagacgggaagaacaggattctgtcgattcaaccggtgaagctgcatcagagacttccgttgttcttgggaagtccggaggatattgatgagttggagagctatggtgatgttcaacaaactgtaaaccctggttatgatgtttgaatgtatgatcgatacctttcgttttgtgtaatagtatcaatgtcgtctgtaaattactaatatgattgttgtaacattatatatagaagatgaattttaatagaattgaaagtcgaatggttcatgttaaactagtttaaacgg

SEQ ID NO: 5427 - DNA, 1900 bp, Papaver somniferum
aagaaataggcttactttaaaaaggtttcacgggtaaaatcccaactcaatagtggcggttcttcagattcaagtggtggagaagataattttaagactttgattgattttattggtaaagatggagaaaatgttggagatgatatggtaattttgatttctcatttacagtatgcttgcaagagaattgctgcagttgttcatcccattcaattcggtacttggaaaaaagggttttgatggttcttcaatgggagatagagatgctccaaagccactggatattgtctcgaatgaaatcattttgtcctccctccggagttctggcaaagctgcagtcatggcttcagaagaagatgatgttccagtttggataactgatgatggcccatttgtggtagtcactgatccattggatggctctcgaaatattgatgcttccattcccacaggtacgatatttgggatttataaccgtcttgaagaactagaccatctacccatagaagagaaagctcaactcaactctctccagagtggtgctagactcattgcagctggctatgttctgtattcatcagccactatattatgtgtcagctttggttcgggaacacatgcattcacgctagatcatacaactggtgactttgttcttactcatccaagaataaaaattccacctcgagggcaaatatactctgttaatgatgcacgatactttgactggcctgacggattaaggaaatatatcgacactgttagacaaggcaaaggcaaatttcccaaaaagtattcggctcgttatatctgctcactagttgctgattttcatcgaactttaatgtacggaggggtaactatgaatccaagggatcatcttcgtctagtttacgaggcaaaccctcttagttttcttgtggagcaagctgggggtagagggtcggatggtaaagttaaaattctttcaatccaaccagttaaactgcatcaaaggctaccattgttcttaggaagttcggaagacatggaagaattagagagctatggagatgttcagcagaagatcaaccctggctatgaagtctaaggatctaagaatccctaaccgattcacaagatcctcaaaacagataaagtatttattcgtgttatgttgttaatttttcttttttttatctgcggattcacggccttctacagtatttgtatatattcatgacagaataatttcatttaccacatgacttgataatgttacatgactcgctgaataacaatctctaagtacatacgagaccaaaaccaaaatatactgaatgaaaacaaacacaaccttaattaggcaaatcaatcttaataatatattaattataggaagcaatttagtgctattaactgaggacaatcttttcaccttcttagatgataccccatttatgttcgagttcttctctaagctgcgcgagttgattttcctgaagggttacagtaacagtccttcctttgccactgccttctttaacaggttccggtcctggaagcactaagaccactccctcactgccgactccatggatgctacagttggcgaaagttggtttgtgtccattcagctctaactcataaaggccaacgtcttctaaattagcaaatgtcagatttgcaccatagactagaaagtcagacatcccttgatccttttccactgttttttcaaccagggttttttcttccactgatttcttgatgatcaattcagccagttccgatacttcggcttcaattatggagaaatctgcatcaactatacttaatatttgattattgttcaaaacattttcatccctgttatgaaaatcgtctctgcagatggtgatcacattggttctctatattc

SEQ ID NO: 5428 - DNA, 1641 bp, Sesamum indicum
ttttttattagttaatttatattgacttcattacaggaaaaaagattaatttaacaaataaataaagcccgaccatctaaaatcttcactacgctcgaatccggtactctgaattcctgggtggaacatcccaaaataaaaaattcctggatagaaatttccaatcaagaaaaactctaaccccatctcaatctcatcaaatgaccacctttactctgacccccttcattcccactagccagagatgcattcagccgccatactcttgagttccatctcgaattaccctccagggattcacctttttcattcagagcttcagaattttcacccaagacttaatctttacactcagcccatcaaaagaatggctttttcaggtgggctaggcttcaaaatcagtgctggaggaactaccgctgcctctggtgatggtggtggtagtgggtttcagacactgagggagtatatgggaagaagggaagaacacgttggcgatgaattggtggtgctgtttagtcacttggagtatgcttgcaaaagggttgctgctcttgtggcttcacctttcaactccagtcttggtaaagacttcaatgttgctgctgccggcagtgctgagagggataagcctaagccacttgatatcgtcgcaaatgagattatattgtcttctttgaagaattctcgaaaagttgcagtgatggcttcagaagaagatgatgctccagtttggcttgctgatgatggcccttttgtggtcgttttagatcctctggatggttcccggaatattgatgcttctattcctactggaacaatatttgggatctatagacgccttgtagaactggatcatctgccgacagaggagaaggcaatgcttaattctctccagagtggaactaagcttattgcttctggctatgttctttattcatcagctacaatcttgtgtaccagctttgggtcaggaacacatgcattcaccctggatcactccacgggagacttcattctaacacatccaaacattaaaattcctcctcgagggcaaatatattctgtcaatgatgctcggtattttgactggcctgaaggcttaaggaaatatatcgatactgttagacaaggcaagggcaaacatcctaaaaagtattcagccagatatatatgttctcttgttgctgatttccatcgaacgctcttgtacggtggcatagctatgaatccaagggatcatcttcgtcttgtatatgaagctaatccactcagtttcctagcagagcaagcgggaggcaaaggttctgacggtaaagctagaatactgtccctccagcctgtcaagctgcaccaaagacttcctctgtttttgggaagtccagatgatatagaagagttagagagttacggagatgttcagcagaaagtaaaccctggatatgatgtctgaaaatgcatttaggtgttgccatttgagaatttctttgatttgttgctgaaatctctggcgtagttgctgttcacgcccagtttgctctgagctctggtgatatggaatggttgtagattgtaatataagtgtaaatgtgaaaattgagatccagttttgtctctatttcaactgatgatgtattgata

SEQ ID NO: 5429 - DNA, 1302 bp, Amsonia hubrichtii
ttcctccatatactcgaacccaagcttgaatttcccgccaagactccaccttttcacgccatatatcagtcttgctccaggaagaagcaaaatgacctctgattcatcttttcttggtgggctcaacttgagggtcagtgccaagatgggtagcgatgcttctggtggttcttttgatggtaataatggtgcgttttctacgctgatggactatgttggcaaaggagggcttaatgtgggtgatgacttggtggttttgtttgttcatttggagtatgcttttaagagaattgcggcgcttgtggcttcccctttcaactctagccttgcgaagaatgtcggtgtagctgctgctggctccgtttctgagagagataagccaaagcctcttgatatcgtctcgaatgagattattttatcatctttacgaagttctggcaaagttgctgttatggcctcagaagaagatgatttgccagtttggataactgatgatggcccatttgtcgtggtcactgatcctctagatggatcccgaaatattgatgcctccattcccacaggaacaatcttcggtatctataaacgtcttattgaacttgatcatctgccagttgaggaaaaagcaatgctcaactccctccagagtggaaccaggcttgttgctgctggttatgttctgtattcatcagccacaatactatgcacaagctttggtacaggaacgcatgcattcacactggatcgttccacagggggatttcatcctcacgcatccaaatattaaaattcccccacgagggcaaatctattctgtaaatgatgcacggtatttcgactggcctgaaggtttaaggcaatatatcgataccgtgagacaaggcaagggcaaatatcctaagaagtattcagctcgctatatatgttctcttgttgctgatttccaccgtactcttctatatggtggtgtggcgatgaatccaagggatcatctacgtcttgtttatgagccaatcctctaagtttcctagctgagcaagctggaggtaaaggctctgatggtaaaatcaggattttatcaattcagccagttaagctacaccaaagacttcctttgtttttggggagtccagaggatatagatgaattagagagttatggcaatgttcaacagaaagtaaatcccggttatgaagtctaataatatgtcaatctttcctctctctagagtagatgttaggtatgctctgaaacatctcagttctaaaggattaagccaaaaggtttcctagtagcaataga

SEQ ID NO: 5430 - DNA, 1375 bp, Aquilegia formosa
gaacttccatcttctctctctctctctcaagaattccagagaccctaaaatcaacagactcaatgatcatcaaattcttatctaccctaattccccaataaacaatgcaatcatccgctttattcatcaatccaactttaaatttcccgcaaaaaatctcctatttcccgccaactaaccctcacttgcttcaaaatcttccctttcgtcctcgactagcttcgtcatcatcttcaattagtacaaaatttcaatccaaaatgttttcttcaaatagtggtgatgggtttcagactttattggattacattggaaaagaaggagaagatgtaggagatgatttggtggtgttgatagctcatttgcaatatgcttgcaagagaattgctgccgttgtagcgtcgccgtttaattcagtgttggggaagcagaataagactggtggtggtgattcatcagttggaggagctgaaagagatgatcctaagccattagacattgtttcgaatgaaattattttgtcatctctgcgcaattctggtaaagttgcagtgatggcttcagaagaagatgatgttcccgtttggattactgacaatggaccatttgtggttgtaactgatcctcttgatggttctcgaaatattgatgcatccattcccactggaacaatattcggtatttacaaccgccttgtggaattagaccatcttccaataaaagaaaaagcacaactaaattcgcttcagagtggaaccagactcattgctgctggctatgtactttattcatctgccacgatattctgtgttagctttggttcaggaacacatgctttcaccctggatcatacaacaggagactttgttcttacacatccaagcataaaagttccttctcgagggcaaatctactcagtcaatgacgcaaggtatttcgattggcctgaaggtttaagacgatatatcgacactgttcggcagggcaaaggcaagtaccccaaaaaatattcagctcgttatatttgttcactggttgctgattttcataggactttgatgtatggtggtgtggcaatgaatccaagagaccatctacgcctagtatatgaggcaaaccctcttagttttcttgtggagcaagctgggggtaaagggtctgatggtaaaagtcggattctttcgcttcaaccggtgaagctgcatcaaaggcttcctctattcttaggaagtctggaggatatggaggagttagaaagctacggtgatgttcagcagaaggtaaatcctgggtatgaagtttaatggtcgactgattgctaactgaggtcagtcaaaagggaactatacccaacttgtatgttgtattgttgact

SEQ ID NO: 5431 - DNA, 1695 bp, Manihot esculenta
ggcttacacagtttaatgggtagagcttcgggcccatgttgtcgaccttccttctcttcctccaaattttttgttcattatctgctcaatttctgttcttatccgctgaaatgatcggagtgttcccaagaaagaaatttgatccatctccctgctcctccaaagaatatatctgtaggaagctcaaaaacttctgattattttcaatgttttcaacgtttcctttctaatcaatctccaacaagctataacgtctataatatgcaatcatctgttctacccatatacccaacttctcttgtcccaccaaaatctcactcttttcacgcaaaagtccaccttttcctgccaaactatccagttttcgcggggagctgttgtaattgcaggccaagaatggcttctcttggtgggtttaccgtaaaatcgaaaatgggtgcttctgcaagtggcgataatgggttttgtacgttggtggaatatatgggtaagggaggaattgacgtgggggatgatctggtggttttgtttagtcatttacaatatgcttctaagagaattgcagctctagtagcgtctcctttcaattccagtctcagtaaacaaggtaatgttgctggtgatggcagtagctcagatagggatgcaccaaagccactcgatatagtctcgaatgaaataatcttggcatctcttcggaattctggaaaagttgctgtcatggcttcagaagaagatgatgctccaatttggataaatgataatggtccatttgtggtggtgacagatccccttgatggttctcgaaatattgatgcatccattcctacaggaacaatttttggggtatataaacgccttgttgaactagatcatctacctcaggaggagaaggctatgctgaattcactgcagagtggaactaggcttgtggctgctggttatgtgctctattcatcagctactatattctgtgccagctttggttcaggaacacatgcatttacactggatcattcaacaggagacttcattctcactcacccaggcattaagattcctcctcgagggcaaatctattctgtaaatgatgcgcgatattttgactggccggaaggattaaggcaatatattgacactgttcgacaaggaaaaggaaaataccctaagaagtattccgcccgttatatatgttctcttgtagctgattttcaccggacattgatgtatggtggagttgcaatgaacccaagggaccatctccgtctggtttacgaggcgaatcctcttagttttcttgtggagcaggccggaggaagagggtctgatggtaaagttagaattctttcactccaaccggtgaagctgcatcagagactttccttatttctgggaagcctggaggacatggaagagctagagagttatggagatgttcaacagaaagtaaatcctggatatgaagtctgatgatgatcttctgcttggatcctataagtttcaagtgtagtcgtaatttagtcatttctaacactatgcacatgatactcaccaaccattcttggctctcaataatagctcggagagttttcagctgataatagcttggagagtttttgcgaaaaactggaagctcatgagccgtcttatctttgtaatgtctttgtccattttgttatattgagtgattcttca

SEQ ID NO: 5432 - DNA, 1611 bp, Catharanthus roseus
cttctgcattcttgaagcacagcttgaatttcccgccaagactccatcttttcccgccaaatacctgtcttggtcaacgcaagagtaaaatggcctctcttcctccatcttttcttggtgggctcaacttgagggttagtgccaagatgagtggcgatgcttcttctgattgtaataataatagtgggttttctacgctgaaggagtatgttggcaaaacagggcttaatgtgagtgacgacttgttgattttgtttgatcatttggagtacgctttcaagagaattgctgctcttgtggcttcccctttcaactctacccttgggaagaatgtctcagttgccgttggctccgattctgagagagataagccaaagcctcttgatattgtctcgaatgagattattttgtcttgtttaagaagttctggtaaagttgctgttatggcctcagaagaagatgatttaccagtttggataactgatgatggcccatttgctgtggtgacagatcctctagatggatccagaaatattggtgcttctattcccacaggaacaatttttggtatctataaacgtcttgtggaaattgatcatctgccagttgacgaaaaagcaatgctgaattcacttcagagtggaaccagacttgtcgctgctggttatgttttatattcatcagccacaatactatgcacgagctttggtacaggaacacatgcattcacactggaccgctcaacaggggatttcattctcacacatcccaatatcaaaattcctccaagagggcaaatttattctgttaatgatgcacggtactttgactggcctgaaggtttaaggcaatatattgacactgtgagacaaggcaagggtaaatatcctaagaagtattcagctcgctatatatgctctcttgttgctgatttccaccgcactctcctatatggtggtgtggcaatgaatccaagggatcatctacgtcttgtttatgaagccaatccactaagtttcctggctgagcaagctggaggtaaaggttctgatggtaaaagcaagattttgtctattcagccggtcaagctacaccaaagacttcctttgtttttgggtagtccagaggatatagatgaattagagagttatggtgatgttcaacagaaagtaaatcctggctatgaagtctgataataggttattatttgctcttcctggagtaaatgttaggttggctctcaagcatcccagttatccaaaagcaaagtcaaaaaccttttctagcagcaggtcttatattatttttcaccattcatgctgcacccaagaagtggtggtttaccgcaattctgaaagaattatacttgcgttcgtatttcttgtttcgtttgtatcatatttttccaaaagtgtactcttggccgtaatggaagatgtgtacttctcctttactaatctgttttgtacagagaatttctgagcgtctcccttaatagctggcatgtttttcagttgcattggcaacccttagatgttaccatgtcattgttggcagcatacctccagtctttatctcacaaaccgactgtctcatttcgcctaaatctta

SEQ ID NO: 5433 - DNA, 1592 bp, Gossypium hirsutum
aagccaaatcccaccttaaattcctttgaaacattcaatcctcaatcttcaggttctgatatgatcccatgattccatttcccattaccagttcttttcacctctttactcttccaacacattaaaacaacctcttatactaatatgcaacaattattgtctcccaccatctcctacccatctccacttctccatctaacttcccatcctttccctccaaaaccccacttctgttctacccacaggttgagcttttacctcccaccaaaaatggcttctttttctgggtttttggctaagtctcagatgggcatgactgctggtggtggtggtggtgatggtgcaaatgggttctcttcactgatggactatgttgggaaaggaggactagatgtaggagatgatttacttgttttgctttatcatatacagtttgcttgcaagagaattgctgctcttgtggcttctccctttaattctgctctcgggaaacattcagctctcactggtgccacatccggggccgctgcttctgatagggataagccaaagccgcttgatattgtggcaaatgaaatcatattgtcatctcttagaaattcaggaaaagtttcagtgatggcttcagaagaagatgatgctccaatttggatcaatgatgatggtccctttgtggttgtattggatccccttgatggttctcgaaatatagatgcttctattcccactggaacaatctttggggtatataaccggctcacagagctagataatcaaccgacggaagagaaggcattgctgaattcgctacagagcggaagaaagcttgtagctgctggctatgtcctctattcatctgccacaatcctatgcgctagctttggctcaggaacacatgcatttaccttagatcattcaacgggagactttattctcacacatccaagcattagaattccgcctcgaggtcaaatatattctgtcaatgatgcaaggtatttcgattggcctgaaggtctaaggcaatacattgatacagtaagacaaggcaaaggcaaattccctaagaaatattcagctcggtatatatgttcgttggttgctgatttccataggaccgtgttgtacggtggaatagcaatgaatccaagggaccatctgcggctggtttacgaggcaaaccctctaagttatcttgcagagcaagctggaggcaaaggttcggatggtaaaagtaggatactttcgatccaaccggtgaaactgcatcaaagattgcctctgtttttgggtagtttggaagatatagatgagttggaaagttatggagatgttcaacagaaagtaaaccctgggtatgaagtttaatcactttcgttgttttaaacagattcattgctctgtttctctaaagttcactcttgtttcgcgttgttaatacttttagcctgaagatcacatcacaaaataaaatcttcaaatgatgtaagttctctaaaactatctccaaaggctgcttaatctccagccttttcactcatctataggaatcatggttcagtgacagcaaaatgtgctgttattacaatgtc

SEQ ID NO: 5434 - DNA, 1282 bp, Cucumis sativus
attcccatgaaattcccaacccatcgcccattatgatcccatcaacttccgccaaatcccaaaactcaaaacaatccacacaataatactatgcaatccactaccattcctcccttcaatccccccgtttcctttccctcaaatctccctcgttttgccccaacaatccgccatttcccccctccatccaagctccgtgtccccacagctatggcttccaccccttttggcctcgccgtccggtcgcgaacagaggccgctcctagcggcacaggcactgatggtctctgtactttgactgattttgtgggtaagggagggattggtttgggagatgatttagtgctgctgttgactcatattcagtatgcttgcaagagaattgccgctcttgtcgcttctcccttcagttccgatcttcaaaatccggcgggtttggctgttgggtcggagagggatgcacccaagccgctcgacattgtgtctaatgaaatcatcttatcatcccttagaaattctggaaaagttgccgtgatggcttcagaagaagatgatgaaccggtttggattagagatgatggcccatttgtggtggtaactgatcctcttgatggttctcgaaatatcgatgcatcaatacctactggcacaatttttggggtttataaacgtcttgttgaactcgataatttaccgagagaagagaaggccgtgcttaattctctacagagtgggactaaacttttggctgctggatatgttctctactcatcagctacaattctttgtgccagctttggctctgggacacatgcatttacactggaccattcaacaggagacttcattcttactcatcctcacatcaaaatccctcctcgagggcaaatatattcagtaaacgatgcaagatatttcgactggccagaaggattgcggcgatatattgacacaatcagacaggggaaaggcaaaaatccaaagaaatactctgctcgttacatatgttctctggttgctgatctccatcgaactttgttatacggcggagtggcaatgaatccaagagatcatcttcgtctagtatatgaggcaaaccctcttagccttctcgttgagcaagccggaggccgaggttcagatggtaaacatcgaattctttcattgcagccaggtaagctgcatcaaaggctgcctttgttcttagggagtatggaggacatggaggagcttgaaagctatggagatgtacagcagaaagtgaatcctggttatgaagttt

SEQ ID NO: 5435 - DNA, 1496 bp, Euphorbia peplus
aatttctacaaatgtttccttattgaatacttacaaataatctctacttactatgcaatcttgttccatagtgatatgcccacctccaaagtctccaactttcctccaaagcttccatcttttccctcctaaagcttcaatctttgtggggagtttgaggtctaaaatggcttctatgggtacttttgttgttaaatctcaaatgggtacttctggaagtggttatagtactttgggggaatacatgggtaaaggaggagttaatgtaggagatgatttggtgttgctttttactcatattcagtatgcttccaagaaaatagctgctcttgttgcttctccttacaattctactctttccaaacaaggtgttgttgctgctgatggcactgtctcggatagggatgcacccaagccgcttgatcttgtctcgaatgaaatcatcttggcttctcttaaaaattctgggaaagttgctgtcatggcttcggaagaagatgatgcgccaatttggataaatgatgatggtacttttgcggtggtaactgatccccttgatggttctcgaaatatcgatgcatccatacctacaggaacaatttttggcatttacagacgccttgaagaactggatcatctaccacagacggagaaggctatgttgaattcattgcagagtggagctaggcttgtagcagctggttatgtcctctattcatcagcaacaatactttgcgccacttttggttctggaacacatgcatttacactggatcattcaacaggagacttcatactcactcatcctggcattaagattcctcctcgagggcaaatctattctgtaaatgacgctcgatatttcgactggcctgaaggattaaggcaatatattgacactgttagacaaggaaaaggaaggtaccccaagaagtactctgctcgttatatatgttcacttgtagctgattttcatcggacattgatgtatggtggagtagcaatgaatccaagggaccatcttcggctggtatatgaagcaaatcctcttagttttctggtggagcaagcagggggcagaggttctgatggtaaaaatcggatactttcaatccaacctgtcaagctgcatcagagacttcctctatttctaggaagcttggaggacattgaagaacttgagagttatggaaatgtccaacagaaagtaaatcctggatatgaagtttgaagctattagtgattggttgagatgttgcactgtataccgatcgtctacgacgagctattttcaggtctgcatttattccaaccattccaaccaatgatagatgtaattagtaaaatattgcataagtattttggcatgaaagactacagatgacattgaatattgtattcgttttgcatgtattccttcttgtttgccttgtagactagtgttaatatgtacctacctttgtcattatagttttactaatcaaatccttgtaaat

SEQ ID NO: 5436 - DNA, 600 bp, Flaveria ramosissima
ctactaccatactctgcaccagcttcggctctagtacacacgcgttcactttggatcacttccaccggagactttgttctcacacatccaaacgtcaaaattcctcctcgaggtcaaatctattcagtcaatgatgctcggtattttgactggcctgagggtcttaggcggtacattgacactataagacagggcaagggcaagtttcctaaaaagtctctgcgcgttatatttgttcgctagttgctgatttccataggactttgatgtatgggggagtggcgatgaaccctagagatcatcttcgacttgtttacgaagcaaacccgcttagttttcttgctgagcaagcgggtggaaaagggtccgatggtaagagccgaattctgtctattcagcctgttaaattgcatcaaagacttccgttgttcctgggaagccccgatgatatcgatgagttggagagctatggtgatgttcaacaaacggtgaatcctggttatgatgtatgatgtgatacgcaggtcgttttttgtttgtgcgtgtgtgtatatatataatgctgtactacaataagcacaaaatgtaattataatatgg

SEQ ID NO: 5437 - DNA, 374 bp, Flaveria ramosissima
cgttacatatgttcattagttgctgattttcatagaactttgatgtatgggggagtggcaatgaaccctagagaccatcttcgacttgtttatgaggcaaacccgttgagttttcttgctgagcaagcgggtggaaaagggtccgatggtaagaaccgaattctgtctattcagcctgttaaattgcatcaaagacttccgttgttcctgggaagccctgatgatatcgatgagttggaaagctatggtgatgttcaacaaacggtgaatcctggttatgatgtataatatgatacgcaggtcgtttttgttgtgcgtgtgtgtatatatataatgctgtactacaataagcacaaaatgtaattataatatgg

SEQ ID NO: 5438 - DNA, 1673 bp, Vitis vinifera
cgaaatgttgtccaactccagctttacttccacgttaaacttgaaacaactgattttgtccgttattccaccctcactgtcaccacaatccacaatccacaatccacaatccgcaatccaaaccaagaagccctagtccccacacagtagaaagccccaaatttctttcattttctctcgctttcccacttcccaaacatctcaaatgaaatccccaatcagctccacctccgaatccccattctaatccaactccaacatgcactcacccgctataccactatactcaacttcaattttcccgccaaaactccatattttcacgccaagcagaagacttttttccagaacagttcttcttcagcaaagaatggcttcattttcgagaattggagtcagctcagaagtaggtggtgtaagatcgtcttcaggtggtgatgatggagtaggtacactaatggagtttgtggggaagagaggggttgacgtgggagatgagttggtggtgttgtttcatcatatacagtatgcttgcaagagaattgcagctcttgtggcctctcctttcaattcaactctggggaagcattcgggtttgggaggtggtgggggcgcgggtggctccgatagagacgccccaaagcccctcgatattgtttcgaatgaaatcattttatcatctctccggaactctggaaaagtagcagtcatggcttcagaagaagatgattttccggtttggataagtgatgatggcccatttgtggtggtcacagatcctcttgatggttcccgaaatattgatgcatccattcctactggaacaatttttgggatctataaccgccttgttgaactagatcatttgcccaaggaagagaagacaatgctgaattcacttcagagtggattgaagcttgtagctgcggtctatgttctctattcatcggccacaatactatgcaccagttttggttcagggactcatgcattcacccttgatcattcaacaggagactttattctcacacatccaaacattaaaattcctccacgagggcaaatctattctgtaaatgatgcacgatattttgactggcctcaaggtttaagacaatatattgacactgtaagacaaggcaaaggcaaatatcccaagaagtactcagctcgttatatatgttctctagtcgctgattttcacaggactctaatgtatgggggagtggcaatgaatccaaggagccatcttcgtctggtttatgaggcgaatcctcttagttttctggtggagcaggccgggggcaggggttctgatggtaaaattagaatcctttcaatccaaccggtcaagctgcatcaaaggcttcctctgtttttgggaagtccagaggacattgaagagttggagagttatgggaatgtgcaacagaaagtaaatcctggttatgaagtctgatgtatgacatttgtaggggttatgaattaaccaaggattgcttcttgtcagtactcagtaggttgtgtattcagattttacattacaaatccagatatcttacttcatcccaaatccaaatggttgtgtaatatattgttgtgtttgatggaaaatgtgtaactgtggtgttactgttaataagttaaaattgttgaatacttgttaaaaagct

SEQ ID NO: 5439 - DNA, 1476 bp, Lotus japonicus
acagcatgcactcagctgcagcatcacccttctatcaacttgtccccttccatccaaagttccaaacattccaatcaaaaactccattgaccaccccttactgcacaccaagactggcttccatttctgggtctgctaagatgaggccactgagagccttgggtggttcttcttcatcagcaggaggtgatggtgatgatggtgatggagttgtcacattgattgagtatctgggtaaggaaggaattgatttgaaagatgatttggtggtgttgcttgatcacatacagtatgcttgcaagagaattgcagctattgtagcttctcctttcagttgcagcattgggaagcaaacgggtgttggtgctgggggcggtggtggttcttctggtagggatgctcctaagcctcttgatattgtctcgaatgaaatcatcttgtcatccctcaaaaaatctggaaaagttgcagtcatggcttctgaagaaaatgatgcaccaacttggataattgatgatggtccatatgtggtcgtaacagatccactagatggctctcgaaatattgatgcatccattccaaccgggacgattttcggtatttataatcgccttgaggaattagacaatctacccacagaggagaaggctcagctgaattcactccagagtggaagtaagctgattgcagctggctatgttctctattcatctgcaactatactctgcgtcagctttggttctgggacacaggcattcactctcgatcattcaacaggagacttcattctcacaaatccgagcattaaaattcctccccgtgggcaaatttattctgtaaacgatgcgcgatattttgactggcctgaaggtttgaggcaatacatagacactgtgagacaaggaaaaggtagataccccaagaagtactctgccaggtatatatgttctctggtggctgatctccacagaactttgatgtatggaggtgtggcaatgaatccaagggaccatcttcgtcttgtttatgaagcaaaccctcttagtttccttgtagagcaggctgggggaagaggatctgatggcaaaaataggattctttcccttcaaccagttaaactgcaccaaagacttcctctctttctagggagtttggaagacatggaagagttggaaagttttggagatgtacaacaaaaagtgaatccgggttatgaggtttgatgatgtagcatacaaatttgactgttcagtcatcactgtgtctaactaatttgttgatatatatttttggtctatatttttccttttcttgtctctgttgttttttgggaagatgattatttacactgcttacaaaacaatgtgatatatgcatattcggatacacggtagaaaaccacaatgagccaaaatcatggtgaacagaagtaactttttgtagtttttggggttgtccagcgtgattttgatttca

SEQ ID NO: 5440 - DNA, 837 bp, Pennisetum glaucum
gccggggggagcgtggcggccgaccgggacgcgcccaagccgctcgacgaattgtcgaatgatatcatcttgtcatcgctcaaaagttctggaaaggttgcagtacttgcgtctgaagaaaatgatctgcctatttggatatgcgatgatggtccatatgttgttgttaccgatccgcttgatggctctcgcaacattgaggtctctatacctactggaacaatttttggaatatacaacaggcttgtggagctcgaccatctccctttggaggagagagctcagctcaattcgctgcaaagtggaactcgccttgttgctgctgggtatgtcctgtattcatccgccaccgtcttgtgtatcagcttcggtgcaggtacacatgccttcacattggattggtcgactggagaattcattcttacacatccttccctccagataccacctagaggacaaatatattcggtgaatgatgcacggtattttgattggcctgagggcctaaggaagtacattgacacaatcagacaaggcaaaggacagcacccgaagaagtactcagctcgctatgtttgctcactggttgctgatttccaccggacaatcatatatggtggagttgctatgaacccaagggatcatctgcggttggtttatgaggcgaatcctctcagtttccttgctgagcaggctggtggtagaggctccgatggcaagaacagaatcctctcgattcagcctgtgaagctgcaccagaggttgccattgttcttggggagcatggaggacatgcttgagttggtaagttacggagatgtccagcagaaggttaat

SEQ ID NO: 5441 - DNA, 1324 bp, Mimulus guttatus
ctaaaacccaatttcaaaaaatgtcaaattaaccagatatgtattcagcaactgtaatctcgaatcccatctcgaattaccctataaaacccaacattttccctccaaatcttcacaatttccagccaagattcaatttttgcgctttgcccatcgaaagaatggcttttcctggcctcaaaatcagtgccggcgccaccgccgctgatgccgacggtagcggcggcggcgacgctgggtttcagacgctgacggagtatatgggaaaaggcggcgaaaacgtgggagacgaattggtggtgctgtacagtcacttggagtacgcttgcagaaagattgctgctcttgttgcttcgccgttcaactccgctcttgctaaaacttccagttccgccgccgccggcagtgctgagagggataagcctaagccgctcgacatcgtcgccaatgacattatattgtcatctttaaagaactcgggaaaagtctgcgtaatggcgtcagaagaagacgacgctccggtttggctagcggacgacggcccattcgttgttgttttagaccctctagatggttctagaaatatcgatgcctctattccgactggaacgatattcggtatctacaaacgactagtggaactcgatcatctcccattggaggagaaggcgacgcttaattcactccagagtggaactaagcttatcgcctcgggctacgttctttattcatcggctacgattatgtgcactagttttggatcgggagcacatgcgtttacgttggatcgatcgacgggagacttcattctgacccatccgaacattaaaatccctcctcgagggcaaatatattcagtaaacgacgctcggtatttcgactggccggaaggcttaaggaaatacattgataccgttagacaaggcagaggggaaaatcccaaaaaatattcagctagatatatatgttcactcgttgcggattttcatcgaacacttttgtacggtggaaccgcaatgaatccaagggaccatcttcgactcgtatacgaagctaatccgctcagcttcttagcggagcaagctggcggcaaaggctccgatggtaaagttcggatactgtctcttcagcccgttaagctgcaccaaagacttcccctgtttttggggagttcgaaagatatcgaagagttggaaagttatggagatgttcaacagaaagttaatcctggatatgatgtctgaaaagtttagtcaattgttgttgtaatatataaagattgggatataaataaataaaataaaaattgatttgtttctttgtt

SEQ ID NO: 5442 - DNA, 649 bp, Pisum sativum
ccgctcgaccggagacttcattctcacaaatccaaacattaaaattcctctccgcgggcaaatatattcggtgaatgatgcgagatattttgattggcctgaaggtttaaggaaatatatagatactgtgagacaaggaaaaggtaaatatcctaagaagtactcagcacggtatatatgttctctggtggcggatctccaccgaactttgttgtatggaggtgtggctatgaatccgagggaccatcttcgtcttgtatatgaagcaaaccctcttagtttcattgtggagcaagctggtggaagagggtctgatggaaaaagcaggattctttcacttcaaccggttaaacttcaccaaagacttcctctctttttagggagtttggaagacatggaagagttggaaagttatggagatgtacaacaaaaagtaaatcctggttatgaggtttgaggctagaatattgaaattttaaatattcatccttcatgtttcctaactaataacaaatctgtgtattgttagaatgagaccttgatttgtatggtatataagttacaagagttatgaatttacatatttacatatatgcttataacatgagaataataagaaaatgacatggcaagacaaacttttgtattt

SEQ ID NO: 5443 - DNA, 542 bp, Lippia dulcis
ggcttaaggcggtatatagatactgtaagacaaggcaagggcaaacatcctaagaaatattcagccagatatatatgttctcttgttgctgattttcaccgtacactgttatatggtggtattgctatgaacccaagggatcaccttcgactcgtgtacgaagctaatccactcagcttcctagccgagcaagcgggaggtaaaggatctgatggtaaagttagaatactgtctctgcagcctgtgaagttgcaccagagacttcctttatttctcggaagcccggatgatatagaagagttagagagttatggagacgtgcaacaaaaagtaaaccctggatatgatgtatagaaaatgtagttatgtctcgtctgttgagtcttttcgtttacttagtttgccacatttcgaccttacattctgtttaaaacccgcttttattccctgtgctaatggattttctgaaatcccgtgttgttgtaatgtaggtcgactttgaaatatttaattgttttaaagcatgtatcaaaaaagaaaaa

SEQ ID NO: 5444 - DNA, 1352 bp, Platanus occidentalis
cgtactgcatttacccgccaaaaagacatagtttcgcgccatctagtccagtccttgtggacagctattctgtatcgttgtcgaatggtcttcttttgcgggtattagggctaattccgaaatgggtcgttcttcgagtggaggtaatggttttcgtactctgattgattatgtgggtaagggaggggccgacgtgggagatgatctagtggtgcttctggctcatattcagtacgcgtgcaagagaattgcagccgttgtggcttctcccttcaattctgagctcggtaaacatatgggttttgccggtggcagtgctgtcggtgaacccggagcaggcagagacgctccaaagcctttggatatagtatcgaatgaaatcatcttgtcctctcttcaaaattctggtaaggtggcagtcatggcttcagaagaagatgatgctccagtttggatagctgatgatggtccattcgtagtggtcactgatccgttagacggttctcgaaatattgatgcttctattccaactgggacaatatttgggatctataaccgccttgtggagttagatcatctacccccagaagaaaaggcacttctaaattctctccagagtgggacaaggcttgtagctgcaggttatgttctttattcatctgccaccatattctgcgtgacttttggttcaggaacacatgcatttacgctggatcagtcaactggagactttgttcttacacaccctagcataaaaattccttctcgagggcaaatctattctgtgaacgatgcacgatattttgattggcctgaaggtttaaggcgatatattgacactgtcaggcagggaaaaggaaagtacccgaagaagtactcggcccgttatatatgttcattggttgctgatctccatcgcactctgatgtatggtgggatagcaatgaatccaagagaccatcttcgtttagtctacgaagcaaatcctcttagttttcttgtggaacaagctggaggtagagggtcggatggtaagagcaggattctttcaattcaaccagttgagctgcatcagaggcttcctttattcctaggaagtttcgaggacatggaagagttagaaagctatggagatgttcaacagaagataaatcctgggtatgaagtctgatgtactggttgctgtcatcctccaaatagctgaatcatccttggactttttattgtttaacagtttttttgtcaattagaaaatcaaggtgccatcttatatttctatgtatttcttcacggaatctgattaagcagcaaatgatatgatccttattttttccctttctctgttttgtaaa

SEQ ID NO: 5445 - DNA, 1564 bp, Prunus persica
atacatataataacatgccattacccacaaccataacaccaccatccttgtgccctgctccaatcttccctccaaatcacccccatttcccgccaagacaccagtttcctccgagacccatctttcacaggccaagaatggcaactctttctgggttcattgctgggtcacaacttgtgggttcttcaggcagtggtggtggtggtgataatgaggcccgcactctgattgagtatgtgggcggcggaggtgtcgatgtgggcgatgatcttgtgcttttaatccatcacttacagtacgcctgcaagaaaatcgcagctcttgtggcctctcctttcaattctacccttgggaagcatacgagttttgctgccggcgccggcggttcggccggtgggtcaggcagggatgcaccgaaaccgcttgatattgtttcgaatgaaatcatcttgtcgtcacttagaagttctgggaaggtagctgtcatggcatcggaagaagatgacactccaacttggatacgtgatgatggcccatttgtggtggtaacagatcctctagatggttcgagaaatattgacgcatccattcccactgggacgatttttgggatttatcgacgccttgaggaactggatcatctaccaacagaggagaaggctttgctgaattcactccagactggaactaggcttgtagcttctggttatgttctttattcatcagccacgatattctgcaccagctttggttcaggaacacatgcatttacattggatcattccacgggagatttcattctcacacacccaagcttaaaaattccttctcgagggcaaatatattctgtaaatgatgctcgatattttgactggcccgacggattaagactctacatagacactgtgagacaaggaaaaggcaggtatcccaaaaagtactctgcccgttatatctgttctctggtagctgattttcatcgaacactactgtatggtggagttacaatgaatccaagagaccatcttcgtctcgtgtacgaggccaacccactcagctttctggtggagcaagctgggggcaaaggttctgatggtaaatatagaattctttcaattcagccagtgaagctgcatcaaaggctgcctctgtttttgggaagttgtgaggacatggaagagttagagagttatggaaatgtgcaacagaaagtgaaccctggatatgaggtctgatagtgtgctaataccacaagatccagtggatatatcgccataaaagccaactctgacatctaaagcgctgtgtgtttcttaaccacttcaagtcctaatagttgtgcgattccttgtcctctcggcaactatatatgtcatgaagagtctaggtgtgaaaaaacaggtgacatgaatctcttcaatatgtgtgatttttgtgtaatctcttatttctgttttggtcgtgcttctcttcttgtcaaatttgagcaataagttgcaaactttgccatcatgtaaaaactgaatgagtactcatttatcatctcatagaagtgctgaagcaa

SEQ ID NO: 5446 - DNA, 1402 bp, Rosa hybrid cultivar
gatccacgagtaggggtataggcttatgccagtctccaatcttcttcccaccgaagcattattcccacttgtcccgccaaacaatcagaatggcaactcctcctccttatgcggtggcttcttcaggcaaagctagtactactcttacagagtatgtgggtgatggaggtgtcggtgtgggagatgatcttgtgctgctcttccatcacatagagtatgcctgcaagagaatcgctgctcttgtggcctctccttataataattcaagccttgccaaacccatgtctctgcccactgctactgggtctgggtctgaccgagatgcacccaagcccctcgacattgtttcgaatgaaatcatcttttcgtctctaagaaattctggaaaagtagctgtcatggcttcagaagaagatgatactccagtttggatatctgatgatggtccgtacgtagtagtaacagatcctctagacggttcacgtaacattgaagcatccattcccaccggaacaatctttgggatttataaacgacttgcagagctggatcatctaccaaaggaggagaaggctttgctgaattcacttcaggttggaactaggcttgtagctgctggctatgttctttattcatcagccacaatattctgtaccagctttggtgcaggaacacatgcatttacgctggatcattcaacaggagatttcattctcacacacccaagcttaacaattcctcctcgcggacaaatatattctgtaaatgatgctcgatactttgactggcctgaagggttaaggagtatataaacactgtgagacaagggaaaggcagataccccaagaagtattctgcccgttatatctgttctttggtagctgattttcatcgaactctgctgtatggtggagttgcaatgaatccaagggaccatctacgtcttgtttatgaagctaaccctcttagcttcctagtggagcaagctgggggtaagggttctgatggtaaaaatagaattctttcaatacagccaatcaagctgcatcaaaggctgcccctatttttgggaagtctagaggacatggatgagttagagagttatggagatgtacagcagaaagtgaacccgggatatgaggtatgagcggtcattaaaaagctattttgactcctgaaaccccttatattgtttaccatttcaaatcgtattagtgacgctatgcaccatgttctcggcaactagataaacatgaagagtttaggggtgaaacatcaggtcacctgaatctgatcatgtaaatagcgttaaactctgtatggtgtatgtaatttcctgtaattagatgctcctgtttttttatgcaataagtggcaaaattttgccatctcttgatacctg

SEQ ID NO: 5447 - DNA, 1402 bp, Rosa hybrid cultivar
gatccacgagtaggggtataggcttatgccagtctccaatcttcttcccaccgaagcattattcccacttgtcccgccaaacaatcagaatggcaactcctcctccttatgcggtggcttcttcaggcaaagctagtactactcttacagagtatgtgggtgatggaggtgtcggtgtgggagatgatcttgtgctgctcttccatcacatagagtatgcctgcaagagaatcgctgctcttgtggcctctccttataataattcaagccttgccaaacccatgtctctgcccactgctactgggtctgggtctgaccgagatgcacccaagcccctcgacattgtttcgaatgaaatcatcttttcgtctctaagaaattctggaaaagtagctgtcatggcttcagaagaagatgatactccagtttggatatctgatgatggtccgtacgtagtagtaacagatcctctagacggttcacgtaacattgaagcatccattcccaccggaacaatctttgggatttataaacgacttgcagagctggatcatctaccaaaggaggagaaggctttgctgaattcactccaggttggaactaggcttgtagctgctggctatgttctttattcatcagccacaatattctgtaccagctttggtgcaggaacacatgcatttacgctggatcattcaacaggagatttcattctcacacacccaagcttaacaattcctcctcgcggacaaatatattctgtaaatgatgctcgatactttgactggcctgaagggttaaggagtatataaacactgtgagacaagggaaaggcagataccccaagaagtattctgcccgttatatctgttctttggtagctgattttcatcgaactctgctgtatggtggagttgcaatgaatccaagggaccatctacgtcttgtttatgaagctaaccctcttagcttcctagtggagcaagctgggggtaagggttctgatggtaaaaatagaattctttcaatacagccaatcaagctgcatcaaaggctgcccctatttttgggaagtctagaggacatggatgagttagagagttatggagatgtacagcagaaagtgaacccgggatatgaggtatgagcggtcattaaaaagctattttgactcctgaaaccccttatattgtttaccatttcaaatcgtattagtgacgctatgcaccatgttctcggcaactagataaacatgaagagtttaggggtgaaacatcaggtcacctgaatctgatcatgtaaatagcgttaaactctgtatggtgtatgtaatttcctgtaattagatgctcctgtttttttatgcaataagtggcaaaattttgccatctcttgatacctg

SEQ ID NO: 5448 - DNA, 1337 bp, Solanum phureja
agagcataaagatgctatcatcgaccgtttcttccctaaattttccagcaagaaccaaactctcctcaccaaaccctgcaatttttcctcaaaactacaatcttgtacctttctgtactgaaaatatggcttcttctccattttctggagggttaattaactccagggttgattcaccaattgcaatatgttgtaaaaatgcttcagtagattctgcaaatagtggattttcaacactgatggagtacatgggtaaaggaggggttggtgtgggtgatgacttggtgttattgtttggtcacttagaatatgcctccaagaaaattgctgctcttgttgcttcccctttcaattccagcctcaacaacaatgttgccattggaaatactgggatttcttctgatagagataaacccaagcctcttgatattgtttcgaacgaagttatattgtcgtctcttagaaattcgggaaaagttgctgtaatggcctcagaagaagatgagtgtcctgtgtggataactgatgatggcccgtttgtggtcgtcatggatcctttagatggttcccgaaatatagatgcctcaatacccactggaacgatatttgggatttacagacgtcttgtggaaattgatcatttgccggtggaggaaaaggctttactaaactgccttcagagtggatcaaagcttgttgctgcagcttatattctctattcgtcagccacaatactctgtgctagttttggttctggaacacatgcattcacattggatcatacaaccggagatttcctcatgacacatcctaacatcaacattcctcctcgagggcaaatatactcagttaatgatgctcggtattttgactggcctgaaggattaaggcagtatattgacaccataagacaagggaaaggacaatatcctaagaagtactcagccaggtatatatgttctctagtggctgattttcatcggactctgttatatggtggggtagcaatgaatccaaggaaccaccttcggcttgtttatgaagcaaatcccttgagtttcttagtggaaaaggctggaggtagaggttcagatggtaaaaatcgaattttatctattcagcctgtcaagctacaccaaagacttcctctatttttgggtagttcggaagatatagaagaattacagagttatggggatgttcagcagaaagtaaaccctggttacgatgtttaatgcccttgtcctctttcatgcagtttgctcatctctctttcacatgtactttttttcttgaggcacatagtaaatatgctcttcactagaataaacatgtga

SEQ ID NO: 5449 - DNA, 1331 bp, Fragaria vesca
gagataatgccatcacccctgagcataggcttatcatctccaatcttgccgccaaagcatcatcctcactcgtcccgcccttcccgccaaaccacaatggcaactccttcttcttcttgagcagtactagtctgatagagtatgtgggccaaggaggtggccatgtgggtgatgatcttgtgctgctcttccatcacatagagtacgcctgcaagagaatcgctgctcttgtcgcctctccttacaattctaccctttccaaacgcatgcctctcccctcctcttctgctgaccgagatgcccccaagcccctcgacattctctccaatgaaatcattttgtcatctcttagaaattctggaaaagtagctgtcatggcttcagaagaagatgatactccggtttggatatctgatgatggcccgtatgtagtagtaacagatcctctagacggttcacgaaacattgaagcatccattcccactggaacaatctttgggatttataaacgccttgcagagctggatcatctaccaaaggaggagaaagctttgttgaattcactccaggctggaactaggcttgtagctgctggttatgttctttattcatcagccacaatattctgtaccagctttggttctggaacacatgcatttacgctggatcattcaacaggagatttcattctcacacacccaagcttaaaaattcctcctcgcggacaaatatactctgtaaatgatgctcgatactttgactggcctgaagggttaaggaagtatatagacactgtgagacaagggaaaggcagatacccaaagaagtattctgcccgttatatctgttctttggtagctgatcttcatcgaactctgctgtatggtggtgttgcaatgaatccgagggaccatctacgtcttgtttatgaagctaaccctcttagctttctagtggagcaagctgggggcaagggttctgatggtaaaaatagaattctttcaatacagccaatcaagctgcatcaaaggctgcccctatttttgggaagtcttgaggacatggatgagttagagagttacggagatgtacagcagaaagtgaacccgggatatgaagtttgagtggtcactaagatctttttcaggttcgaaaccccttatattgtttaccattccaaaccgtaattgtggcacaatgcactatgttctcgtcaactagacaaacatgaagagtgagacataaggtcgcctgaatctgatcatgtagatagtgctaaaccccaaatggtgtatatgtaatttcttttaattagatgcttctgtttcata

SEQ ID NO: 5450 - DNA, 685 bp, Vinca minor
agacttgttgctgctggttatgttctgtattcatcggccactatactatgcacgagctttggtacaggaacacatgcatttacgttagatcgctcaacagggggatttcattctcacacatccaaatattaaaactccccccgcgagggcaaatctattctgtaaatgatgcacggtactttgactggcctgaaggtttaaggcaatatattgatactgtgagacaaggcaagggaaaatatcctaagaagtattcagctcgatatatatgttctcttgtagctgatttccaccgtactctcctatatggtggtgtggcaatgaatccaagggatcatctacgtcttgtttatgaagctaatccactgagtttcctagctgaacaagctggaggtaaaggttctgatggtaaaagcaggattttgtctattcagccggtcaagctacatcaaagacttcctttatttttggggagtccagaggatatagatgaactagagagttatggtgatgttcaacagaaagtaaatcctggttatgaaatctgataatctggatacgctttgaagcatcctagttctgcaagaacgaagccaaaagctttcctagaagcagaccgtatcttctttttttcaccacttttgctgcaccgaaacaaggggtggttcactgaaactctggaagc

SEQ ID NO: 5451 - DNA, 663 bp, Juglans hindsii x Juglans regia
ttgctgaattcgctccaaactggagcgaggcttgtagctgctggctatgttctgtattcatcagctacaatactctgtgccagctttggctcagggacacatgcatttactttggatcattcaacaggagatttcattctcacacatccaagcattaaaattccttctcgagggttaaggcgatacatcgacaccatgagacaaggaaaaggcagataccccaagaagtactcagcccgttatatatgttctcttgtagctgatctccatcggactctcatgtatggaggggtggcaatgaatcccagggaccatcttcgtatagtttatgagggaaaccctcttagttttcttgtggagcaagcagggggcagaggatctgatggtaaaaacaggattctttcaatgcaaccagttaagctgcatcaaagacttcctctgtttcttggaagtctggaagacatggaagagttggagagttatggagatgtccaacagaaagtaaatcctggctatgaagtttgaagattagtgactctattagtttataaatcaatcgcttgtgttactaacaatgtccatctatgaaaaatccagagattacacccaacaaaaaaaagtttgtaactagtcactccaagtatcagttgtaaatttccaatc

SEQ ID NO: 5452 - DNA, 760 bp, Eschscholzia californica
aagagcttgaccatctaccaacagaagagaaagcacaacttaactcactccagagtgggggcaaactcgttgcagctggctatgttctgtattcctctgccacaatattctgtgttagttttggttcaggaacgcatgcattcacattggatcacacaactggtgattttgtccttactcatccaagaatgaaaattccaccccgagggcaaatatactctgtgaatgatgcacgatatttcgattggccagaggggttaaagaaatatattgataccattagacagggcaaaggaaaatatcaaaaaaagtattcagcacgttatatctgctctctggttgccgatttccatcggactctcatgtatggcggggtggccatgaaccctagggaccatcttcgtctagtttacgaggcaaacccacttagttttcttgtggagcaagcagggggaagagggtctgatggtaaatctaagattctttcaattcaacctgttaagctgcatcaaaggcttcctctgtttttgggaagtttggaggacatcgaggagttagagagctatggagatgttcaacagaagataaatcctggctatgaagtttgatcatctaaatcccgaacagttcacttcgttctcctagagagaatcgcccattgtgttgtttattagttttctttggtttgaaaatgggtcactactctctctatctgtatctatctgcattcacaataatttccatttactgctaagaaatc

SEQ ID NO: 5453 - DNA, 1585 bp, Tabernaemontana elegans
caccttgcatagccagtgtctcccccaccaagagatgcaatcttcctccgtattcttgaaccacagcttgaatttcccgccaagactccaccttttccggccacatatcagtcttgctcaacgcagaagcagaatggcttctgtgccatcttttcttggtgggctcaacttgagggtcagcgcgaagacgggttgtgattcttctggtggtggttcttatgatggtgatagtggtggattttctacgttgatggagtgtgttggcaaaggcgggcttaattcgagtgatgacctggtggttttgtttgctcatttggagtatgctttcaagagaattgctgttcttgtggcttcccctttcaactctagccttggcaagaatgtcggtattgctgctgccggtgctggctccatgtctgagagagatgagccaaagcctcttgatatcgtctcgaatgagattattttgtcttctttaagaagttctggtaaagttgctgttatggcctcagaagaagatgatttgccagtgtggataactgatgatggtccatttgtggtggtcacagaccctctcgatggatcccggaatatcgaggcctctattcccacaggaacaatctttggtatctataagcatcttgtggaacttgatcatttgccagttgaggaaaaagcaatgctgaattccctccagagtggaaccaggcttgttgctgctggttatgttttgtattcatcggccacaatactatgcatgagcttcggtacaggaacacatgcatttacactggatcgctcaacaggggatttcatcctcacacatccaaatattaaaattccccgacgagggcaaatctattctgtaaatgatgctcggtatttcgactggcctgagggtttaaggcaatatattgacactgtgagacaaggcaagggcaaatatcctaagaagtattcagctcgctatatatgttctcttgttgctgatttccaccgcactctcctatatggtggtgtggcaatgaatccaagggatcatctacgccttgtttatgaagccaatccactaagttttctagctgaacaagctggaggtaaaggttctgataggtaaaagcaggattttgtcaattcagccagtcaggctacaccaaagacttcctttgttttggggagtccagaggatatagatgaattagagagttatggtgatgttcaacagaaagtaaatcctggttatgaagtctaatgctatgttaatctttggtctgtctggagtagatgttgggtatgctttgaagcatttcagttctgcaaggaataaagccaaaacctttcccagttgcagcaggttttctctttgtttttcaccatttatggtgcacctgacagggcatcatttactgaaactttaaaagaaccatgcagctgcattgacactttcttgtttcttttttatcatagttttctgaatgtggatcattgaatgtatgaaaaaactgtgtacttctccattatttatctgttttgtacagtgaattttctgtgtgtctccttagctgacatgcttgtcagttagatt

SEQ ID NO: 5454 - DNA, 1486 bp, Citrullus lanatus
gaatcgcagctccatcgcccattatgatcccatcaactactgccaaatcccagaagcgaaaaccaatccacacagtaatactatgcaatccaccgccattccccctttcaatcctcccgtttcatttccctcaaatctccctcgtttcgccccaataatccgccaatttccccctccatccaagcttcgcgtccccacagctatggcctcttccccttctgggctcgccgtcgggtcgcgaacaggggccgtttcgagcggggcacccgttgatggcccctgtactttgactgactttgtgggtaagggagggattggtttgggagatgatttggtgctactgttgactcatattcagtatgcttgcaagagaattgctgctctcgttgcttctcccttcagttccgatcttcaatatccggcgggtttggctgttgggttggagagggatgcacccaaaccgctcgacattgtgtctaatgaaatcatcttgtcatcccttagaaattctggaaaagttgctgtgatggcttcagaagaagatgatgaaccagtttggattagagatgatggcccttttgtggtggtaacagatcctcttgatggttctcgaaatattgatgcatcgatacctactggcacaatttttggggtttataaacgtcttgttgaactcgataacttaccgagagaagagaaggccgtgcttaattctctgcagagcgggtctaaacttttggcagctggatatgttctctactcatcagccacaatactttgtgccagctttggttccgggacacatgcatttacactggatcattcaacaggagactttgttcttactcatcctcatatcaaaatccctcctcgagggcaaatatattctgtaaatgatgcaagatatttcgattggccagaaggactgcggcgatatattgacacaatcagacaggggaaaggcaaaaatccaaagaagtactctgctcgttacatatgttctctggttgctgatctccatcgaactttattgtatggcggagtggcaatgaatccgagagaccatcttcgtctagtgtatgaagcaaaccctcttagcctcctcgttgagcaagccggaggccgaggttcagatggtaaaaaccgaattctttcaatgcagccaggtaagctgcatcaaaggctgcctttgttcttggggagtttggaggacatggaggagcttgaaagctatggagatgtacagcagaaagtgaatcctggttatgaagtttgaagttatggtagacaatgaagtttaaaatgtaaaaatcaaccttctaaacaataaggtcagtctctagattttgtgtatttcatcacattttttttcagtggcttgcatgctttactggaagatgtatataaactgtagaatattaacagtaaattctgacagcatgtgaattatagttatttgcaatctgaataatgaagttctattact

SEQ ID NO: 5455 - DNA, 1317 bp, Ambrosia trifida
atagaatgcaatcacctcacccaccaccactccatcccacttcatataatctcaatctcatccacaacttcccaccaaaactaacccctcttcacttccgccccaaactccccaaccaccgtatctccacacccatgacttccacttttacttaaatacatttaaaatcaactcaaaaacagacaccaatagtcatgcctttgttaccgtcactgagtttgctggcaaagcaggagaggatgtgggtgatgatttggtggttttgtatagtcatttagagtatgcttttaaaaagattgctgctctggttgcatctccggttaattctagccttgggaaaagcgatggtcatggtggtgatgtgggggccggtagagataagcctaaacctcttgacattgtttctaacgagatcatcttatcttgtttaacgaactctggaaaagttgcggtcatggcttccgaagaagacgacgctcctgtttggataaccgatgatggcccatttgtggtggttacagatcctctagacgggtctcgtaatattgacgcctccatcccaactggaaccatttttgggatctataaccggctgattgaactcgacagtcttccagtggaagagaaggcaatgctaaactcgttgcagagcggcagcaggctcattgctgctggctatgttctttattcatcggcaaccatactttgcaccagcttcggttctggtgcacacgcgttcactttggatcattcgacgggtgactttgttctcacacatccgaacatcaagatccctcctcgaggtcaaatctattcagtcaacgatgctcggtattttgactggcccgagggtcttagacggtacatagacacaataagacaaggcaaaggcaagttccctaaaaagtactcagcgcgctatatctgttcgttagttgctgatttccacagaactttgatgtacggtggagtggcgatgaatcctagagaccatcttcgacttgtttacgaggcaaacccgctgagttttctagcggagcaagcaggtggaaaagggtctgacggtaagcaccgaatactgtcgattcagcctattaaattgcatcaaaggcttccattgttcttgggaagcccagacgatatcgatgagttggaaagctatggtgatgttcaacaaactgtgaatcccggttatgatgtttgatatatatgatagatgagctgttttatgatgatcgaatgcgtgtttaatgtttatagtaacttataagaagaaaagatgtaaattgttatacggttaggcatgttaacttggta

SEQ ID NO: 5456 - DNA, 1721 bp, Theobroma cacao
gacaacagacctgagctcctcaactgaggtatttctatccgttatcccttccttctacctattttcccaacctcgtttcgacactgatacaaaaaatccaaaaccaaaatccacgttaaattcctttgaagaattcagtctccagtctctgatcccatgtttacatttgccatctccacttcactcttctaacatgtgaaacaacctctataatttccatttactaatatgcaacagttattgttacccaccacctcgttcccgcctccacttttccctctgaagtctcatcctttccctcgaaagcagcaattttgtctaagagacggcttgagcttgtacgccccaccaaaaatggcttccttttctgggtttgtagctaagtcccagatgcaaacgactgctgatggtggtgatgcaaatgggttttctacgctgatggagtatgttggcaaaggaggactagacgtgggagatgagttagtggttttgctttatcatatgcaatatgcttgcaagagaattgctgctctcgtggcttctccttttaattctgctctcgggaaacattcaggtctttctgctggcacatccgggtctggtggtttagacagggataaaccaaagccgcttgatattgtggcaaatgaagtcatattgtcctctcttagaaattcaggaaaggtttcagtcatggcttcagaagaagatgacgctcctatttggatcaatgacgatggcccttttgtggtggtattggatcctcttgatggttctcgaaatatagatgcttccattcccactggaacaatttttgggatatataagcgacttgtggagctagatcatctacctacagaggagaaggcatcactgaattcgctacagagtggaaccaggctcctagctgctggctatgttctctattcatccgccacaattctctgtgctagcttcggctctggaacgcatgcatttacactagatcattcaacgggagactttattctcacacatccaagcatcagaattcctgctcgaggtcaaatatattctgttaatgatgcacggtattttgactggcctgaaggtctaaggcaatatatcaacacagtgagacaaggcaaaggcaaataccctaagaaatattcagcacgttatatatgctctttggttgctgatttccataggactctcttgtatggtggactggcaatgaatccaagggaccatctacgcctggtgtacgaggcaaaccctctcagttttcttgcagagcaagctggaggcaaggggtcggatggtaaaagtaggattctttccatccaaccagtcaaactgcatcaaagactgcctctctttttggggagtttggaggatatagatgagttggaaagctatgaagatgttcaacagaaagtaaaccctgggtatgcaatctaatgactttgttctttccagcagatgtgatgtatataaaaccagctctgctctgttgctctgcttttctataagttcacatgacagctcttcctctccgctgttcatacttttttctctgttttttcaataatcaagagttgtatgtgagtcacgaagaccaaaatgtaatgctattattacaaagtcgaatgtgaaagcatcacactttttacaagttttgagtttggttgttgtaagaaccaatccagcagtacaaggaaaaaagacatacttattgt

SEQ ID NO: 5457 - DNA, 1566 bp, Citrus clementina
tccattctcatttctctctgctctgtctttcattatatcaatcaaaaagatgataaaatagttacaatccatctaaattctgaacccaataacacataacatgcaatcatccaccattactttatatcaaactcccattttccagccaaaattcagcagtttcccgccaaaaaataaccaccaccaccagcagcagcaatttcttgtgagaaccaatttgctgatcagtccaaaaatggcttcttcttcttcttcactttctgggtattttccaattcgttcacagaaggctgattcattgagcgttgtcaatgatgaagcaaatggctttcccacgttgatggattatgtgggcaagggagggctcaatgtgggggatgatttggtggtcctgcttacccatcttcattatgcttgcaagagaattgcagctcttgtggcttcgcctttcaactccagccttgctaagcatatgggtggttcagctgctggtgggtctgctgagtccggcagggatgttgctaagccgcttgatatagtctccaatgaaatcatattgtcctctcttcggagttctggaaaagttgcggtcatggcttcggaagaagatgattcgccaatttggataaatgatgatggcccatttgtggttgttacagatcctcttgatggttctcataatatagatgcttccatacccactggaaccatatttggggtctataatcgccttgtggagctagatcatttagctgacaaagagaaggcactcctgaactctctgcagagtggaagtcggctggtagctgctggatatgtcctctattcatcagccacgatactctgtgctagctttgggtcaggaacacatgcatttacattagaccattcaacaggggactttgttctgacacatccaaacataaagattcctcctcgagggcaaatatactctgtaaatgatgcacggtattttgactggcctgagggtttaaggaaatatattgatactgtgagacaaggcaaaggcaaaaaccctaagaaatattcagcccgttatatatgttctttggttgctgatttccatcgcactctgttgtatggcggagtggcaatgaatccgagagaccatcttcgattggtgtatgaggcaaatcctcttagtttccttgctgagcaagctggtggcaaaggttctaatggcaaaagtaggattctttcaattcagccggtccaggttcaccaaaggctgcctctgtttcttggaagttcagaagacatggaagagttagagagttatggagatgttcaacagaaagtgaaccctgggtatgaagtttgatctatgttttgtttatgctcatgttcttgttagtttcttcaatgatatttttcaagcaagacttagtgaatgcacaaaatctttctggagaaaaagaaaataaactcagatgccagaattttcagaatgcgaagcatgtaccatatctattaacaataagagaatcatttgaagaacaacccgaaatttcaacaaatattaatgttcaaagatcctgtttgcta

SEQ ID NO: 5458 - DNA, 327 bp, Conyza canadensis
agtggcaatgaatcctagagatcatcttcgacttgtctatgaggcaaaccctttgagttttctagcagaacaagccggcggaaaggggtctgatggtaagaaccgaattctttcacttcagcctgttaagttgcatcaaagacttccattgttcttgggaagcccagatgatattgatgagttggaaagttatggtgatgttcaacaaacagtaaatcccggttatgatgtatgatacagcacgtttatattctcatgtatatatagcaaaactgttttcacgactctcgactataaataacaaatttctcttagacaatgttcttc

SEQ ID NO: 5459 - DNA, 623 bp, Eschscholzia californica
aagagcttgaccatctaccaacagaagagaaagcacaacttaactcactccagagtgggggcaaactcgttgcagctggctatgttctgtattcctctgccacaatattctgtgttagttttggttcaggaacgcatgcattcacattggatcacacaactggtgattttgtccttactcatccaagaatgaaaattccaccccgagggcaaatatactctgtgaatgatgcacgatatttcgattggccagaggggttaaagaaatatattgataccattagacagggcaaaggaaaatatcaaaaaaagtattcagcacgttatatctgctctctggttgccgatttccatcggactctcatgtatggcggggtggccatgaaccctagggaccatcttcgtctagtttacgaggcaaacccacttagttttcttgtggagcaagcagggggaagagggtctgatggtaaatctaagattctttcaattcaacctgttaagctgcatcaaaggcttcctctgtttttgggaagtttggaggacatcgaggagttagagagctatggagatgttcaacagaagataaatcctggctatgaagtttgatcatctaaatcccga

SEQ ID NO: 5460 - DNA, 3242 bp, Eucalyptus grandis
acggtctgctaccactcccaaagactctccttttatccaaaatttgcagatagaatcatctccatctcaacttcagccaagtaaaatcttcacctcatctgtcagaactttgcaaaaaggttgtacctttacttcccatgtagcctgccacatcctggattttgagttgaccttcatctgatcccagttctcgaaactattactatgcaattaccgacaacgctcgagtacccatttccgtcaacctctccaaagtccctccttttcatccgcaaggcccagaattttcggacacaaccgaattttcctccaagaaacaggttttgcacctcgaaaatggcttcttttcctgggttttcggtgaggtgccgcgcggctggcggtgcaacagagggcctaagtgagtaccgcacgttggtagagttcttgggtaaggaggggattggcgtgggagatgatctggtgctgctgtttgatcacattcagtatgcttgcaagaggattgcttctcttgtggcttctccgttcaattccagcttaggaaagcaagcaagtcttgttggtggggtgggtggtgaatcaggcagagatgccccgaagcctctggacattgtctcgaatgaaattatcttgtcgtctctaaggaattctggaaaagttgctgtcatggcttcagaagaagatgatgctccagtttggatagttgatggtggcccatttgttgtggtaacagatcccttggatggttctaggaacatcgatgcatccattcccacaggaacaattttcggcatatataatcggcttgtggaacttgatcatttacctaaagatgagaaggctcagctgaactcactgcagagtggaaccaggcttgtagcttctgcttatgttctctattcttcagccacaattctttgtgctacctttggttccggaacacatgcttttactctggatcagtctacaggagacttcattctaactcatccaaacatcaaaattcctcctagagggcaaatttattctgtaaatgatgcaagatattttgattggccggatggtttaaggcggtatattgacactgttcggcaagggaaaggaagataccccaagaaatattcagcgcgttatatatgctctctggtggccgattttcatcgcactctgctgtatggtggcgtggcaatgaatcctagagatcatctccgtctagtttatgaggcaaatcctttaagctttcttgtggagcaggcaggtggcaggggctctgatggcaaaagtaggattctttctattcaacctgtgaagctgcatcaaaggttgccactgtttttgggcagtccagaggacattgaagaattggagagctatgaaaatgttcagcaaaaagtaaatcctggatatgaagtttaggtatccagtcgtaatgaaatctgtattggtctgatgagttttgttgctgggtcctctcccttttagagttttggtaaatgtcgagtcattcaaaatgtactttactaatttgggatcatatgtaaaatcagcaattagatgagatgtgatcaaggattggcattttgctttgtctaagtcactgaagtgtgattacaaactgtcattgctgcatattccttcaaaaggtaccctctcttggggaactagaacaagaatacaacacacaccaaaaaaattatattgccatgctactaagactagaactcatctttattcgacgacaatgcagatattaatgcgtctctctcaagatacgacaagttcttagctatcgtgggtatctgatgatccttttctgcggctatacaggaactctacaaagtcgttgatgtaactgtcgtgaagatcctgatcggcgaaatcttctgtatatgggctgccttcactctcaatccttctccctgatcttccagcaacacaagtctgatggacttggcaactgcgtctctgtgaaatgatccatcttcatttctgggcacctcgaacccgacacctttttccactaacagctttgcgttaaggccctggtcatctaccatgggcatcgtaatctgtggatggccaaatccaagcgactcaatgatagaactccacccagaatggtacagacaccctccgatagcaggatgaccaagtattgccaattgcggagcccaccctattgaaaccatactccgttctgaggttctctccagaaacccatcaggaagcagttcagagctatcaaattctagtcctccgggcttcctgaggatccagaagaaaggcatctcagagagctcgagcccatatgccaactcgtggatttcctccagaggcattttgtattctgttccgaatccgacaaacagtacagactttctagcttgtttgtccaaccatttggagatatgtgaccaatttgagccggtagcctgatcacatgctttgttcttggacaatggaggcaataaacctactggcagtacaggtttccggtagagtcctctaagaaggtttagatattcaccttcaaattctgagcagcttctcacagcaacaaattcgcaaccatgtagagttgctgcccacctttggctgcatgataagctggatttatcagggaagtataaattcttgaacatcttttgtgccaggtgaggaccttgagacactagtgaagttagaggaaaccagtctggagttactgcaaaatcttctggcttctttccccggccaaatgactcgagctctgctggtggccctaaaaatgcaagtgtacaagcagcatacgcactaaaatttccagaaggcacgctgaatttggcggctatttgtgggatccagcactgaacaaaatcaaataggattaagtcgggtgaaatcttgcacaagagctgctctagtgcctcgcgtaacccgtcgcaggccttcctaagatactcagtgcactctaatggcaagtctatagtagcctcagaattctcgggcaggccatcgactgaagtcagtgggatctggacaagctttatgttttcaattaagttatcgggaactggaggcaatctctgtatatttctgggagtagagatgaaggaaatatggatcccctttgaagccaatcttttggccaattcgaaatatggaaggatgtggccaaatgccaaccatgggaacatcattatttcatattgtttggaagccttttggatcttctctgctaatgcaaagacgttgttaatcat

SEQ ID NO: 5461 - DNA, 1388 bp, Medicago truncatula
gtccccaaatgaaaatggaaactttttgctgaaacttggataagttttgacactatgcagtcagcaacaacaacaacacccttctatcaactcctcctcaccttccgaccaaagcttcaaactttccaatcaaaaactcaaacccttttctacactccaacaatggcttcagtttctgagttcagaacaagagtaaaaccactctcagccttaggtaattcttcttcatcttcatcaacagttgcaaatgatgatgggtctgttacattgatggagtatatgggtaagagaggtggaattggtgtgaatgatgatttggtgattttgattgatcatatacaatatgcttgtaagagaattgcagctcttatagcttctcctttcaattataccattgatatgccaagtagtggttctgatagggatgctccaaagcctcttgatattatatcgaatgaaattatcttgtcatcacttcaaaaatctggaaaagttgctgtcatggcttctgaagaaaatgatacaccaacttggataagtgatgatggtccatatgtggtcgtgacagatcccctagatggttctcgaaatattgatgcatccattccaactggtacaattttcggtatttataaacgccttgaggagctagatgatcttcccacagaggagaaggctttgctgaattcactccaaagtggaaataggttgatagcttctggctatgttctctattcatctgcaactatactctgcattacctttggctctgggacacatgcattcactctcgaccgttcaacaggagacttcattctgacaaatccaagcattaaaattcctccccgtgggcaaatatattctgtgaatgatgcaagatattttgattggcctgaaggcttaagaaaatatattgatactgtgagacaaggaaagggtaaatatcctaagaagtactctgcaaggtatatatgctctctagtggctgatctccatcgaactttgttgtatgggggtgtggcgatgaatccgagggaccatcttcgtcttgtttatgaagcaaaccctcttagtttcatcgtggagcaagctggtgggagagggtccgatggaaaaagtaggattctttctcttcaaccagttaaactgcaccaaagacttcctctctttttagggagttcagaagacatggaagagttggaaagttatggagacatacaacaaaaagtaaatcctggttatgaggtttgatgctatagcattgaaattttgaatgttcaacctttatgtttcctaacttatttgtaactatgttgttgtttatatctgttgtatgtattgccttatatccatcatttgtgttaatagatttctttctcttcactttt

SEQ ID NO: 5462 - DNA, 1388 bp, Medicago truncatula
cccaaatgaaaatggaaactttttgctgaaacttggataagttttgacactatgcagtcagcaacaacaacaacacccttctatcaactcctcctcaccttccgaccaaagcttcaaactttccaatcaaaaactcaaacccttttctacactccaacaatggcttcagtttctgagttcagaacaagagtaaaaccactctcagccttaggtaattcttcttcatcttcatcaacagttgcaaatgatgatgggtctgttacattgatggagtatatgggtaagagaggtggaattggtgtgaatgatgatttggtgattttgattgatcatatacaatatgcttgtaagagaattgcagctcttatagcttctcctttcaattataccattgatatgccaagtagtggttctgatagggatgctccaaagcctcttgatattatatcgaatgaaattatcttgtcatcacttcaaaaatctggaaaagttgctgtcatggcttctgaagaaaatgatacaccaacttggataagtgatgatggtccatatgtggtcgtgacagatcccctagatggttctcgaaatattgatgcatccattccaactggtacaattttcggtatttataaacgccttgaggagctagatgatcttcccacagaggagaaggctttgctgaattcactccaaagtggaaataggttgatagcttctggctatgttctctattcatctgcaactatactctgcattacctttggctctgggacacatgcattcactctcgaccgttcaacaggagacttcattctgacaaatccaagcattaaaattcctccccgtgggcaaatatattctgtgaatgatgcaagatattttgattggcctgaaggcttaagaaaatatattgatactgtgagacaaggaaagggtaaatatcctaagaagtactctgcaaggtatatatgctctctagtggctgatctccatcgaactttgttgtatgggggtgtggcgatgaatccgagggaccatcttcgtcttgtttatgaagcaaaccctcttagtttcatcgtggagcaagctggtgggagagggtccgatggaaaaagtaggattctttctcttcaaccagttaaactgcaccaaagacttcctctctttttagggagttcagaagacatggaagagttggaaagttatggagacatacaacaaaaagtaaatcctggttatgaggtttgatgctatagcattgaaattttgaatgttcaacctttatgtttcctaacttatttgtaactatgttgttgtttatatctgttgtatgtattgccttatatccatcatttgtgttaatagatttctttctcttcacttttgtt

SEQ ID NO: 5463 - DNA, 1567 bp, Citrus sinensis
tccattctcatttctctctgctctgtctttcattatatcaatcaaaaagatgataaaatagttacaatccatctaaattctgaacccaataacacataacatgcaatcatccaccattactttatatcaaactcccattttccagccaaaattcagcagtttcccgccaaaaaataaccaccaccaccagcagcagcaatttcttgtgagaaccaatttgctgatcagtccaaaaatggcttcttcttcttcttcactttctgggtattttccaattcgttcacagaaggctgattcattgagcgttgtcaatgatgaagcaaatggctttcccacgttgatggattatgtgggcaagggagggctcaatgtgggggatgatttggtggtcctgcttacccatcttcattatgcttgcaagagaattgcagctcttgtggcttcgcctttcaactccagccttgctaagcatatgggtggttcagctgctggtgggtctgctgagtccggcagggatgttgctaagccgcttgatatagtctccaatgaaatcatattgtcctctcttcggagttctggaaaagttgcgatcatggcttcggaagaagatgattcgccaatttggataaatgatgatggcccatttgtggttgttacagatcctcttgatggttctcgtaatatagatgcttccatacccactggaaccatatttggggtctataatcgccttgtggagctagatcatttagctgacaaagagaaggcactcctgaactctctgcagagtggaagtcggctggtagctgctggatatgtcctctattcatcagccacgatactctgtgctagctttgggtcaggaacacatgcatttacattagaccattcaacaggggactttgttctgacacatccaaacataaagattcctcctcgagggcaaatatactctgtaaatgatgcacggtattttgactggcctgagggtttaaggaaatatattgatactgtgagacaaggcaaaggcaaaaaccctaagaaatattcagcccgttatatatgttctttggttgctgatttccatcgcactctgttgtatggcggagtggcaatgaatccgagagaccatcttcgattggtgtatgaggcaaatcctcttagtttccttgctgagcaagctggtggcaaaggttctaatggcaaaagtaggattctttcaattcagccggtccaggttcaccaaaggctgcctctgtttcttggaagttcagaagacatggaagagttagagagttatggagatgttcaacagaaagtgaaccctgggtatgaagtttgatctatgttttgtttatgctcatgttcttgttagtttcttcaatgatatttttcaagcaagacttagtgaatgcacaaaatctttctggagaaaaagaaaataaactcagatgccagaattttcagaatgcgaagcatgtaccatatgtattaacaataagagaatcatttgaagaacaacccgaaaatttcaacaaatattaatgttcaaagatcctgtttgcta

SEQ ID NO: 5464 - DNA, 1525 bp, Glycine max
ctaaaagtgcttgtcaagtagtatctgccactgaaattgtctgaaatgaaacattctgatcattagataacttatcacattatgcaggcagcagcaacaacaccactctatcaactcgtgagcttcaagccaaagcttcaaactttcccttcaaaatctcaactttgccccttagggacccctttctgcagactaggaatggcttctgtttctgggtttaggttgagacccctgagggctgtgggtggttcttcatcatcttctgcatcaggtgatgatggatttgtcacactgatagagtatgtggcgaaggaaggaatgaatgtgaaagatgatttggtggtgttgcttgatcacattcagtatgcttgcaagagaattgcagcacttgtggcttctcctttcaattacagccttggcaaacaaactggtcatggttctgttggttctgatagggatgccccaaagcctcttgatattgtctcgaatgaaattatcttgtcatcactccgaaaatccagaaaagttgctgtcatggcttcagaagaaaatgatgcgccaacttggataagtgacgatggtccttacgtggttgtaacagatcccctagatggttctcgaaatattgatgcatccattccaacaggcacaatttttggtatttataagcgccttgaggaacttgataatctacccacagaggagaaggctatgctaaattcactccagagtggaagtaagctgattgctgccgcgtatgttctctattcttctgcaactatactctgcatcacctttggttctggaacacaggcattcactcttgatcattcaacaggagactttattctcacaaatccaagcatcaaaattcctccccgtgggcaaatttattcagtaaatgatgcgcggtattttgactggccggaaggtttaaggcaatatatagacactgttagacaaggaaaaggtagataccccaagaagtactctgccaggtatatatgttccctggtggctgatctccacagaactttgctgtatggaggtgtgacaatgaatccaagggaccatcttcgtcttgtttacgaagcaaaccctcttagtttcattgtagagcaggctggtgggagagggtctgatggcaaaaataggattctttcccttcaaccagttaaacttcaccaaagacttcctctctttttgggaagcttggaagacatggaagagttagaaagttatggggatatccaacaaaaagttaatcctggttatgaggtttgatgctgctgtatatagcatcatgcatacaaattttgaatattcaaccatcatggtgcctgactaattgttccagtgtttttcacctgtgttttatgtacttcgttatccatcatctgtgttaacgtagctttaattctctgatcacacttctgctctgatataaacaaaattctgtcaagaagattgtatgagaaaatggatacaaatgcttttgctttgataaaagttcgtattcttttca

SEQ ID NO: 5465 - DNA, 1485 bp, Glycine max
actgaaattgtctgaaatgaaaacattctgatcatcattagataacttttcacattatgcagtcaacagcagcaccaccactctatcaacttgtgagcttcaagccaaagcttcaaactttcccttcaaaatctcaactttgccccttagggacccctttctgcagactagaaatggcttcaatttctgggtttgggctgaaacccctgagggctgtgagtgtttcttcttcatcttctgcatcaagtgatgatggatttgtcacactgacagagtatgtggggaaggaaggaatgaatgtgaaagatgatttggtggtgttgcttgatcatattcagtatgcttgcaagaaaattgcagcacttgtggcttctcctttcaattacagccttggcaaacaaactgctcttggttctgttggttctgatagggatgctccaaagcctcttgatattgtctcgaatgaaattatcttgtcatcactccgaaaatccggaagagttgctgtcatggcttcagaagaaaatgacgcaccgacttggataagtgacgatggtccatatgtggttgtaacagatcccctagatggttctcgaaatattgatgcatccattccaacaggcacgatttttggtatttataagcgccttgaggaactagatgatctacccacagaggacaaagctatgctgaattcactccagagtggaagtaggctgattgctgctgcttatgttctctattcttctgcaactatactctgcatcacctttggttctggaacacaggcattcactcttgatcattcaacaggagactttattctcacaaatccaagcatcaaaattcctccccgtggtcaaatttattcagtaaatgatgcacgatattttgactggcctgaaggtttaaggcaatatatagacactgttagacaagggaaaggtagataccccaagaagtactcagccaggtatatatgttctctggtggcagatctccacaggactttgttgtatggtggtgtggcaatgaatccaagggaccatcttcgtcttgtttatgaagcaaaccctcttagtttcattgtagagcaggctggtgggagagggtctgatggcaaaaataggattctttcccttcaaccagttaaacttcaccaaagacttcctctatttttgggaagcttggaagacatggaagagttagaaagttatggggatatccaacaaaaagttaatcctggttatgaggtttgatgctgctttgtatagcctcatgcatacaaattttgaatattcaaaccattatggtgcctgattaattgtttcagtgttcttcttcacttgtgttttatgtactgcattacccatcatctgtgttgacgtagctttaattctctgatcatacttgtgctctgatataaataaaattctatgtcgataagattgtatgagaaaatggatacaaatgattttgctctga

SEQ ID NO: 5466 - DNA, 395 bp, Helianthus annuus
tggtggagtggcaatgaaccctagacaccatcttcgacttgtttacgaggcaaaccctctgagttttctcgcggagcaagcgggtggaaaagggtctgatggcaagcaccgaattctgtcgattcagcctattaaattgcatcaaagacttccattgttcttgggaagcccagacgatatcgatgaattggaaagctatggtgatgttcaacaaactgtgaatcctggttatgatgtatgatatgtatgatagatgggtcgtttaatgacggctgagtgtgtttaatgccgttgaactaatatgaaaagatgtaaattgtaatgtggtttggttatgaaaagatgtaaattgttatatggtttggcatgtttacttgccatttttggtacgtaaa

SEQ ID NO: 5467 - DNA, 915 bp, Tripterygium wilfordii
cgatgctccagtttggataagtgatgatggcccatttgtggtggttttggatccccttgatggttctagaaatattgatgcctccattcccacaggaactatatttggggtttatagccggcttgtggagctggatcatcttccgcgagaggagaaggctgctacttaattcattgcagactggaactagtcttgttgctgctggatatgtgctctattcatcagccacaattctctgtatcagctttggttctgggactcatgcttttacattggatcgttcaaccggagatttcattttgtctcatccaagcattgaaatccctcctcgggggcaaatctactccgtaaatgatgcacgatattttgattggcctgaggggttaaggcgatacattgacacagtgagacaagggaaaggcagatacccaaagaagtactcggccaggtatatatgctctcttgtagctgatttccaccggaccctgttgtacggtggagtagcaatgaatccaagggaccatcttcgcctagtttacgaggcaaatcctctaagttttctggtggagcaggctggtggcaaaggctctgatggtaaatgtagaattctttcaattcaaccagataagcttcatcaaaggcttcctttatttctagggagctcagaggatatagaagagttggaaagttacggagatgttcagcagaaagtgaatcctgggtatgaagtttgatgctagagtgattcccgtctaatgttgtgatttgaatccacatttgtcggttttctgctggctggatatgtccattgacaacttgaagttagatgacaaggctatatgtatttatttataggctctaaaacccttttagtccagcaagacccttctcattctcatatcagtcgtggtttca

SEQ ID NO: 5468 - DNA, 285 bp, Utricularia gibba
tacatatgttctctggttgctgatcttcacagaaccctgctgtacggcgggatcgccatgaacccaagggaccatcttcgcctggtctacgaagcgaaccctctgagcttccttgtggagcaggctggaggcagaggctcgaatggaaaggcaaggattctgtctctccagccagtgaagatccaccagagactccctctgttcctgggtagccctgaggatgtccaggagctggagagctatggagatgttcagcagaaacgttaaccccgggtacgatgtctg

SEQ ID NO: 5469 - DNA, 1390 bp, Amborella trichopoda
ggcatataccttcgcctcacagcatgcacgcttcatcaattccctgcaaagcctcaaatttgaatgttaatctctccccatttaaccaaagatcatcatctaagaggagctcaattaggtttttccagtttggctttccttggccttctcccatggcttcttcttctccctctggttctggttttaaggttcaatccctgatgggttcttcttcaagcgagggtttccaaactctaatggattatattggcaaggagggagctgatattggggatgaccttgtgattttgttgaaccatttgcaatatgcttgtaaaaagattgcagctttggttgcttctcctgtgagttctaagcttaggcaacaaatagagttttctgaatttggtcaacggatggcccgagacaaacctaagcctctggatattgtttcgaatgagatcattctggcctcccttcgaagctccggaaaggttgcagccatggcatcagaggaagatgactcccctgtttggatagccgataatggcccctacatagtggtcactgatcctcttgatggttctcgaaacattgatgcctccattcccactgggacaatatttggaatatataaccgactcatagagcttgatcacttacctgttactgagaaggcactgcttaattcacttcaatgtggacagagacttattgcggcttgctatgtcctatattcttcagctactatcctctgcatcagttttggttcaggaactcatgcatttacacttgatcggtcattgggtgatttcgttctcactcatccatatataaaaattcccgctcgagggcaaatctactctgttaatgatgcccggtatttcgactggcccgaaggcttgaagcaatacatagacacaattcgacagggaaagggggagtaccccaaaaaatattctgctcgatatatctgttcgttagttgccgacctccaccgaactttgatctatggtggggtagcaatgaacccaagggaccaccttcggctagtttatgaggcaaacccactaagctttctagtggagcaagcaggagggagaggctctgatggaaagtcaaggattctctctattcaacctgtggagcttcatcagaggctctctctctttcttggaagctcagaggacatcgaagaacttgagagctatggtgaagttcaacagaaggttaatcctggttatgaggtttgatacaaggtgagccagactggtatggtttcatttcaggttggtgcttagattgagtgtcaagtgcgtatagtaaattataatttcggatgaatttgtggatggttgtttacatgttatcgaatggaagagtatgttgatatgtgatataatatttgcat

SEQ ID NO: 5470 - DNA, 3200 bp, Musa acuminata
gaagaattcgaacacgtgtcctgttcgatgttatgttccagtgggactgaggtggtctttctcactgcctcatcgtcagctctgtttgcaccttaagctactgatggaagttctgcagtagaaaggatcatgcttattggtaattgcttatgaagctgtgtgatttatcaggtttggcgaaagttgtcttaaagaaagggaagacacaagtctttaagaatggaaatcccatggtttacagcggtgcagttgacagaatcatcggtaggcctcctcctaagacaggcgatgctgtcctggtagcagatggatcagagagggcaatagggtggggtatgtacaattcggtgtcaatgttctgtgtcagactaatgcaattagaagaagaggcggcaagggatccaagctatgcactgaacatggagaagctgcttgaagcaagacttgatgctgctgtagatttacgtcagagcatgggacttccttcggatgacacaaatgtatatcgtctagtgaacagtgagggggataggttgtcaggtttaattgtggacgtttttggcgatgttgcagtaatagcctcatctgctgcatggatcgagaaatataaacaggaaattgagttccttgttggcagagtcagaaatgtaaaccatataaagtggagaccttcaattgatattctgaaagaagaaggacttgaaatatcagatcaaggagaccctggctcttcttcatgccctggaagagtaaaggtcatggagaatggcatatgttacttaatctcactagagggacagaaaacagggttctatgcagatcagcgtgaaagtcgtcgactgatttcatctatttcaagagatcggagagtccttgatgtttgctgttatagtggtggtttcgcattgaatgcatcatttggtggtgcaaaggatgtcattggtaaaatactgaattgattcatcatcacctgccttggaacttgcaaaagagaacatccaactcaacaaattggatccaggaaggatctcatttttaagagaagatgcaacagagttcatgaaaggtgctgctgccagaaatgaatcatgggatgtggtaattttggaccctccaaaattagcacctcgaagaaaggtgctacaaagtgcatctggcatgtacagaaatttgaactcattggccatgcaaatcacaaagagaggtggtctactaatgacatgttcatgttctggagctatgacacagagtgggttgttcctgcgtgttcttcaggggtgctgcatcgatggcagggagaagaatcacagtcttgcgtcaagctggcgtcgcatgcgaccatccgatcgacccctcctacccggagggtgcctacctcaccaacttcttgctccgcgtcctctgagaagacggcagaacgtcgatacgacggtgaccggtgacagttctttgcagatgagttcttcctgcatcaacttctccaccatggtagacggggcacatcgtacatcttgcattacacaggtgccatgccatcaccatttgcagcacaacaagatcatttacggagtgaaggaaaaactagtcagatactgtggatttcactgtaactcttctgatcattatattaatcatcatcatccttatttgtttgctgtagtaacgagcaaatccatttttcttttatttgatttggcctccccatccatcaccacatcgagctcgaactttatccttccccaacttctgtgccgcccatcgatggaatcccccgccctcctcctctcccctcccgccgcgaatccgaaccacccaccgtcttctctctccccccatcgcgtgctttggtcgcctcgccgtaacctccgccccctcggctgcagcctctccacctccagcggccgcgccacgaggaggccgccgctcggctccccgagggtcgtctccgagatggcgtcttctaccggcggcgagagctacatgaccctgttggagtacgttgggaaaggaggcgccgatgtcggggacgacctggtggtcctgttatgccacctccagtacgcctgcaagcggatcgccgccttggtagcgtcgcccttcaatgccgagctcggccgcgacggcggaggaggtgtcgcgtcgtcatcgtcttcttccaagagggacgcgcccaagccgctcgacatcgtttcgaatgacataatattggcctcgcttagaaaatctggaaaagtcgcagttatggcatcggaggaagatgatgttccagtttggataaccgatcacagcccgttcgtcgtcgttgtcgatcctttagatggttctcgcaatatcgatgtgtccatcccaactggaaccatatttggagtatacaatagacttgctgagttagaccatcttcccatagaggagaaggcacagctcaattctctgcagagtggaaaacggcttgtagctgccggttacatcttgtactcatccgccacaatcttttgtatcagctttggttctggcacgcatgctttcatgttggatcactcaaccggagagtttgttcttacgcatccatcaattcaagttcctcgccgggggcagatatactctgtgaatgatgcacgttacttcgactggcctgatgggttaaggagatacatcgacacagttcgacaagggaaggggcagttccccaagaagtactcagctcgctatgtctgctcactggttgctgatttccatcgcacgctcatatacggtggtgtggtgatgaacccaagagatcatcttcgcctggtttacgaagccaaccctcttagtttcctcattgaacatgctggtggtagaggctctgatggcaaaaccaggatcctatcgattcagccagttgagctgcatcaaaggcttccactcttcctggggagcgtggaggatatgcatgagttagaaagctatgacagcattcagcagaagattaatcccgggtatgatgtctgatgctgatagctcattgatatcgcgttgtgttttcggtatattcactgaaggttttttgtaaatgttgtacacatgtgaatttgcagtatgcaaatgagtatctcctcgatgttctacgttttgcagaacctaacgctattggcaattcctgcattcttttatcgttgtcttgtccccaattatctgataattaattgaatattttaccc

SEQ ID NO: 5471 - DNA, 1126 bp, Centaurea maculosa
agtgataccgatgggtttgttaccatctccgagtatgccggcaagggaggtgtggatgtaggtgatgatttggtggttttgtttacccatttggagtatgctttcaagagaatagctgctcttgttgcttctccggcgaactctagtctcggaataagctccggcgctggcgaagatgtggggtccggcagagatacacccaagccactcgacattgtttctaacgagatcatcttgtcgtctttaagaaactccggaaaagttgctgtgatggcttcagaagaagacgatgctcctgtttggatagcggataacgccccattcgtggtggttacggatcctctagatggttctcgtaacattgacgcttctatccccaccggaaccatcttcggaatctataatcgccttatagaagtcgatagtcttcccgtggaagaaaaggcgatgctaaattcgctacagagtggcgctcggctgatcgctgctggctacgtcctttattcatcggccaccatcctctgcaccaccttcgggtcgggctcgcatgcattcactttggatcgttcgaccggagactttgttctcacacatccaaacatcaaaattccccctcgaggtcaaatctattccgtaaacgacgctcggtattttgactggccggagggtctgaggcggtacatcgacaccatcaggcaaggcaaaggcaagtttccgaaaaagtactcggctcgctatatttgttcgttagtcgctgatttgcatagaaccctgatgtacggtggggtggcgatgaaccctcgagatcatctccggctcgtttacgaggccaaccctttgagtttcgtggtggagcaagccggtggcaaagggtccgatggtaaaaacagaatcttgtcaatccaacctgttaaattgcatcaaaggcttcctttgttcttgggaagcccagatgatattgaagagttggaaagttatggtgatgttcaacaaacagttaatcctggttatgatgtatgatattgtggtccccgcctaccactgacactaacagacgagtaaggaggtggacattcttgcagaatgtgtaatccacctgtcctgtgggatcggtatagtgggacgc

SEQ ID NO: 5472 - DNA, 1416 bp, Cicer arietinum
ttttggataaagttttcacagtatgcagtcagcaaccttctatcaacttgtaaacttccgaccaaagcttcaaactttccaatcaaaaactccgacccttttctccacccgaagaatggcttcggtttctgggttcagaagaatggccttggacggttcttcttcatcttcatccacagtagcaagtgatgatgggtttgttacattgatggagtatatgggtaagggaggaggaattggtgtgaatgatgatttagtggtgttgattgatcatttacagtatgcttgtaagagaattgcagctcttgttgcttctccttttaatcatagtattgggaaacaaacgagtcttggtgattttcccaatactggttcagatagggatgctccaaagcctcttgatattctttctaatgaaattatcttgtcatcacttcaaaaatctgggaaagttgttgtgatggcttctgaagaaaatgatacaccaacttggataagtggtgatggtccatatgtggtggtgaccgatccactagacggttctcgaaatatcgatgcatccattccaactggtacaattttcggtatttataagcgcctggaggagctagaagaccttcctacagaggagaaggctttgctgaattcactccaaagtggaaataggctgatagctgctgcttatgttctctattcatctgcaactattctctgcatcacctttggttctggaacacacgcattcactctcgaccgttcaacaggagacttcatcctcacaaatccaagcattaaaattcctccccgcgggcaaatttattcagtgaatgatgcaaggtattttgattggcctgaaggtttaaggcaatatatagatactgtgagacaaggaaaaggtagatatcctaagaagtactctgcaaggtatatatgttctcttgtggctgatctccacaggactttgttgtatggaggtgttgcgatgaatccgagggaccatcttcgtcttgtttatgaagcaaaccctcttagtttcattgtggagcaagctggtggaagagggtctgatggaaaaagtaggattctttcacttcaaccagttaaactgcaccaaagacttcctctctttttagggagtttggaagacatggaagagttggaaagttatggagatatacatcaaaaagtaaatcctggttatgaggtttgatgctatagcattgaaattttgaatgttcaatcttgaccatgcttctttacttatttatttgttgttgttctttcatctttcatctctgctgtatctattgccaaatccttcatttgtgttaatatctttctttccctttgtttttcttgggagatggttccttgctaactcgttaattatgggttaagattccctctatttctcat

SEQ ID NO: 5473 - DNA, 1027 bp, Plantago ovata
tggaaaagttgcggtgatggcatcagaagaagatgatgctccagtttggctagcagatgatggcccttttgtggttgctttagatcctcttgatggttctcggaatatcgatgcatctattcctactggaactattttcggggtctataagcggcttgttgaactggatcatttacctgtagaggaaaaggcaatgctgaattctctccaaagtggaactaagctgcttgccgcttgttatgttctctattcatctgctacaattctgtgtgcctcctttgggtcaggaacacatacttttaccctggacagatccactggagattttgttttgacacagcaaaatctcaaaattcctagtcgaggtcaaatctattctgtgaatgatgcacgttactttgactggcctgaaggcttacggaagtacattgatacagttagacaaggtaaaggtaaataccctaagaagtattcagccaggtacatatgttctcttgttgctgattttcatcgaactctcctatatggtggaatagcaatgaatccaagggatcatcttcgtctagtttacgaagcaaatcccttgagtttccttgcagagcaagcaggaggtaagggttctgatggtaaagctagaatactgtctctccagccaaacaagatgcaccagagactccccctgtttctgggtagtcctgaggatatcgaagagttggagagttatggagatattcaacagaaagtaaaccctggatatgatgtctgactgaaattgttgtttcagttactcttccagtgtttctcttatgtacttcttgagtatacttgcggtacaatatcagcttgttactgatactgagcaatcccagtctcttgttgtcacatgtaaatttgtaattgttgaaactatgtagaagaataacattttcttcttctagatggatgcaaatgctcatcgcgaagtgtcataattacgcgatcaaggcataaatccatgaagttatcttaggcagacccatgttgtagc

SEQ ID NO: 5474 - DNA, 598 bp, Amaranthus tuberculatus
cgtgtctcaggttagacaaggaaaaggccaatacccaaagaaatattcagcgcgttatatatgctcattggttgctgattttcataggactttactttatggtggagttgcaatgaatccaagggatcatcttcgacttgtttatgaagcaaacccgcttagctttattgcagaacaagctgggggaaaaggttccgatggtaaaagtaggattctttccattcaacccgtgaagttgcatcaaagactacctctattcttaggtagtcctgaagatatcgaagaattagagagttatgaagaagttcaacagaaagtcaatcccggctatgaagtatgaagggcaatacaagcctgtatcaatggtatgttccaatattttgctacatttttcttttccgcaacatctgtgcagaataaattgtttgcataaacttcctgcgcgctcagcgccaactatagtcaaataattgtttcagaaacatattatcgagtctttggcctttctgcgatctgtgtgttaagtttattacttgtgtttctctgtaaatgcaaaatgatatactttcaattgctgatattattacctgtgaattct

SEQ ID NO: 5475 - DNA, 1373 bp, Ambrosia trifida
atagaatgcaatcaccttcacccaccaccaccccatccccactacacaatctcaatctcatccacaacttcccatcaaaactaacccctcttcattccgtcccaaactcccaaccaccgtatctccaaacccatgactccactttactaaatcatttaaaatcaactcaaaacagagagcaatagtgatgcgtttgttacagtcactgagtttgctggcaaagcaggggaggatgtgggtgatgatttggtggttttgtatagtcatttagagtatgcttttaaaaagattgctgctctggttgcttctccggttaattctagtcttgggaaaagtgatggtgatggtgctgatgtggggtccggtagagataagcctaaacctcttgacattgtttctaacgagatcatcttatcttgtttaagaaactctggaaaagttgcggtcatggcttccgaagaagacgacgctcctgtatggataaccgacgatggcccatttgtggtggttacagatcctctagacgggtctcgtaatattgacgcttctatcccaacgggaaccatttttgggatttataaccggctgattgaactcgacagtcttgcagtggaagagaaggcaatgctaaactcgttgcagagtggcggcaggctcattgctgccggctatgttctttattcatcggccaccatactttgcaccagcttcggttctggtgcacacgcgttcactttggatcgtttgacgggtgactttgttctcacacatcctaacatcaagatccctcctagaggccaaatctactctgtcaacgatgctcgatattttgactggcccgagggtcttagacggtacatcgacactataagacaaggcaaaggaaagttccctaaaaagtactcagcgcgttatatctgttcattagttgctgatttccatagaactttgatgtacggtggagtggcgatgaaccctagagatcatcttcgacttgtttatgaggcaaacccgctgagttttctagcagagcaggcaggtggaaaagggtctgacggtaagcaccgaatactgtcgattcagcctattaaaatgcatcaaagacttccattgttcttgggaagcccatatgatatcgatgagttggaaagctacggtgatgttcaacaaactgtgaatcctggttatgatgtttgatatatatgatagatgacctgttttatgatgatcgaatgcgtgtttaatgtttatagtaactaataagaagaaaagatgtaaattgttatacggttaggcatgttaacttggtatttttttggtacgttttgatgtttatgatctagtaagtactctcttagacttctcttaaaaaa

SEQ ID NO: 5476 - DNA, 317 bp, Arnica chamissonis
gctgatttccatagaactttgatgtatgggggagtggcgatgaatcctagagatcatctacgacttgtttacgaggcaaacccgctcagtttcttgccgagcaagcgggtggaaaagggtctgatggtaagaagcgaattctgtctattcagcctactaaattgcatcaaagacttccattgttcttgggaagcccggatgatatcgatgagttggaaagctatggtgacgttcaacaaacggtaaatcctggttacgatgtatgatatgataaacgtgttgttttatgatcgtagcgtgtgtgtatatatatgtgt

SEQ ID NO: 5477 - DNA, 1485 bp, Phaseolus coccineus
tgaaattttctgaaatgaaaatatttcatcattagataacttttgacattatgcagtcagctgtaaggccaccactctatcatcttgtaagcttaagaccaaagcttcaaaaattttcatcaaaatctcaactttgtgccttggggacccctttctgcagactaagaatgacttcagtttctgggtctgagctaagaccccttagagctgtgggtggttcttcttcatcttctggaggtgatgatgggtttgtgacactgttagagtatgtggggaaggaaggaatacacgtgaaggatgatttggtggtgttgcttgatcacatacagtatgcttccaagagaattgcagctcttgtggcttctccttttaattacagccttggcaaacaaaccggttttgactctgttggttccgatagagatgctccaaagcctcttgatattctctcgaatgaaattatcttgtcatcactccgaaaatctggaaaagttgctgtcatggcttctgaagaaaatgatgagccaacttggataagtgaggatggtccatatgtggttgtaacagatcccctggatggttctcgaaatattgatgcatccattccaacaggcacaatttttggtatttataagcggcttgaggaactagatgatctaccaatagaggagaaggctatgctgaattcactccagagtggaagtaggttgattgctgctgcctatgttctctattcttctgcaactatactctgcatcacctttggttctggaacacacgcattcactcttgatcattcaacaggagactttattcttacaaatccaagcattcaaattcctccccgtgggcaaatttattcggtgaatgatgcaagatattttgactggcctgaaggtttaaggcaatatatagacactgttagacaaggaaaaggtagatatccaaagaagtactctgccaggtatatatgttctctggtggctgatctccacagaactttgttgtatggtggtgtggcaatgaatccaagggaccatcttcgtcttgtttatgaagcaaaccctcttagtttcattgtagagcaggctggtggaagagggtctgatggtaaacatagaattctttctcttcaaccatataaacttcatcaaagacttcctctttttttggggagcttggaagacatggaagagttagaaagttatggggatatccaacagaaagttaatcctggttatgaggtttgatgctgtgtacatgcaaccaagttttgaatattcaaccatcattgtgcctgatcaagtgactaattgttccactgttcttcacttatgttatatgtacttcgttatccatcatctgtgttaatatatctttaatatctgatcatacttgtgctctaatataaataaaattctctgtcaaatagattgcaagagaaaatggatagaaatctttttgctttgttgaatgtttggattc

SEQ ID NO: 5478 - DNA, 393 bp, Phaseolus coccineus
ctctgccaggtatatatgttctctggtggctgatctccacagaactttgttgtatggtggtgtggcaatgaatccaagggaccatcttcgtcttgtctatgaagcaaaccctcttagtttcattgtagagcaggctggtgggagagggtctgatggtaaacatagaattctttcccttcaaccatataaacttcatcaaagacttcctctttttttggggagcttggaagacatggaagagttagaaagttatggggatatccaacagaaagttaatcctggttatgaggtttgatgctgtgtataccatcatgcaagcaagttttgaatattcaaccatcatggtgcctgaccaagtgactaattgttccagtgttcttcacttatgttata

SEQ ID NO: 5479 - DNA, 509 bp, Cirsium arvense
aaaattcctcctcgaggtcaaatctattcggtaaacgatgcccgatattttgactggccggaggggattaaggcgatatatcgacaccataaggcaaggcaaagggcagtttccgaaaaaatactctgctcgttatatttgttcgttagttgctgatttgcatagaactctaatgtacggtggagtggcgatgaatcctcgagatcatcttcggctcgtttacgaggctaaccctttgagttttgtggtggaacaagctggtgggaaagggtctgatgggaagaacaggatattgtcgattcaacctgttaaattgcatcaaagacttcctttgtttttgggaagcccagatgatattgaagaattggaaagttatggtgatgttcaacaaacagttaatcctggttatgatgtatgatacctggtatccgaccagtgcccagatcactgggcactggtctgttggcaggtaaggaggtggacattctggcagaataattaataggttt

SEQ ID NO: 5480 - DNA, 1528 bp, Citrus sinensis
  misc_feature (317)..(317): n is a, c, g, or t
  misc_feature (363)..(363): n is a, c, g, or t
  misc_feature (374)..(374): n is a, c, g, or t
  misc_feature (1288)..(1288): n is a, c, g, or t
  misc_feature (1325)..(1326): n is a, c, g, or t
  misc_feature (1329)..(1329): n is a, c, g, or t
tatcaatcaaaaagatgataaaatagttacaatccatctaaattctgaacccaataacacataacatgcaatcatccaccattactttatatcaaactcccattttccagccaaaattcagcagtttcccgccaaaaaataaccaccaccaccagcagcagcaatttcttgtgagaaccaatttgctgatcagtccaaaaatggcttcttcttcttcttcactttctgggtattttccaattcgttcacagaaggctgattcattgagcgttgtcaatgatgaagcaaatggctttcccacgttgatggattatgtnggcaagggagggctcaatgtgggggatgatttggtggtcctgcttncccatcttcantatgcttgcaagagaattgcagctcttgtggcttcgcctttcaactccagccttgctaagcatatgggtggttcagctgctggtgggtctgctgagtccggcagggatgttgctaagccgcttgatatagtctccaatgaaatcatattgtcctctcttcggagttctggaaaagttgcggtcatggcttcggaagaagatgattcgccaatttggataaatgatgatggcccatttgtggttgttacagatcctcttgatggttctcataatatagatgcttccatacccactggaaccatatttggggtctataatcgccttgtggagctagatcatttagctgacaaagagaaggcactcctgaactctctgcagagtggaagtcggctggtagctgctggatatgtcctctattcatcagccacgatactctgtgctagctttgggtcaggaacacatgcatttacattagaccattcaacaggggactttgttctgacacatccaaacataaagattcctcctcgagggcaaatatactctgtaaatgatgcacggtattttgactggcctgagggtttaaggaaatatattgatactgtgagacaaggcaaaggcaaaaaccctaagaaatattcagcccgttatatatgttctttggttgctgatttccatcgcactctgttgtatggcggagtggcaatgaatccgagagaccatcttcgattggtgtatgaggcaaatcctcttagtttccttgctgagcaagctggtggcaaaggttctaatggcaaaagtaggattctttcaattcagccggtccaggttcaccaaaggctgcctctgtttcttggaagttcagaagacatggaagagttagagagttatggagatgttcaacagaaagtganccctgggtatgaagtttgatctatgttttgtttatgnncangttcttgttagtttcttcaatgatattttcaagcaagactaggaatgcacaaaatctttctggagaaaaagaaaataaactcagatgccagaattttcagaatgcgaagcatgtaccatatctattaacaataagagaatcatttgaagaacaacccgaaatttcaacaaatattaatgttcaaagatcctgtttgcta

SEQ ID NO: 5481 - DNA, 701 bp, Cynara scolymus
  misc_feature (687)..(687): n is a, c, g, or t
cggggatattcgaccggagacttcgttctcacacatccaaacatcaaaattcctcctcgaggtcaaatatattcggtaaacgacgcccggtattttgactggccggagggtctgaggcgatacatcgacaccatcaggcaaggcaaaggcaagtttcctaaaaagtactctgtacgttatatatgttcgttagtcgctgatttgcatagaactctaatgtacggtggagtggcaatgaatccacgtgatcatcttcgactcgtttacgaggcaaaccctctgagttttgtggtggagcaggctggcggcaaagggtccgatgggaagaacagaattttgtcgattcaaccggttaaactgcatcaaagacttcctttgtttttgggaagcccagatgatattgaagagttggaaagttatggtgatgttcaacaaacagttaatcctggttacgatgtatgataccctggtcaccgaccagtacaagtggtagtggccgtgacctgacaggcattatttgagaagatggagggtttgacgatgatgatgctgcttggtagagagagtttaatagtttgtgttgttgtaaatttttctaagattatggaggtatatataccaaaataccgaggcgacaacttaataccgatgtgacaactcaatactcaggtaataaatttttattangtattttgtgatca

SEQ ID NO: 5482 - DNA, 1106 bp, Euonymus alatus
tttcggttccagtctttgcaaacaaactactctcagtggcggtgggggaaatggcagggatgctccgaagccactcgatatcgtctcaaatgaaatcatcctctcatcccttcaaaattctggaaaagtcgccagtatggcttcggaagaggatgatgctccagtttggataagtgatgatggaccatttgtggtggttttggatccccttgatggttctagaaatattgatgcctcgattcccacaggaactatatttggcgtttatagacggctggtggagctggatcatctaccgcgagaggagaaggctacacttaattcactgcagactggaactagtcttgttgctgctggatatgtgctctattcatcagccacaattctctgtatcagcttcggttctggaactcatgcttttacattggatcgttcaacgggagatttcattttgtctcatccaagcattgaaattcctcctcgggggcaaatctattctgtaaatgatgcacgatattttgattggcctgaggggttaaggcgatacatcgacacggtgagacaagggaaaggcaggtacccaaagaagtactcagcccggtatatatgctctcttgtagctgatttccaccggaccctgttgtacggtggagtagccatgaatccaagggaccatcttcgcctagtttacgaggcaaatcctcttagttatctggtggagcaggctggtggcaaaggctctgatggtaaatgcagaattctttcaattcaaccagataagcttcatcaaaggcttcctctattcctagggagctcagaggatatagaagagttggagagttatggagatgttcagcagaaagtgaatcctgggtatgaagtttgatgcgaaagtgattcctgtctaatgactgtgatttgaatccatagaagccataagatgctaataccaagatcacaaagattaattcctcttatcagtatggattcttcaatggagccatgaaaacattgtctatatatgaatgttgtaccaccaattttattgcctgtaattaagtaccgctgtaacatatttatataaagatatgttaatcataattaac

SEQ ID NO: 5483 - DNA, 523 bp, Fagopyrum esculentum
ccggagttcattctttcacattggatcattcaactggagattttgttctcacacaaccaagtctgaaaattccatcccggggacaaatatattcagtgaacgatgctcggtatttcgactggcctgaaggtttgaggcggtatatagacacggtgagacagggcaagggaagatacccggagaaatactctgctcgttacatatgttctctggttgctgattttcacaggactctaatgtatggaggagtagccatgaatccgagggatcatcttcgactagtctacgaagcaaatcccttgagtttcctagctgagcaagctggggggaaaggttctgatggtacaagacggattctttcgaagcagccggttaagctacaccagagattgcctctattcttgggaagtcctgaagatattgatgagcttgaaagctatggtgatgttcaacagaaattcaatcctgggtataatgtatgatgatttataagcttcatgttttgtgatgtagttatttactc

SEQ ID NO: 5484 - DNA, 801 bp, Orobanche aegyptiaca
atgctccggtttggctttccgatgacggcccgtttgtggtggtttttggatccacttgatgggtcccgaaatatcgaggcctctattcctaccggaacaatattcgggatatataaacgtctttttgaacttgattatctgccgaaagaggaaaaggcgactcttaattccctccagagtgggactaagcttatagcttctgcttatgtcctttattcgtcggctacgattctgtgtaccacctttggatcgggagcacatgctttcacacttgatcgttcgaccggagactttattctgacacatccaaacgttaaaattccccctcgagggcaaatatattccgtaaatgatgctcgttatttcgactggccggatggcttaaggcaatacatagacaccatcaggcaaggcaagggcaaaaatcctaaaaagtactcggctcggtatatatgttctctcgtagccgattttcaccgcacgatcttgtacggtggggtcgcgatgaatccaagggaccatcttcgtcttgtttacgaagctaatccgttaagtttcttagccgagcaagctggaggcaaagggtccgatggtaaagttagaatattgaaccttcaacccgtgaggctgcaccaaaggcttcctttgtttctagggagtcgggacgatatcgaagagttggagagctatggagatgttcaacaaaaagtaaaccctggatatgatgtctgaaaatgtagtagtttaagttttttgatttctaaattatgtggttgtaatatatggtataaatatatatgt

SEQ ID NO: 5485 - DNA, 1615 bp, Arachis hypogaea
gtgatttatctaccaccgaaactgtatcaaaggataacactttgatgaagctcagataaccgtacataatatgcagtcagcatcaacaaccttgtaccaacttcccagtctccggggaaagtttcaaactttactatcaaaagctcaactttttccagtgagctatttttgcagaccaagaacaaggccttcagtttctgggtcggggatgagatcagtgattgccttaagtggttcttcttcttcgtatgcagttgatgatgggtttgttacactgatcgaatatgtgggcaaaagaggaataaatgtggaagatggtttggtggtgttgctcgatcacatacaatatgcttgcaagagaattgcaactcttgtggcttctcctttcaattccagccttggcaagcaagagggtattggtgctgcttctggttcagatagggatgctcctaagcctcttgatattgtctcgaatgaaattatcttatcatcactgcaaaagtctggaaaagttgctgttatggcttcggaagaaaacgatgcaccaatttggataagtgacgatggtccatacgtggtggtaacagatccccttgatggttcacgaaacattgatgcatcaattccaactggtacaatctttggtatttataagcgccttgaggaactagatgatctacccactgaggagaaagctatgctgaattcgctccaaagtggaagtaggctggttgctgctggatatgttttatattcatctgcaactatactgtgtaccacctttggttccggatctcagacattcactcttgatcattcaacaggagactttatcctcacgaatccaagcatcgaaattcctcgccgtgggcaaatttattcggtgaatgatgctcggtattttgattggcctgaaggattaaggcggtatatagacacaattagacaaggaaaaggtaaatatccaaagaagtattcagctaggtatatatgttccctggtggctgatctccaccgaactttgatgtatgggggcgtggcaatgaatccgagggatcatctccggcttgtgtacgaagcaaaccctcttagtttcattgtagagcaggctggtggaagaggatctgatggcaaaaatagaattctttcccttcaaccagttaaattgcaccaaaggcttcctctattcttggggagtttggaggatatggaagagctagaaagttatgacgatgttcaacaaagagtgaatccaggttatgaggtttgataatgtggcacaaaagttttcaacattggtgtaaatccaatctgcttcaggaattgtgatgcaaatatatttttcccttctcttgctattcacttttcttgactctgcttccttgagatgcatatggacactgcttacaacactgtagggatataaattaatatgtcatctatcatcttatttgatctgttttggtctttggcttggtttaagtagcagagtttggtgaaactatatcattcagcaatagcaataaatattgcatggtatgatattataatttagcagaaaacttacaatattacaagaaaaaaacctagtaatctaaatgaatgcgtcgtcatt

SEQ ID NO: 5486 - DNA, 1450 bp, Cajanus cajan
cattctgatcaaatccattggataacttttcacattatgcagtcagctgccacaccaccattctatcaactcgtgagcttcaggccaaagcttcaaacttttccatcaaaatctcgactttgctccttagggacccctttctgcagactaagaatggcttcagtttctgggtttgggctgagacccctaagggccttgggtggttcttcttcatcttctgcaagtgatgatgggtttgtcacatttatagagtatgtgggaaaggaaggaatgaatgtgaaagatgatttggtggtgttgcttgatcacatacagtatgcttgcaagagaattgcagctcttgtggcttctcctttcaattacagccttggcaaacaaactggtcttgcatctgttggttccgatagggatgctcctaagcctcttgatattgtctcgaatgaaatcatcttgtcatcactccaaaaatccggtaaagttgctgtcatggcttcagaagaaaatgatgaaccaacttggataagagacgatggtccatacgtggtagtaacagatcccctagatggttctcgaaatattgatgcatcaattccaacgggtacaatttttggtatttataagcgccttgaggaactagataatctacccactgaggagaaggctactctgaattcactccagagtggaagtaagctgattgctgctgcctatgttctctattcttctgcaactatactctgcatcacctttggttcaggaacacaagcattcactcttgatcattctaccggagactttgttctcacaaatccaagcattaaaattcccccccatgggcaaatttattctgtaaatgatgcgcgatattttgactggcctgaaggtttaagacaatatatagacactgttagacaaggaaaaggtagataccccaagaagtactcggccaggtatatatgttctctggtggctgatctccacagaactttgttgtatgggggtgtggcaatgaacccaagggaccatcttcgtcttgtttatgaagcaaaccctcttagtttcattgtagagcaggctggtgggagagggtctgatggcaaaaatagaattctttcccttcaaccagttaaactgcaccaaagactccctctctttatggggagcttggaagacatggaagagttagaaagttatggggatatccaacaaaaagttaatcctggttatgaggtttgatgctgtgtacatcatgcatgcaaaattttgaatattcaatgcttcaaccttcatggtgcctgactaattgttccagtgttcttcacttgtgttgtatgtactgctttatccattgtgttaatatagctttaattctctgatcaaactcatgctctcataaataaaaattctctttcaataagattgtatatgaaaagggatacaaatgtttttg

SEQ ID NO: 5487 - DNA, 1521 bp, Cajanus cajan
aaagtgcttgaagtatctgccactgaaattgtctgaaatgaaaacattctgatcaaatccattggataacttttcacattatgcagtcagctgccacaccaccattctatcaactcgtgagcttcaggccaaagcttcaaacttttccatcaaaatctcgactttgctccttagggacccctttctgcagactaagaatggcttcagtttctgggtttgggctgagacccctaagggccttgggtggttcttcttcatcttctgcaagtgatgatgggtttgtcacatttatagagtatgtgggaaaggaaggaatgaatgtgaaagatgatttggtggtgttgcttgatcacatacagtatgcttgcaagagaattgcagctcttgtggcttctcctttcaattacagccttggcaaacaaactggtcttgcatctgttggttccgatagggatgctcctaagcctcttgatattgtctcgaatgaaatcatcttgtcatcactccaaaaatccggtaaagttgctgtcatggcttcagaagaaaatgatgaaccaacttggataagagacgatggtccatacgtggtagtaacagatcccctagatggttctcgaaatattgatgcatcaattccaacgggtacaatttttggtatttataagcgccttgaggaactagataatctacccactgaggagaaggctactctgaattcactccagagtggaagtaagctgattgctgctgcctatgttctctattcttctgcaactatactctgcatcacctttggttcaggaacacaagcattcactcttgatcattctaccggagactttgttctcacaaatccaagcattaaaattcccccccatgggcaaatttattctgtaaatgatgcgcgatattttgactggcctgaaggtttaagacaatatatagacactgttagacaaggaaaaggtagataccccaagaagtactcggccaggtatatatgttctctggtggctgatctccacagaactttgttgtatgggggtgtggcaatgaacccaagggaccatcttcgtcttgtttatgaagcaaaccctcttagtttcattgtagagcaggctggtgggagagggtctgatggcaaaaatagaattctttcccttcaaccagttaaactgcaccaaagactccctctctttatggggagcttggaagacatggaagagttagaaagttatggggatatccaacaaaaagttaatcctggttatgaggtttgatgctgtgtacatcatgcatgcaaaattttgaatattcaatgcttcaaccttcatggtgcctgactaattgttccagtgttcttcacttgtgttgtatgtactgctttatccattgtgttaatatagctttaattctctgatcaaactcatgctctcataaataaaaattctctttcaataagattgtatatgaaaagggatacaaatgtttttgctcttataaaagttcatattcttttca

SEQ ID NO: 5488 - DNA, 1027 bp, Plantago ovata
tggaaaagttgcggtgatggcatcagaagaagatgatgctccagtttggctagcagatgatggcccttttgtggttgctttagatcctcttgatggttctcggaatatcgatgcatctattcctactggaactattttcggggtctataagcggcttgttgaactggatcatttacctgtagaggaaaaggcaatgctgaattctctccaaagtggaactaagctgcttgccgcttgttatgttctctattcatctgctacaattctgtgtgcctcctttgggtcaggaacacatacttttaccctggacagatccactggagattttgttttgacacagcaaaatctcaaaattcctagtcgaggtcaaatctattctgtgaatgatgcacgttactttgactggcctgaaggcttacggaagtacattgatacagttagacaaggtaaaggtaaataccctaagaagtattcagccaggtacatatgttctcttgttgctgattttcatcgaactctcctatatggtggaatagcaatgaatccaagggatcatcttcgtctagtttacgaagcaaatcccttgagtttccttgcagagcaagcaggaggtaagggttctgatggtaaagctagaatactgtctctccagccaaacaagatgcaccagagactccccctgtttctgggtagtcctgaggatatcgaagagttggagagttatggagatattcaacagaaagtaaaccctggatatgatgtctgactgaaattgttgtttcagttactcttccagtgtttctcttatgtacttcttgagtatacttgcggtacaatatcagcttgttactgatactgagcaatcccagtctcttgttgtcacatgtaaatttgtaattgttgaaactatgtagaagaataacgttttcttcttctagatggatgcaaatgctcatcgcgaagtgtcataattacgcgatcaaggcataaatccatgaagttatcttaggcagacccatgttgtagc

SEQ ID NO: 5489 - DNA, 324 bp, Scabiosa columbaria
ctgttagacaaggcaaaggcaagtacccaaaaaagtattcggctcgatatatttgttctcttgttgctgattttcaccggactttgttatatggtggagtggcaatgaatccaagggaccatcttcgacttgtttatgaggcgaacccgctgagttttcttgtggaacaagcagggggcataggatctgatggtaaaagtagaatcttgtcgattcagcctgtagaattgcaccaaagactacctttgtttttggggagttcagaggatattgaagagttggagagttatggggatgttcaacagaaagtaaatccgggttatg

SEQ ID NO: 5490 - DNA, 1484 bp, Nicotiana tabacum
  misc_feature (742)..(742): n is a, c, g, or t
  misc_feature (799)..(799): n is a, c, g, or t
  misc_feature (1005)..(1005): n is a, c, g, or t
  misc_feature (1215)..(1215): n is a, c, g, or t
gctcaatagtcatatgaatgagctgccacatagcagagagatagagatgctatcatcaaccatttcttccctaaatttgccaccaagaacccaactttcctcctcaaaccctccatttttccctcaaagatacaatcttgcacctttccacaatatgacatcttctccattttctggagggttaattaacttgagggtaaattcaccaactgcaattggcagtaaaagagattctgtaaatagtgggttttatacattgatggagtacatgggcaaagacggagcggctgatgacttggtattgttgtttggtcacttagaatatgcctccaagaaaattgcagcacttgttgcttcccctttcaattccagcctcagcaagaatattgttggcactgagacttcttcttctgatagagataagcctaagcctcttgatttagtctcgaacgagattatattgtcgtctcttagaaattcaggaaaagttgctgtaatggcctcagaagaaaatgagggtcctgtgtggataactgatgatggaccctttgtggttgtcatggatcctttagatggttcccgaaatattgatgcctcaatacccacagggacgatatttgggatttacagacgtcttatggaaattgatcatcttccagtagaggaaaaggctttgctaaactgccttcagagtggagcaaagcttgttgctgcagcttatgttctctattcgtcagccacnatactctgcaccagttttggttctggaacgcatgcattcacattggagcatacaacnggagatttcctcttgacacatcctaacatcagcattccacctcgagggcaaatttattcagttaatgatgctcggtattttgactggcctgaaggtttaagacagtatattgacaccataagacaagggaagggaaaacatcctaagaagtactcagccagatatatatgttctctagtggcagattttcatcggactcttttatntgggggagtggcaatgaatccaagggaccaccttcgtcttgtttatgaagcaaatcccctgagtttcttagcggaaaaggctgggggtagaggttcagatggtaaaaacagaattttatctattcagcctgtcaagctacaccaaagacttcctctatttttgggtagtccagatgatatagaagaattacagagttatggggatgttcngcagaaagtaaaccctggttacgacctttaataccttggtcatctttcatgcatttcagactttgttcttgtacagctcatctctctttcacgtgtaaattttttccttaggcagttcttagctagcagatatgctcttcgctggaataaacatgtgatttctttacttagtcttgaagattttcacatgatgaacttcatgtatctttaaagcaccttaaacttttaaagaaatttactgtaaattttgtttggatagcggccgcatg

SEQ ID NO: 5491 - DNA, 1433 bp, Tragopogon dubius
aacgaaatcaattcagaagatgttccctttcaattccaccacccatcacttgaaaaccccaccgccatagaatgcaatcacccaccaccatcacagccacaatacatacttcccatctcacccctactttcctaacaaaattcccgccaaacccacttcgcatccgcccggaattcttcgaccgccgtagcagtacaagtatggcgtcttcttttgctaggtttaagctcaattcgaaaacggacaccagtagtgatgggtttcttactctcaccgagtacgccggcaatggaggagcaaacgtaggtgacgatctggtggttttgtttagtcacttggagtacgcgttcaagagaattgcagctctcgttgcttctccgatcaattccagcctcggaaaaagctccggcggtggtggggatgtggatgccggtagagataaacccaagccgctcgacattgtttccaatgagatcatcttgtcttctttaagaaactccggaaaagttgcagtaatggcttccgaagaagatgatgctcccgtttggataaccgacaacgccccatttgtggtggttacagatcctctcgacggttctcgtaacatcgatgcttcaatccccaccggaaccatcttcgggatctacaaccggttaatcgaactcgataatcttccaccggaggagaaggcgctgctaaattctctccagagtggatctaacctcatcgccgccgggtacgttctttactcctccgccaccatactctgcaccacattcggttccggcgcccacgccttcactctcgatcattccaccggagacttcgttctcacacacccagacatcaaaatcccacctcgaggtcaaatctattcagtaaacgatgctcgatactttgactggccggagggtttgaggcgatacatcgacacgattagacaagggaaagggaagttcccgaagaagtattcggcgagatatatttgttcgttggttgctgatttccatagaactttgatgtacggtggagtggcgatgaaccctagagatcatctccggcttgtttatgaggcgaatccgttgagttttgtggcggagcaagccggcgggaaaggatctgatgggaagaacaggattctggggattcaaccggtgaagctgcatcaaagacttccgttgttcttgggaagtccagatgatattgaagagttggagagttatggtgatgttcaacaaacagtaaatcctggttatgatgtataagattactttttaacgatggctaaggagtgtaaatgtgtaatgtagttaagttggatcgattattgtataataacgagttttacaatgctcgtgcgttgcgtcaagtatgctcaccggaaatcattatcattcggtagaccgcctctataaacccttaatttgagagac

SEQ ID NO: 5492 - DNA, 726 bp, Triphysaria pusilla
gcgttcacacttgatcgctcgaccggagactttattctgacgcatccgaacattaaaatcccacctcgagggcaaatatattctgtaaatgatgctcggtatttcgactggcccgaaggcctaaggcagtatatagacactattcgacaaggcaagggcaaatatcccaaaaagtattcggccagatatatatgttcccttgttgctgatttccaccgcactctcttatatggtggcgtcgcgatgaatccgagggatcatcttcggctcgtttatgaagctaatccactcagcttcttggccgagcaagccggaggcaaaggatcggacggtaaagttcgaatattgaatctgcagcctgtaaagctgcaccagaggctttctttgtttttagggagcaccgatgatatcgaagagttggagagttatggagatgtacaacaaaaagttaaccctggttatgatgtctaaaagagaatggactcgagctgttgaatagttttgaagggtaaaatagtaaatatgcataatgggttgtaataaaagaatgtgattcaggttttgtaacacgggtttctcgttgtcttcgggtttcgtggagggatcaggtggttttatgtactgctctgggttgtatgttgttttgtggacttcggctcgtcgggtaagccaacttctacatatttggcttttggaaaatcaatggtattttttgtttttgctttt

SEQ ID NO: 5493 - DNA, 721 bp, Triticum aestivum
attggtacccgtttcctcggagtgaagacgtcatgggggatcgaggtttggctattggacggccccctgagagctgcatcaatgcgcccgaggcagattgggcagtgatatgcgcgtatttgagggccggaggctgagagtacttgaaggatcagaccaggcaagggcagcatctcacgagtactggggcggtacgtgtggcgctggctgctgattgtcatcgggcgatcatatatgtggactcgcaatgaacccaaggatcacttcgttgcgtgaaggggggaagcctctcagtttcgttgccgagcaggcaggggggcgaggctcaggtggcaagaccagatcctctccattcaacctgtgaaggtgcaccagaggctgccattgttcgtggggagcatggaggacatgcttgagctagaaagctatggagatggccagcagaagggcaatcctggatacgatgtttaatgttatgcgtgaggtgaaatcttcaggtattgtaatgaggtaaccgatgtagggcaaaatctacatttgcaagcacaatattgtctctgtatttatttatttatgccaccttgcctaggcaattgcagagtactgcatagtggaggttagaagaatttgctgtagttcactgaaaacaaaatatgcaatatggctattttactttttgtaacttctatacattttactctcaagaatatataacttaaat

SEQ ID NO: 5494 - DNA, 1538 bp, Elaeis guineensis
gtgctgtgcctctgcctccccgtcctatcacgtttccatcgcacggaaatgggcagtaccatcgccaccattcctaccccatccgccctcgctcaatagcctcagcgatgcaatcctccttcctcctcccaacccccatcgcgaattcgaattccccgccatctctctccctccgtttaccgccaccgagcacccggaccttctccttccctaccggccttggtctcttctctgtcggtggccgaacgaggaggcagctctcctccctgagggccaaacccaagatggatttatcgggcggcagaggccaccggacccttttggagtacgccgggaagggaggagccgacgtgggcgacgacctcgccgtcctcctcgcccacatccagcacgcctgcaagcggatcgccgcagtggtcgcttctcccttcaatgctgagctcggccggcacggcggcggcggcggagatgggtcgttgtcttcagggagggacgctcccaagcctctcgatatagtttcgaatgacattttattctcctcactccaaagctctggaaaagttgcagttatggcatcggaagaagatgatgttcccatttggataactgatggtggcccatttgtcgttgttactgatcctctagatggttcccgaaatatcgatgtctccattccaaccggaaccatttttgggatctataataggcttgcagaattggaccatctgcctgtggaagagaaggcacagctcaattctcttcaaagtggtaatcggcttgttgctgctggctatgtgttatattcatctgctacagtattatgcattagctttgggtctgggactcatgcattcaccttggatcgctcaactggagaatttgttcttacacatcccagcatacaaattcctcgtcggggacagatatattctgtaaatgatgcacgatacttcgactggccagatggtttaaggcaatatattgatactatcagacaaggcaagggacagttcccaaagaaatattcggctcgctatgtctgttcgctggttgctgattttcaccggactcttatttatggtggggtggtaatgaatccaagagatcatcttcgcctagtttatgaggcgaatcctcttagtttcctcgtggagcatgctggaggcagaggttctgatggtaaatctaggattctttcaatccagccagttgagctgcatcaaaggctgcccctgtttttgggaagtctggaggatatgcaagaattagagagctatgacaatgtccaacagaagattaatcctggatatgaagtctgatgctgataaatccgttgtgaccattacaagtgatgtttgttacatgaggtggcttgcttacttttgctatcttcaaaagattatgagtgaaaactcctaaagttataagtatctgtagtctgcaattcaacatttgtttcttcattattctcgatttcgtagctttccagtttatgcaaatgtatgattgtacatatgtcagattaaattttaacctcc

SEQ ID NO: 5495 - DNA, 1068 bp, Cleome gynandra
ggaggaatgtgaataatgatcttgtggtgctcatgtaccacatacaacatgcctgcaagaaaattgcttctcttgtggcttctcctttcaactcttctctcgggaaacaggttcttaactccagtgatggatctggtggatcgggtcgagatgctcctaaaccacttgatattgtgtcgaacgatatcatcttatcatctcttaaaaactcggggaaggtagctgtaatggcttcagaagaggatgacagtcctgtctggataaaggatgacggcccctacgttgtggttatagatcctctagatggttccaggaacattgaggcttctatacccacaggaaccatattcggcatatacaatcgtcttgtcgaacttgattatttacccgtagaggagaaagcacagctcaattctctacaaagaggcaacaggctagtggcttctggatatgttctatattcttccgccaccatcctctgccttagtcttggctctggaactcacgccttcacgcttgatcattccaccggagagtttgttcttacgcatcagaatatcaagattcctccccgtggacaaatctattcagtcaacgacgcaaggtactttgattggccggaaggtttgagaaagtatattgacactgtgagacaaggcaaaggccagaatccaaagaaggactctgcacgatatatatgttctttggtcgctgaccttcacaggactctcctttatggtggcatagcgatgaaccctagagatcatcttcgattggtgtatgagggaaacccattggcctttcttgtagaacaagcaggcgggagagcctctgatggaaaaagtgggattctttcaattcagcctgtgaagctccatcagagactgcctctatttcttggcagcgtcgaagatgtgattgaattggaaagctatggagatgttcaacagacagtgaatcccggttacgatgtttgaaatgttgagttttatcatgttcaattgtaatacaatgtataaatataatgatagatgttaaatattaagatgatgctattgtggtaacaaa

SEQ ID NO: 5496 - DNA, 825 bp, Linum usitatissimum
ctaaggcgttatatcgacacagtgaggcaagggaaaggaagatatccaaagaagtactcagcccgctacatatgttctctagttgctgatttgcatcggacgctgctgtatggtggaattgcaatgaacccaagggatcatcttcggcttgtttatgaagccaatcctctcagctttctggtggagcaagctgggggaaaaggttccgatggtcgaagtaggatactttccctccaacctgtgaagctgcaccaaagactccctttattcttgggaagtccggaggacatagaagagttagagagttatggggacgtacaacagagagtaaatcctggttatgaagtttgaacacaacttgctaacccgaaactgatgcatgctcaagatctttgatgaactttgctttaatttgctactttccctgtccatgcctagttcgattgctcaacaatcagcggctggcgaggatggccaatggggtgtgattgcgattcagtttgagttatgttttatggtgctgcaacggctgtttcagtagcattaggttgtcttccaagacatggaagcattcagaagagagtcttgttagatttgcagttcacaggagctccaatggcgtaacctgcttcagtattcgttacaggaccataaggtttgcaagaaccaaagtctctatgtattggatgctctcccccatcatgtacagaataaggaagctctagctacaatagaattgtctgttcattattgacatgttgttctggttgtttggttcacattctgttttaatatctgaaataaatttgacctcttttttatatt

SEQ ID NO: 5497 - DNA, 1798 bp, Phalaenopsis aphrodite
aggaatcctccgatatcccgtacggttaccttgccttcctcgctcaagaggcgtgtgcaatgcatatcttccttattccaaaccccagcacaactctgaatttaccgccttctctgtgcaatgtcgtcccgtttcgctcaagcttctgcaccaccatcatcggtgcaactgccagctctcgtcttccgacagtgaaacccatatcgccgtgcctgaatgcggtaaggtctgagatggctcttcttgatgaaaaacgctcatataccatgatggagtatttggggaagacaggggccgacctcggtgacgatttggccatcttgatcgtccatcttgagtacgcctgcaaacgaattgcagcgttggttgcttctcccttcagcagcgaagttggcagaaggccggtccatggagaatttgggttgtcatcttctggcagggacactcccaaacccctcgatctagtctcgaacgatatcatattatccgcacttaaaagctctggaaaagttgctgtcatagcatcagaggaagatgatcttccagtttggattactgatgatggaccatttgtggttgtagctgaccctcttgatggttctcgtaatattgatgtttctattccaactgggacaatatttgggatctacaacaggcttgaagaattggatcacctccctattgaagagaaagcacagcttaatgccctccaaagtgggaatagacttgttgctgctggctatgttttatattcatctgctaccattttatgccttagttttggatcgggaactcatgctttcactttggatcgctcaactggtgattttgttctcacacatcccttcatgagaattccacctcgggggcaaatttattcagtgaatgatgcacgatactttgactggcctaatgggttaaggcaatacattgacactattagacagggtaaagggcagtttcctaagaagtattctgctcggtacatttgctcacttgttgctgatttccatcggacccttatatatggagggatagcaatgaacccaagggaccatcttcgcttagtttatgaggcaaatcctcttagttttcttgttgagcatgctggaggcaggggatctgatggcaaaacaaggattctttcaatccaaccagttgagttgcaccaaaggcttccccttttcttagggagtttggatgacatgcatgaactagaaagttatgataatattcagcagaaagttaatcctggatacgaagtttgattattaatgaataattttgatccatataagaagggaagtgtattgccggaagttttccgcatggattgggctaaagctaaatttcaatgcaatgaattctgttggatattttttttgaatctaaaagttgcttcatcatttcagcagtcgatcgactcatctactttatcctatatcttgtatttttttttcctgttgaacaaagtgttattttttagaaaaaatgaattcgaaacttttgcaaatagtgaagccaaattttgcaaactttagttgtgaaatattagttttacaatgctgccagatgccataggaaaatgatggagtttggttttatttgtatcaatggttccaagtggctggctattttctcaacatcgagcctatcttagaagagccatcaattcaacgttaatgggtcttcacttccccaacctactagttttgttaagtctttgacgtaagggtgaaagtaagttaactagttaagtttcaattaatacctaaagtatacaaagtttcgaccttag

SEQ ID NO: 5498 - DNA, 475 bp, Valeriana officinalis
acgatactttgactggcctgaaggcttaaagcgatacatagatacagttaggcaaggaaaaggcgaaaacccaaagaaatattctgcacgttacatttgctctcttgttgctgattttcatcgaactttactatacggtggaatcgcgatgaatccgagggaccatctgaggcttgtttacgaggcaaatcctctaagttttcttgtcgaacaagcaggaggcaaaggctctgacgggaaaaccggaattttatctattcaaccagtgaaactgcatcaaagattgcctttgtttttggggagttcaaaggatattcaagagttggaaagctatggagatgttcaacagcgaataaatcccggttatgaggtttgaaaatgattttgtatgcttgtatttgtgttttgtatgtctttgttcaacttgtaaattctatccttgtatcttatttctcggattctttctctcaagcaa

SEQ ID NO: 5499 - DNA, 688 bp, Pseudoroegneria spicata
gtgcgggaacccatggcttcacgttggatagatcgacaggagaatttgttctgacgcatccgtccatgcagataccccctagagatatattcagtgaatgatgcgcggtatttcgactggccagaaggcctgaagaagtacatcgacacgatcagacaaggcaaggggcagcatcccaagaagtactcggctcggtacgtgtgctcgctggtcgctgattttcatcggacgatcatatacggtggagtcgcaatgaacccaagggatcaccttcggttggtttacgaggcaaatcctctcagtttccttgccgagcaggcaggggggcgaggctcagatggcaaggcaaggatcctctccattcagcctgtgaagctgcaccagaggctgccattgttcctggggagcatggaggacatgcttgagttagaaagctatggagatgtccagcagaaggtcaatcctggatacgacgtttaatgcgtgaggtaaaatcttcaggtactgtagcatacaatgaggtaacgaatgtatatggcaaagtctatatttgcacgaacaatgtgtctgtgtcttgctttctttgccttcttgcctatgcaatttcagagtactgagtcagaagtctttgctgtagttcactgtgaaaatgaaagatgatcccttgggagcttccataaaaaaaaaa

SEQ ID NO: 5500 - DNA, 2828 bp, Aristolochia fimbriata
cagaagggcgtcggtggcactttaggttctactgctgggagggatgcgccaaaaccacctgacattgtttcgaatgagatcatcttggcagctcttcaaaactctggaaaagtaacagtcatggcatcagaagaagaagcagagccggtatggattactgatgatggtccatttgttgtagtgactgatcctctggatggctcacgaaatattgatgcctcaattcccactggaactatatttggaatttataagcatcttgtggaactagatcatttgcctaccaaggaaaaagctctgctgaattcactgcagagtggaaataggcttattgcagccggctatgtcctttactcttctgcaaccatgttctgcatcacttttggttcaggaacccatgcatttactttggatcattcaactggtgattttgttcttacacatccatccataaaaattcctccgcgaggccaaatttattctgttaatgatgcaagatactttgactggcctgaaggtttaagacaatacatagacacagtcagacagggaaaagggcagttcccaaaaaaatattctgctcgttatatatgctcactagttgcagatttacatcgaactcttgtttatggtgggattgcaatgaatcctagagatcatcttcgtttggtgtatgaagcaaatccccttagcttcctagtggagcaagctggcggtaaaggctctgatgggaaatctcgaattctttcacttcagcctgttgaattacatcaaaggcttcctttgttcttggggagtgtagaggacattgaagagctagaaagctatggagaaattcaacaaaaagtcaatcctggatatgaagtgtaatggttagtgaaattctatgatgtgcagtaatagagttggtgatagtatccactgacataagatttgggtgagaatttcatgttgcttgtccttcttcattgtaattcctacccgtactaatggatccttgttattcacaccacgcaggcacttgctcgaaaatatgttttcagaacctacggttatcatgcaataaattaaatggttcgtatcaaattgatttcaaacagtgcttccagtcactaccaaatgtcttttgtatgtttaagcttagcttgcttgacacagaggcatttaataaatgaactcattaaaaaatctgcttaatacagacaacaacacaaacttgcttactttgcttgacaaactcggtaccggctaaactgtcacttattttggcacttcatgtctaacctactttagagaactcccaacatttagttgatgttccattcctctttgagctcattccgcagctgcagcacttgattctctggcatgataacagtcactaatctacccccagcttcttggtcgtggttctcaagtagccgatgcacgaaaactgccccttcatctccaactccatcgaggttaaagcttacatggacaggttttttacctttgatttccaagccatagaattccgcatcttccaagtttacaaatgtcaagtttgtaccgtacacaagaacatctgccagcccattttctgtctccaccattgcttcaatttccttgctctcatcttcaatgctttctgctattagctttgctaattctgaaagctgtgctccaggtatgtcaaaatctgcttctgcagtacttataatctgtttgttgcttagcatgccttctcctttagctcctgcatcatttctgcaaatggtgatcatcttcggttgcttttctcctctgatgtgagccaagcatctccagaaaagagctgaaatagcttcaaaagcggagaactttcccgagaccttcgactgtagttccctcaactgggtttcagttatactgaaggagagagtctccattttgctctcgttttccacaatccagcgatctttgacatgaatttgctttgttgaaagtggtttcttgctgggttttccggccttttcgatctgggttcttgggagatattgagcttgaatttttggctttccggccagtatttgcccccacatgttgatgaacatggcagcagtgaatgcatccccaagaacatgtgcccagctaagcccaattgacatccccccacacttgaaataagtgtactggacgaagaccaagggggagaactgcgagttgggatcaataacttggtcagagacgagttgcctgtgcaaagaatgctcacccttcacctgttccagccactcctccaagctcttactgcacttggcctccacaatccgcaccccggcgtcgttgcatttgatgaagggcctctgaccctccaatctccggactctcccggaggcggagcagtatgtgtcgagcatcaggaacatgggtttctttatgctggggatgtctaggccttccactgcatctttctcaaagtagtataccaaacggaggtagtgcaacttcatggaccagtccaaattggtgagctcgtggaccgctgtctcgccggtgacggtggcggggacgacggaggaggtccggactccgtagacgtagttgtcggagaccatggtgatgggtgttgctaaggatggaggtggtgatgggtgttgctaaggatggaggtggtgatgggtgttgctaaggatggaggtggtgatgggtgttgctaaggatggaggtggtgatgggtgttgctaaggatggaggtggtgatgggtgttgctaaggatggaggtggtgatgggtgttgctaaggatggaggtggtgatggggggatcagaggatgagggagaggagtggtacaattgatgagagt

SEQ ID NO: 5501 - DNA, 681 bp, Zingiber officinale
atacaatagactcgccgagttggaccatcttccagtggaggagaaggcacaactcaattctctccaaagtggaaaccgtcttgtagctgctggttatgttttatactcatccgccaccatcctttgcataagtgtcggttcagggacccatgctttcactttggatcattcaactggagagtttgttctcacacatccatcaattcaagttcctcctagaggacagatatactctgtgaatgatgcgaggtacttcgactggccagatggactaaggcaatacatcgacactgtcagacaaggcaaagggcagttccctaagaagtactcagctcgatatatctgctcactggtcgctgactttcatcgcactcttgtttacggaggtgtcgtcatgaacccaagggatcatcttcgacttgtttatgaagcgaaccctcttagcttcctcatcgagcatgctggtggaagaggttccgatgggaaaacaaggattctgtcatttcagccagtagaactacatcaaagattgccactgtttttggggagcatcgacgatatgaatgaattagaaagctacgacagtatccaacagaagattaaccctggatacgatgtttgacatgggaaacttcttctatagttatataacattgtataatcctactggccacaggtcac

SEQ ID NO: 5502 - DNA, 1403 bp, Silene vulgaris
actttgacacatttaggccgggcattgtgcatctgtgcctagtttaggaatattcgttaattctcttaacaaaaaaaaaaacaggcttggtattatccgtcatctttagtgtaatggagtatatggtactttgaccggtataatgttctctgcagaatgatattattctatcctcccttcaaaattctggaaaagtagcagttgttgcttcagaagaaaatgatgccccaatatggttctctgacgatgctccatttgtggtagtcatggatcctcttgatggttcgaggaatattgacgcatcaatccctacaggaactatttttggagtttacaatcgtcttgtggaattagataatcttcctcaagaggagaaggccacgttgaattcgttgcaaagtgggtccaaacttgttgctgctggttatgtcctttattcatcagctactatcttttgtgcgacttttgggtctggggtacactcattcacactggatcattctaccggagattttatcctcacaaaccccaatatcaaaattcctagtagaggtcagatatattctgtgaacgatgctcgatactttgattggcctgaaggtttaagacattacattgacactgtcagacaagggaaaggcagatacccgaagaaatactctgcacgctacatatgttcgctggttgctgattttcatagaacattactttatggtggaattgcgatgaacccaagggaccatctccgacttgtttacgaagcaaatcccctaagttatgttgcagaacaagctggtggaaaaggctctgatggtaaacgtagaattttggcaattcagcctgccaaacttcatcaaagactacctctattcttaggtagtcctgaagatattgaagaactagaaagttatggtgacatacagcagaaagtaaatcccggctatgaagtttgatgggcagttcacgtatttacgtcaggcgcaatgtggacaaggactaagcatgtcatgatgtacatgtatgccgaaactgatgatgcatctcgtgatcgtggttcttatgagcatgccaaacgtgtcatggtgcataaaatgtgcgcatcacgaggttatcctcattgatcaaacgtgtgtcatgactcacgagtgactgcaaccttaactatttgtcgcagtcactcgggatgctatgtagtttaaatggcctccaagggctcaaactttaggggaagcttactactagggtcaaatctgttgtccatattgtatactaccttcatagctactgtacacatccccatttatattatgttattatcaaaacattctgtaagttgtttatacatattctattttttattttttattagtcgaaagtcttaatgatataatggtacttacata

SEQ ID NO: 5503 - DNA, 328 bp, Cucumis melo
tactctgctcgttacatatgttctctggttgctgatctccatcgaactttattatatggcggagtggcaatgaatccaagagatcatctccgtctagtatatgaggcaaacccctcttagcctcctcgttgagcaagccggaggccgaggttcagatggtaaacaccgaattctttcattgcagccaggtaagctgcatcaaaggctgcctttgttcttggggagtttggaggacatggaggagcttgaaagctatggagatgtacagcagaaagtgaatcctggttatgaagtttgaagttgtgatagagaatgaagtttaaaatgt

SEQ ID NO: 5504 - DNA, 1231 bp, Allium cepa
ggggtaattccgagacaaaatgatcaacgctatcctctacccacgactaatttcatcctccataattcaacccctactctcccaaaaacccagattaaaaagcctcgcttcgtttcgtttagaatgaaatcccaaatgggttctcaaactcttcttgaatacatgtcaataaaacaaaaaagctcgaaaattggtgatgatatggcaattttagtgacccatttgcagtatgcatgcaagaagattgcttctattgttgcttctccatttgggtctgagtatgggagcaacatgattgaggttgggtcagtagctgattctggaagggatgctcctaaacctcttgatttagtctcgaatgacattatactatcttcactccaaaactcaggaaaagttgctgtaatggcatcagaagaagatgaaaatccagtttggatttcggatacgggaccatttgtggttgtcactgatcctttagatggttctagaaacattgatgcttccattccaactggaacaatttttggaatatacaatagacttcctgaactggaccatcttccaatagaggagaaggcacagctgaattcgcttcaaagtggaaccaggcttctggctgctgggtatgtattatattcatctgctactataatgtgtgttagctttggattgggaactcatgcatttacattggatcatgctactggcgagtttatgttgacccatccttctataaagattcctacccgtggacaaatatattcagttaatgatgcacgatattttgattggcctgatggtttaaggcaatacatcgacacagtacgtcagggcaagggtcagtatccaaagaaatattcagctcgatacatatgttctttagttgctgatttgcatagaatgctcatgtatggaggagtagttatgaatccaagagatcaccttcgcttagtttatgaagcaaatcccctcagttttctagtagagcatgctggtggcaaagcatctgatggtaaaaccagaattctttcgattcaaccagttaagttgcatcagaggcttccactatttatggggagtttggacgatatgcatgaactagagagttatgatactattcaacagaaggttaatcctgggtacgaagtctaacatatcaatgtcataacctatggaatgagcttgttctgtgtatcgcaaagcattgtataataataataaaaaactt

SEQ ID NO: 5505 - DNA, 1528 bp, Eutrema halophilum
cgtcatcctgaatcgctatccgggattttgacgcgtacccagatgagatcgagtttcgcggatgctcgaagtccagaaaaataatgcaatctctcactataacttggtacccaactttaatttccccgccaagactcgatctttacccgctaagacaaatcgcagcttcttctgttctctcttctccgaccgctggtaacaaacgtcgcgggatgacgtctcgccgtgagtctgcttcacttaagtccctcgcctctcgtcggacttcgaccggtgatgatgatgatggatactgtactcttgtagactttgcaggtaatggaggaggagggagagaagggacaactgtaggagatgatcttgtggttttgctttaccacttacagcatgcctgcaaaagaattgcttctcttgtcgcatctcctttcaattcttcacttggaaagctctctgttaactcctctagtggctcagaccgagatgcgcctaagccgctcgatattgtctcgaacgatatcatcttgtcctctcttagaaactcaggaaaagtagcagtaatggcttccgaagaagacgatagtccgacttggataaaagatgacggtccttacgttgtggttgtagatccattagatggatcacgtaacattgatgcttcgataccaacgggaactatatttgggatttacaatcgcctcgttgagcttgatcatttaccagttgaagagaaagctgaactcaattctctgcagagaggaaacaggcttgtagcttccggttacgtgctctactcttcagcgacaatactctgtgttagtctcggctccggaacacatgccttcacgcttgatcattccacaggcgaattcgttctcactcatcaaaatattaagatccctactcgagggcaaatatactcagtgaacgatgcgaggtacttcgactggccagaaggtttgaggaagtacattgatacagtgagacaaggcaaaggtcaaaacccgaagaaatactcggcacgttacatttgttcgctggtggctgatcttcacaggaccctgttatacggaggagtggctatgaatccaagagaccacctccgtttagtctatgaaggaaaccctttggcttttctcgtggaacaagctggtggtaaagcctctgatggaaagagagagatactttcgatacagccagtgaagcttcaccagagattgcctctgtttcttgggagcgtagaggatgtggctgagcttgagagctatggtgatgtgcagcagactgtgaatcctggctatgaagtttgaactatacctttttttttttttttttgaacgtaagtttgaagttgaactatacctctgcttcagttaatgtgttaaataaacataaatcaaatgcttgtgttacgcgaaaattatattatgattttctatagtgcgtaaaagacccaaatgccctaacaatccatcgtgtatattccagacatatgtaattacggtcgtatatgcaagtcattttctcttct

SEQ ID NO: 5506 - DNA, 1363 bp, Eutrema parvulum
tcgtcatccgtgttttgctatccgagattttgaagcgtattcagatgagattgagtttcgcggatgctctaaattcagaaacataatgcaatctctcactataactcggtacccaacttcaatttcccggccaagacaaatcacaacttctgttctctctcctccgaccgccggatacaaccgtcgcgggatggcgtttcgccgtgagcctgcttcgtttaagtccctcgccgctcgtcggacttcgatcggcgataatgatgatggatactgtactctcgtagactttgcaggtaatggaggagaaggggcagatgtaggcgatgatcttgtggtgttgctttaccacttacaacatgcctgcaaaagagtcgcttctattgtcgcatctcctttcaattcttcacttggaaagctctctgttaactcttctagtggctcagaccgagatgcgcctaagccgctcgatattgtctcaaacgatatcatcttgtcatctcttaaaaactcggggaaagtagcagtaatggcttccgaagaagacgatagtgccacttggataaaagatgacggtccttacgtcgtggttgtagatcctttagatggatcacgtaacatcgatgcttccatacccacgggaactatatttgggatttacagtcgcctcgttgagcttgatcatttaccagttgaagagaaagctgagctcaattctctgcagagaggaaacaggcttgtagcttcgggttacgtgctctactcgtcagcaacgatactctgcgttactcttggctccggaacacatgccttcacgcttgatcgttccacaggcgaattcgttcttacccatcaaaacattaagatccctgctcgaggacaaatatactcagtgaacgatgcgaggtacttcgactggccagaaggtttgaggaagtacattgatacggtgcgacaaggcaaaggcgaaaacccaaagaaatactcggcacgttacatttgttctctggtggctgatcttcacaggactctattatacggcggagtggctatgaatccaagagaccatctccgtttggtctatgaaggaaacccattggcttttctcgtggaacaagctggtggtaaagcctccgatggaaaaagagagatactttcgatacagccagtgaagcttcaccagagattgcctctgtttcttgggagcgtagaggatgtggctgagcttgagagctacggagatgtgcagcaaactgtgaatcctggctacgaagtttgaacgacttctctgtttcatttcatgtgttcaaacataaatcaatctagatcttgttgattgtaacataacactgttaaaacataaatc

SEQ ID NO: 5507 - DNA, 1489 bp, Arabidopsis thaliana
ttttctactcctcgtcatcttctattcgttatccgttttgaagcgtactcggatgggattgagtttcgcagatgctttaaattctagaaaataatgcaatctcttaccttaactcggtacccaactccaatttccccgccaagactcaatctttacccgctaagacaaatcgcagcttctgttctctctgctccgaccgccggtattaaccgtcgcgatatggcgtctcgccatcagtcaacttcctttaagccccttgccgttggtcggaatttgaccggagatgatgatgatggttactgtactcttatagactttgcaggtagtggaggaggagaagggaaaaatgtaggagaggatcttgtggtgttgctttaccacttacaacatgcttgcaaaagaatcgcttctcttgtcgcctctcctttcaattcttcactcggaaagctctctgttaactcctctagtgggtcagaccgagatgcgcctaagccgctcgatattgtctcgaacgatatcgtcttgtcctctcttagaaactcagggaaagtagcagtaatggcttctgaagaaaacgatagtccaacttggatcaaagatgatggtccttacgttgtggttgtagatcctctagatggatcacggaacatcgatgcttcgattcccacgggaactatatttggaatttacaatcgtctcgttgagcttgatcatttacctgttgaagagaaagctgagctcaattctttgcagagaggcagcaggcttgtagcttccggttatgtgctatactcttcagccactatcttctgtgttacacttggatcgggaacacacgccttcacgctagaccattccacaggagaatttgttcttacccatcaaaacatcaagatcccaactcggggacaaatctactcagtgaacgatgcgaggtactttgattggccagaaggtttaaggaagtacattgacacagtgagacaaggcaaaggtcaaaacccgaaaaaatactctgcgcgttatatttgttctctagtagctgatcttcacaggactctcttatacggtggagtggctatgaatccaagagaccatcttcgtttagtctatgaaggtaaccctttggcttttctcgtggagcaagctggtggcaaatcctctgatggaaaaagagggatactttcgatacaacccgtgaagcttcaccaaagattgcctctgtttcttgggagcttagaggatgttgctgagctagagagctatggagatgtgcagcagactgtgaaccctggctatgaagtttaaacaactcctctgtttcatattatctgtaaaaacaataaatgaatcgatgttagatttggttgcttgtaacattatgtattaggaaagttagatccgtgtatatatctgtttatcaagattcaagatcgactggtataatcacaattcacaagtttattatgtttctttatcagaagcaatc

SEQ ID NO: 5508 - DNA, 582 bp, Brassica juncea
acatcagaacattaaaatccctactcgaggacaaatctactcagtgaatgatgcgaggtacttcgactggccagaaggtttgaggaagtacattgatacagtaagacaagggaaaggcgagaacccgaagaaatactcggcacgatacatatgttctctggtggctgatcttcacaggactttgttatacggaggagtggctatgaatccaagagaccatctccgtttagtctacgaaggaaaccctttggctttcctagtggaacaagctggtggcaaagcctctgatggaaagagagagatactttcgatacagccagtgaagcttcaccagagattgcctctgtttcttggaagcgtagaggatgtgactgagcttgagagctatggagatgtgcagcagactgtgaaccctggctacgaagtttgaacggttcctcagtttcctttcatgtgttaaaaacatcaaatccataaaatgcttgtaaagatatatcaagagtgcatcctctgtttcattacatgtgttcaaacataaaccagtctagatcttgttcattgtaacataacactgttgaaaca

SEQ ID NO: 5509 - DNA, 1391 bp, Brassica juncea
tctctcactctaactctgttcccaacttcaatttccccgtcaagtctcgacctttacccgctaagacaaacgtcacaaaccgtaccttctgttctctctccttcaaccgccggatacaaccgtcgcggcatggcgtctcgcagtgattctacttcgtttaagtccctcgccgctcgtgagacttcgatcagtggtgatgacgatggttactgtactctcgtagacttcgcaggcaatggaggagggggtagagaaggggcaaatgtaggagatgatcttgtggtgttgctttaccacttacaacacgcctgcaaaagaatcgcttctcttgtcgcttctcctttcaactcttcacttggaaagctctctgtcaactcctctagtggctcagaccgagacgcggctaagccgcttgatattgtctcgaacgatatcatcttgtcatctcttagaaactcagggaaagtagcagtaatggcttcagaagaagacgatactcccacttggataaaagatgacggtccttacgttgtggttgtagatcctttagatggttcacgtaacatcgatgcttcgataccaactggaactatatttgggatttataatcgactcgttgagcttgatcacttaccagttgaggagaaagctgagctcaattcacttcagagaggtaacaggcttgtagcttcaggttacgtgctatactcttcagccacgatattctgcgttactcttggctctggtacacatgccttcactcttgatcactccacaggcgagttcgttcttacgcatcaaaacattaagatccctgctcgaggacaaatctactcagtgaatgatgcgaggtacttcgactggccagaaggtttgaggaagtacattgatacagtaagacaagggaaaggcgagaacccgaagaaatactcggcacgatacatatgttctctggtggctgatcttcacaggactttgttatacggaggagtggctatgaatccaagagaccatctccgtttagtctacgaaggaaaccctttggctttcctagtggaacaagctggtggcaaagcctctgatggaaagagagagatactttcgatacagccagtgaagcttcaccagagattgcctctgtttcttggaagcgtagaggatgtgactgagcttgagagctatggagatgtgcagcagactgtgaaccctggctacgaagtttgaacggttcctcagtttcctttcatgtgttaaaaacatcaaatccataaaatgcttgtaaagatatatcaagagtgcatcctctgtttcattacatgtgttcaaacataaaccagtctagatcttgttcattgtaacataacactgttgaaacataaaccattctagat

SEQ ID NO: 5510 - DNA, 1217 bp, Lippia dulcis
ttcaccctcatcccgtcagaagaatggcttttctgggtgggtttggctccaaaatcagctctagtggaattcacggtgcttctgttgatggcggcgaaaatgggtttccgacgctgaaggagtatatgggcaaagggggcgaaaatgtgggcgatgaattggcggtgctttttggacatttggaatatgcttgcaaaaagattggtgcgcttgtagcttcgccattcaactcgagccttgctaaaagtttcagttctgcggctggaagtgctgagagggataagcctaagccacttgacattgttgcgaacgagattgtattatcttccttgaagaactccggaaaagttgcagtaatggcttcagaagaagacgatgctccgatttggcttgatgatgatggcccttttgttgttgttttagatcctctggatgggtcccgcaacattgatgcctcgattcctactggaacgatatttgggatctataatcgtcttgcggagctggatcatttgccggtagaggaaaaagctatgcttaattccctccaaagtggaactaagcttattgcttctggctatgttctttattcatcagctacaattctgtgcacgagctttggatcaggaacacatgcattcactctagatcactcgacaggagacttccttttaacgcatccaaatattaaaattccgtctcgagggcaaatatattctgtgaacgatgctcggtattttgactggcccgaaggcttaaggaagtacatagatactattagacaggggaagggaaaacatcctaagaagtactcagcaagatatatatgttctcttgttgccgatttccatcgaaccttattatatggtggcattgcgatgaatccaagagatcatcttcgcctcgtgtatgaagctaatccacttagctttctagcagagcaagctgcaggtaaagggtcagatggtaaatcaagaatattatctcttcagcccgtaaaactccatcaaaggcttcccctgttttgggaagtccagatgatatcgaagagttagagagttacgaagatattcaacagaaagtaaatcctggatacgaagtttgaatattgttgtaatataaggtagaaacatgtaaaaaaacactattttgttcactatgagactttacgcttgtatttatggagatgttcaataaatttgtttatgtaaaaagaa

SEQ ID NO: 5511 - DNA, 431 bp, Primula obconica
aatttagatttctcataaacatagcttccatctgacgacaggacaaatctattctgtaaatgatgcccgttatttcgactggcccgaaggtttaaggcgatacatcgacacagttagacaaggcaaaggtaaataccctaaaaaatactcggcccgttacatatgctctcttgttgctgattttcataggactctcatgtatggaggaatagctatgaaccctagggaccaccttcgtcttgtgtacgaggctaaccctttgagttttctagtagagcaagcggggggtagaggatccgatggtcaaaatcgaatattgtctcttcaacctgttaagctacatcaaaggctccctttgtttttggggagtttagaggatattgaagagttggagagctatggagatgttcaacagaggataaatcctgggt

SEQ ID NO: 5512 - DNA, 1511 bp, Thellungiella halophila
  misc_feature (20)..(20): n is a, c, g, or t
  misc_feature (26)..(26): n is a, c, g, or t
  misc_feature (743)..(743): n is a, c, g, or t
  misc_feature (785)..(785): n is a, c, g, or t
tatccgggattttgacgcgnacccanatgagatcgagtttcgcggatgctcgaagtccagaaaaataatgcaatctctcactataacttggtacccaactttaatttccccgccaagactcgatctttacccgctaagacaaatcgcagcttcttctgttctctcttctccgaccgctggtaacaaacgtcgcgggatgacgtctcgccgtgagtctgcttcacttaagtccctcgcctctcgtcggacttcgaccggtgatgatgatgatggatactgtactcttgtagactttgcaggtaatggaggaggagggagagaagggacaactgtaggagatgatcttgtggttttgctttaccacttacagcatgcctgcaaaagaattgcttctcttgtcgcatctcctttcaattcttcacttggaaagctctctgttaactcctctagtggctcagaccgagatgcgcctaagccgctcgatattgtctcgaacgatatcatcttgtcctctcttagaaactcaggaaaagtagcagtaatggcttccgaagaagacgatagtccgacttggataaaagatgacggtccttacgttgtggttgtagatccattagatggatcacgtaacattgatgcttcgataccaacgggaactatatttgggatttacaatcgcctcgttgagcttgatcatttaccagttgaagagaaagctgaactcaattctctgcagagagganacaggcttgtagcttccggttacgtgctctactcttcagcgncaatactctgtgttagtctcggctccggaacacatgccttcacgcttgatcattccacaggcgaattcgttctcactcatcaaaatattaagatccctactcgagggcaaatatactcagtgaacgatgcgaggtacttcgactggccagaaggtttgaggaagtacattgatacagtgagacaaggcaaaggtcaaaacccgaagaaatactcggcacgttacatttgttcgctggtggctgatcttcacaggaccctgttatacggaggagtggctatgaatccaagagaccacctccgtttagtctatgaaggaaaccctttggcttttctcgtggaacaagctggtggtaaagcctctgatggaaagagagagatactttcgatacagccagtgaagcttcaccagagattgcctctgtttcttgggagcgtagaggatgtggctgagcttgagagctatggtgatgtgcagcagactgtgaatcctggctatgaagtttgaactataccttttttttttttttttgaacgtaagtttgaagttgaactatacctctgcttcagttaatgtgttaaataaacataaatcaaatgcttgtgttacgcgaaaattatattatgattttctatagtgcgtaaaagacccaaatgccctaacaatccatcgtgtatattccagacatatgtaattacggtcgtatatgcaagtcattttctcttct

SEQ ID NO: 5513 - DNA, 2883 bp, Cajanus cajan
atgacggcggggaagcaaaccacgtcgtcttcggtatctctttcatctgcgtcgtcgtcgtcgtcgtcttcggatgagagagagtacgaggtgcaggaccttagggaccgcttgaagtcttcgcgagggagcaggttcaatctgattgagacggagttggcgctgaactcgcgttggagcaagttcagtcgccaagctcttctccatggaatccgaggcttctccatcgacttctttaaaaacttcatcattcatcctgataacaggtggtatcgggcatggacaaagttcatattgttatgggcagtatattcatcctttttcactccaatggagtttggatttttccgtggcctacctgaaaatctctttatactggacatcattggacaagtagcttttctcgtggatattgtcttgcaattctttgttgcttatagagacagtcagacctatcgtatggtctacaagagaactcctattgctctaaggtatctaaaatctagctttatatttgatcttcttggatgtatgccctgggacatcatcttcaaggcttgtggacgaaaagaggaagtgaggtaccttttgtggatcagattataccgggtgcggaaagtgacagattttttccacaagttggagaaggacatacgtgtcaattacattattacccggattgtgaaacttatagtagttgaactctactgcacccatacagcagcttgcattttctactatttggctacaacactacctgaatcccaagaagggtacacatggataggaagtttaaaaatgggtgactacagttattcacatttcagagaaattgatatttggaagcgctacacaacatctctgtatttcgctattgttacaatggctacagttggctatggagatatacatgcagtaaatatgagggagatgatattcataatgatatatgtttcatttgatatgattcttggtgcctatttgattggtaacatgacagctttgatagtcaagggatcaaagactgaaaagttcagggacaagatgactgaccttatgaaatatatgaacagaaataggcttggaagggatatccgtgaacaaataaagggtcatctgcgcttacagtatgagagtagctacactgaggctgctgtcattcaggacatccctatttctattcgagctaagatatcccaaacattatatttgccatacattgaaaaggtttctctttttaaaggttgctcttcagaattcatcaatcagattgttatcaggctccatgaggagttctttcttccaggggaagttatactggaacaaggaaatgttgtagatcaactatattttgtctgtcatggaatgttggaggaagtaggcacagctgaagacgggactgaagaaactgtttcacttctgcagcctaacagttcatttggagagatatctattctttgcaacattcctcagccatatactgtccgcgtgtgtgaactgagtagactcctgcgacttgataaacaatcatttacaaatatcctagacatatacttctatgatggaaggaaagtattaaataaccttctagaggcaaaagagtcttttcgaggtaaacagttggagtcagacatcacatttcatatcggaaagcaagaagctgagcttgctttgaaggttaatagtgcagcttttaatggggatctgtgtcagctaaaaggtttgattcgagctggagctgatcccaacaagatggattatgatggaagatcacctttgcatcttgcagcatctagaggatatgaagatataacacttttccttattaaagaaggtgtagatgtcaatattaaagataacttcgggaacacacccttacttgaagcagttaagaatggacatgatcgaattgcttctttacttgttggagaaggggcctctatgaagatagaaaacgctggttgttttttgtgtacagcagttgcaaggggagattcagattatcttaaaagacttttatccaatggcatggatcctaacttaaaagattatgattaccgaagccctcttcacattgctgcagctgaaggtttatacctaatggcaaagtttctactagaagccggagctagtgttttttccaaagacagacggggaaatacaccgcttgatgaagcccggatgtgtggaaaccagaatctgatcaagctactagaaaatgcaaaatctgctcaactgtcagaattcccatatccctcccaagaatttacagataaaatgcacccaaagaagtgcacagtgttccctttccacccgtgggatccgaaagatagtagaagacatggaattgtattatgggttccacaatcaatcgaagagctaatcaaaacagcagcagaacaaatagaattttctggcgattcttgtattttatcagaagatgctggtaaaattactgatgtagatatgattaaggacggtcagaaactgtatttagtccatgaaacacattaggcctccgtattatggctcttaacaaacataatgtgcagttttgtaatgtgttccgttttctagaaatgaacacattatttgatcttattaacagtaaaaagagtgtcgtagcctgtcaaaataaaatctcatgtgagagtaattaagatcaaataatgtgctgtgctttagtggcaccactcaaaagcagtccgtgccaataaagtacttgatagttgttagcgatggcacgcatcagagctcagcaagaatttatcaaacattaaggtgccgcatttcctgagtgaactttcccacgagattttctcttgtattatcttctgtaatttttttcaccctttaaaaccccatacttattattattattaa

SEQ ID NO: 5514 - DNA, 2537 bp, Medicago truncatula
atgaagatgaaggaggaagaggatgaaggtgagaaaaacaggattaataatcaaactgccacgtgttcgggatcatcttctttgacaccttcgtcttcttcagatgaaagagagtaccaagtgcaggatcttcgagataaattgaaatcatcgcgaggaagcagattcaatctgatagagaaagaattagggttaaagattggttggagaaagttcagtcgtcgaactcttcttcatgaattcgttataaatcctcttaacaggtggtatcgtgcatggctcaaatttatattgttatgggcagtatactcatctttcttcaccccaatggagtttgggttttttcgtggcctgccagagaatctctttatactggatatcgtaggacaaatagcttttcttgtggacattgttttgcagttctttgttgcttatagagatagtcagacctatcgcatggtttacaagcgtactcctattgctctgcggtatctaaaatccacctttgtcattgatcttcttggatgtatgccttgggacctcatctacaaggcttgtggacggagagaggaagtgaggtacctattatggatcagattatatagggcagagagagttgtgcaatttttcaggaatttggagaaagatatacgtgtcaattacattattgctcggattgtgaaacttttagttgttgaactctactgcactcacacagcagcctgcatattctactatttggctactacactacctgaatcccaagagggctacacatggataggaagtttgaaactgggtgactatgcttattcaaagttcagagaaattgatatttggaagcgctacacgacatcgttgtattttgctattgttactatggctactgtcggatatggagatatacatgcagtaaatttgagggagatgatattcataatgatttatgtttcatttgacatggttcttggtgcttacttgatcggtaacatgacagccttgatagtcaagggatcaaagactgaaaagtttagggacaggatgacagatttgatgaaatatatgaatagaaataaacttcataaggatatccgtgaacaaataaagggccacgtgcgtttgcagtttgaaagcagctacactgacgctgcagtccttcaggatattcccatttctattcgatctaagatatccgaatcattgtattcgccatacataaaaaacgtttctctttttagtggatgctcttcagaattcatcaatcagattgttactaggctccatgaggaattctttcttcctggggaagttataatgcaacaaggttacgttgtagatcaactatattttgtctgtgatggtgtgctggaggaagtaggcatagctgatgatgggtccgaggaaactgttgcacttctagagcgcaacagctcatttggagaaatatctattctttgcaacattcctcagccacatactgttcgtgtttgtgaactatgtagggtcctgcggattgacaaacaatcattttcaaatatcctagatatatacttttatgatgggaagaaagtattggacaaccttctagagggaaaagagtctatcagaggtaagcaattggagtcagacatcacattccacattggaaagctagaatctgaacttgctttgaaggtcaacagaacagcttttgatggcgatctgtaccagctaaaaagtttgattcgagctggagctgatcccaagaagacagattatgatggaagatcacctctgcatcttgctgcatgcagaggatatgaagatatcacacttcttcttattcatgaacgtgtagacatgaacgtcaaagataactttgggaacacaccgctacttgaagcagttaagaatggacacgatcggattgcttctttacttgttagagaaggggcctcgttgaagatagatgatggtggtagttttttatgctcagcagttgcaagaggagattcggattatcttaaaaggcttttatcaaatggaatggatgctaacttgaaagattatgactatcgtacccccctacacgttgctgcatctgaaggattaatcttcatggcaaagttgttattagaagccggagctagtgtttttaccaaagacagatggggaaataccccgcttgatgaagctcggatgagtggaaacaaaaatctgataaagctactggaagatgcaaaatcagctcaattgacagaattcccttttccccaagaaattacagataaagtacatccaaagaagtgcacagtgttccctttccatccgtgggatccaaaagaacaaagaagaaatggaatagtattatggattccacacaccattcaagagctaatcataacagcggcagaacagataggattttccagcgacgcttgtatattatcagaagatgctggtaaaattattgacattagcatgattaaggatgatcagaagctgtatttagtcaatgaaacgcattaggcattcatattatggctcttttatagcca

SEQ ID NO: 5515 - DNA, 2753 bp, Secale cereale
ccgctcccccgggggcgttcctctcgtccgggatcaccgtcgagcgcgcgcgcgaggagtgccgcggcctcatcggcgccgccgccgcccagaaggcgggcgggctcgacaccgacgtgcccttcgacgcgggctgcaggcgcgtcttcgaggtcgccgtcgagctgtccaggaacatgggctgcagcttcatctcccccgagcacctcgccatcgcgctcttcactctcgacgatcccaccaccaacaatctcctcagaagcttgggagcggatccgagtcagctagcgtcagttgcagtcacccgactccatgaagagcttgcaaaagatggcagagatctcaaaggagcatcttccctcaaagtgcccgagaaagcacccgctggagctgcagctggaagatctgccttcagcaaatccttgagtaaaaagaaagataaaggtgcgctagatcagttttgtctagatttgaccacacaagccagtggagggtttattgaccccattattggccgtgaggaggagatcgaaagggtggttcagataatatgccggcgaacaaagaacaatcccatccttttgggtgaggctggtgttggtaaaaccgccatcgccgaagggttggctcttcggattgcaaatggagatgtccccattttcctcgtggcaaagcgtataatgtcactagacattggtctgcttattgctggtgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcctccacttgccagaggtgaactgcagtgcattgcagctacaactttagatgaacaccggatgcattttgagaaggataaggctttgaaccgcaggttccagccagtatttgtagatgagcctagccaggaagatgctgtgaaaatattacttggtcttcgtgagaattatgaagcttatcataaatgcaaattcactctagaagccatcaatgcagccgtttatttgtcagcaaggtatatcccagacagacagcttcctgataaggctattgatcttattgacgaagctggcagtagagctcgaattgaatcatatcaaaagaagaaggaaggacagtcttctgttctcttaaaggagccggatgaatactggcaggagataaaagctgtccaggccatgcatgaagtggtgtcatctaacaagatgaaatattctccgaataagagtaatcaacagaatgcgagtcttaacactgaagcgccacatcaggataaggctgagtcaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgatgctgttgcagcgatatcgcgggcggtgaagagatcgcgtgttggcctcagtgaccctgacagacctatcgcgacgatgctcttttgtggtcctacaggggttggtaaaaccgagcttaccaaagctcttgcggcgagctactttggatcggaatctgctatgcttagattagacatgagtgaatacatggagaggcacacagtgagcaaactgataggatctcctccagggtacattggatatggtgaaactggtactttgacagaagcagtcaggagaaaaccattcaccgtggtactgcttgatgagatagagaaagctcaccctgatattttcaatatccttctccaaatttttgaagatgggcatctggcagactcacagggtcgcagagtttcattcaagaatacattgattgtcatgacatcaaacgttggttctacgtcaatttccaacggacggcggagcatgggtttctcaacagaggatactgaatcaagcagatatgtcgcggtgaaatccctcgtgatggaagagctgaagggattcttccgtccagaattgctcaacagaatcgatgagacggttgtcttccgtcctctggaacagactcagatgctggcaatcctcgatatcctcctagaggagctgaagggcaagctcttggccgtcgggatcggcctggaggtctctgatgcaatgaaggagctgatctgccgagaaggctacgacaagaactacggcgcgcggccgctgaggagagccatcacccaactgatggaggatgtcatcagcgaagcgattcttttcggcgagtacaagcctggcgacacgatactggtggacaccgacaacaaggggaagccttgcttgagtcgtctgaaccaaccaccggtcgtccaagtgtctgactcgacacggacattctgaagtgaagcccttgggtggtagactggtagagtagaggtctaatttcatattctttggatttcgagtaacgagataggagtaagtagtaattctttgataggccgacaccaaatacttatttggttatttctttattgtacataacaaacattgagggaattcgtcccagcatggtcttgttcggcaagtatatatccaactgtatattgtcctccggtttataacaaatacggtactataattttgaaaacggctgcgtggagtggatatttttaggaaact

SEQ ID NO: 5516 - DNA, 2518 bp, Triticum aestivum
gaacatgggctgcagcttcatctcccccgagcacctcgccatcgcgctcttcacgctcgacgatcccaccaccaacaatctcctcagaagcttgggagcggatccgagtcagctagcgtcagttgcagtcacccgactccatgaagagcttgcaaaagatggcagagatctcgcaggagcatcttctctcaaagtgcccgagaaagcacccgctggagctggagctggaagatctgccttcagcaaatccttaagcaaaaagaaagataaaggcgcgctagatcagttttgtctagatttgaccacacaagccagtggagggtttattgaccccattattggccgcgaggaggagatcgaaagggtagttcagataatatgccggcgaacaaagaacaatcccatccttttgggtgaggctggtgttggtaaaactgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccacttgccagaggtgaactgcagtgcattgcagctacaactttagatgaacaccggatgcattttgagaaggataaggctttgaaccgcaggttccagccagtatttgtagatgagcctagccaggaagatgctgtgaaaatattactgggtcttcgtgagaattatgaaacttatcataaatgcaaattcactctagaagccatcaatgcagcagtttatttgtcagcaagatatatcccagacagacagcttcctgataaggctattgatcttattgacgaagctggcagtagagctcgaattgaatcatatcaaaagaagaaggaaggacagtcttccgttctcttaaaggagccggatgaatactggcaggagataaaagctgtccaggccatgcatgaagtggtgttatctaacaagatgaaatattctccgaatgagaataagcaacagaatgcgagtgttaacactgaagcgccacatcaggataaggccgagccaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgacgctgttgcggcgatatcgcgggcagtgaagagatcacgtgtaggcctcagtgaccctgacagacctatagctacgatgctcttttgtggtcctacaggggttggtaaaaccgagcttaccaaagctcttgcggcgagctactttggatcggaatctgctatgcttagactagacatgagtgaatacatggagaggcacacagtgagcaaactgataggctctcctccagggtacgttggatatggtgaaactggtactttgacagaagcagtcaggagaaaaccattcaccgtggtactgcttgatgagatagagaaagctcaccctgatattttcaatatccttctccaaatttttgaagacggtcatctggcagactcacagggtcgcagagtttcgttcaagaatacattgattgtcatgacatcaaacgttggttctacatcaatttccaacggacgacggagcatgggtttctcaacagaggacaccgaatcaagcagatatgtcgcagtgaaatccctcgtgatggaagagctgaagggattcttccgtccagaattgctcaacagaatcgatgagacggttgtcttccgtcctctggaacagactcagatgctagcaattcttgatatcctcctagaggaactgaagggcaagctcttggccgtcgggatcggcctagaggtctccgacgcgatgaaggagctgatctgccgagaaggctacgataagaactacggcgcgcgaccgctgaggagagccatcacccagctgatggaggatgtcatcagcgaggcgattcttttcggcgagtacaagcctggcgacacgatactggtggacaccgacagcaaggggaagccttgcttgagtcgcctgaaccaaccaccgatcgtccaagtgtctgactcaacacggacattctgaagtgaagctctctctcgtgtggtagactggtagagtagaggcctaatttcctattctttcgatttcgagtaacgagataagtagtaattctttgatagatagatagataggccaaatatttggttatttctttatgtacataacattgagggagttcgtcccagcatggtcttattcggcaagtatatatccaactgtatattgtcctccggtttataa

SEQ ID NO: 5517 - DNA, 2570 bp, Triticum aestivum
ggctgcagcttcatctcccccgagcacctcgccatcgcgctcttcacgctcgacgatcccaccaccaacaatctcctcagaagcttgggagcggatccgagtcagctagcgtcagttgcagtcacccgactccatgaagagcttgcaaaagatggcagagatctcgcaggagcatcttctctcaaagtgcccgagaaagcacccgctggagctggagctggaagatctgccttcagcaaatccttgagtaaaaagaaagataaaggtgcgttggatcagttttgtctagatttgaccacacaagccagtggagggtttattgaccctattattggccgtgaggaggagattgaaagggtggttcagataatatgccggcgaacaaagaacaatcccatccttttgggtgaggctggtgttggtaaaaccgcgatcgccgaaggtttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccgcttgccagaggtgaactgcagtgcattgcagctacaactttagatgagcaccggatgcattttgagaaggataaggctttgaaccgcaggttccagccagtatttgtagatgagcctagccaggaagatgctgtgaaaatattacttggtctccgtgagaattatgaaacttatcataaatgcaaattcactctagaagccatcaatgcagcagtttatttgtcagcaagatatatcccagacagacagcttcctgataaggctattgatcttattgacgaagctggcagtagagctcgaattgaatcatatcaaaagaagaaggagggacagtcttccgttctcttaaaggagccggatgaatactggcaggagataaaagctgtccaggccatgcatgaagtggtgttatctaacaagatgaaatattctccgaatgagaataagcaacagaatgcgagtgttaacactgaagggccacatcaggataaggctgagtcaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgacgctgttgcggcgatatcgcgggcagtgaagagatcacgtgtaggcctcagtgaccctgacagacctatagctacgatgctcttttgtggtcctacaggggttggtaaaaccgagcttaccaaagctcttgcggcgagctactttggatcggaatctgctatgcttagactagacatgagtgaatacatggagaggcacacagtgagcaaactgataggctctcctccagggtacattggatatggtgaaactggtactttgacagaagcagtcaggagaaaaccattcaccgtggtactgcttgatgagatagagaaagctcaccctgatattttcaatatccttctccaaatttttgaagacggtcatctggcagactcacagggtcgcagagtttcgttcaagaatacattgattgtcatgacatcaaacgttggttctacatcaatttcaaacggacgacggagcatgggtttctcaacagatgacaccgaatcaagccgatatgtcgcggtgaaatccctcgtgatggaagagctgaagggattcttccgtccagaattgctcaacagaatcgatgagacggttgtgttccgtcctctggaacagactcagatgctagcaattctcgatatcctcctagaggaactgaagggtaagctcttggccgtcgggatcggcctggaggtctccgacgcgatgaaggagctgatctgccgagaaggctacgacaagaactacggcgcgcggccgctgaggagagccatcacccaactgatggaggatgtcatcagcgaagcgattcttttcggcgagtacaagcctggcgacacgatactggtggacaccgacagcaaggggaagccttgcttgagtcgtctgaaccaaccaccgaccgtccaagtgtctgactcaacacggacattctgaagtgaagctctcgtgtggtagacttggtagagtagaggcctaatttcctattctttcgatttcgagtaacgagataagtagtaattctttgataggtagataccaaatattcatttcgttatgtacataacattgagggaattcgtcccagcatggtcttattcggcaagtatatatccaactgtatattgtcctccggtttataacaaatacagtataattttggaacggctgcatggagtggatattttggactaaaatcagtgaatgaaaacttt

SEQ ID NO: 5518 - DNA, 2476 bp, Hordeum vulgare
cctcgccatcgcgctcttcactctcgacgatcccaccaccaacaacctcctcagaagcttgggagcggatccgagtcagctagcatccgttgcagtcacccgacttcatgaggagcttgcaaaagatggcagagataccgcaggagcttcttctctcaaagtgcccgagaaagcacccgctggagctggggctggaagatctgccttcagcaaatccttgagtaaaaagaaagataaaggtgcgctagatcagttttgtctagatttgaccacacaagccagtggagggtttattgaccccatcatcggccgcgaggaggagatcgaaagggtagttcagataatatgccggcgaacaaagaacaatcccatccttttgggtgaggcaggtgttggtaaaactgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgacgaggttcacaatcttgttggatctggaactgctggaaaaggtaagggtgctggccttgatattagcaatctcctgaagcccccacttgccagaggtgaactgcagtgcattgcagctacaactttagatgaacaccggatgcattttgagaaggataaggctttgaaccgcaggttccagccagtatttgtagatgagcctagccaggaagatgcggtgaaaatattacttggtcttcgtgagaattatgaaacttaccataaatgcaaattcactctagaagccatcaacgcagcagtttatttgtcagcaagatatatcccagacagacagcttcctgataaggctattgatcttattgacgaagctggcagtagagctcgaattgaatcatatcaaaagaagaaggagggacagtcttctgttctcttaaaggagccggatgaatactggcaggagataaaagctgttcaggccatgcatgatgtggtgttatctaacaagatgaaatattctccgaatgagaataatcaacagaatgcgagtcttaacgctgaaggaccacgtcaggataaggctgagtcaacaactgaggagcctattgtagttggaacagaagaaattgcaagagtcgcctcattatggtcaggtattccagtccagcagctgacagctgatgataaaaagatcttagtaggactggatgatgagcttcgaaagcgtgttattggtcaagatgacgctgttgcggcgatatcgcgggcggtgaagagatcacgtgttggccttagtgaccctgacagacctatcgctacgatgctcttttgtggtcctacaggtgttggtaaaaccgagcttaccaaagctcttgcggcgagctactttggatcggaatctgctatgcttagactagacatgagtgaatacatggagaggcacacagtgagcaaactgataggctctcctccagggtacattgggtatggtgaaactggtactttgacagaagcggtcaggagaaaaccattcaccgtggtactgcttgatgaaatagagaaagctcaccctgatattttcaatatccttctccaaatttttgaagatgggcatctggcagactcacagggtcgcagagtttcgttcaagaatacattgattgtcatgacttcgaatgttggttctacgtcaatttcgaatggacgacggagcatgggtttctcaacagatgataccgaatcaagcagatacgttgcggtgaaatccctggtgatggaagagctgaaggggttcttccgtccagaattgctcaacagaatcgatgagacggtcgtcttccgtcctctggaacaaactcagatgctagcaattcttgatatcctcctagaggaactgaagggcaagctcttggccgtcgggatcggcctagaggtttccgatgcgatgaaggagctgatctgccgggaaggctacgacaagaactacggtgcgcgaccactgaggagagccatcacccagctgatggaggatgtcatcagcgaagcgattcttttcggcgagtacaagcccggcgacacgatactggtggataccgacaacaaggggaagccttgcttgagtcgtctgaaccaaccaccgatcgtccaagtttccgactcaacgcggacattctgaagtgaagctcttgtgtggtagacgagataagtagtaattctttgataggtcaaaattttctattctttcagtctcaagtaacgagataagtagtaattctttgataggtagataccaaatattcatttccttgtgtacatatatagcattgagggaattcgtcccaggatgatcttattcgggaagtatatatcaaactgtaatattgtt

SEQ ID NO: 5519 - DNA, 2893 bp, Pennisetum glaucum
ctccggggcgtgatcagggcggtgttcgagcgcttcacggagcgggccgtcaaggcggtcgtgctgtcgcagcgggaggccagggggctcggggaggccgccgtggcgccgcgccacctcttcctcggcctcgtcgccgaggaccggtcctccgccggctacctctcgtcggggatcggcatcgagcgcgcgcgggaggggtgccgcggcatcgccgccagggacgacgacgcgccggcgaaggcgccgccgtccaaggccggatcggggggactcgacaccgacgtgcccttctccgcggccagcaagcaggtcttcgaggtcgccgtcgtgctctccaagaacatgggatgcagcttcatctcgcccgagcacctcgccatcgcgatcttcaccctcgacgatcccaccaccaacaacctcctcaggagtttgggagcggatccgagtcaacttgcatcagttgcggtagatcgtctccaagcagagcttgcgaaagatggaagagatcctgccggagcatcatctttcaaaatcccagagaaggctcctgcagcagctggaagatctgctttctcccaatccttgactacaaagaaagagaagggtgcactagatcagttttgttttgacttgaccacacaagctagtggaggtttcatcgatcctattattggccgtgaagaggagattgaaagagtggttcagataatatgccgacggaccaagaacaatcctattcttttgggtgaggcaggagttggcaaaactgcaattgctgagggactggctcttcgaattgcaaatggcgatgtccccatttatcttgtggcaaagcgcatactgtcactggatgttggtctacttatcgctggtgcaaaagagaggggtgaattggagtctagggttactaatataattcgtgaagtccgggaagcaggcgacgttattctttttattgacgaggttcacaatcttattggatctggaaccattgggaagggtaagggttctagccttgatattggcaacttgctgaaacccgcgcttgctagaggtgaactgcagtgcattgcagcaacaactctagatgaacaccgaatgcattttgagaaggataaggctttggcccgccgctttcagccagtattagtagctgagcctagtcaggaagatgctgtgaagatattgctcggtcttcgtgagaaatacgaaacttaccacaaatgcaaattcacattagaagccatcaatgcagcagtttatctgtcagcaagatatatccctgacagacagcttcctgataaggctattgatctaattgatgaggctggaagtagagctcggatggagtcatttaacaggaagaaggaagggcagtcttcaattctcttgaagtcaccagatgagtattggcaagagataagagctgcacaggccatgcatgaagtggtgttatctaacaaggcaaaatattctccaaatgcgaatgatcaagagactggtaatgctgatgtggaagcaccatatgaagacaatagagggtcaacatcaacctcatcactttcagctgatgagccaattgtagttgggacagaggaaatcgcaagagttgcctcattatggtcagggataccagttcagcagttgactgctgatgataagaagcttctagtaggactagatgatgagctcaggagacgggtcattggccaagatgacgcagttgtggccatatctcgtgcagtgaagagatcgcgtgttggccttagtgaccctgacagacctattgctacactgcttttctgtggtccaacaggcgttggtaaaacagagcttaccaaggctctagcagcaagttattttggatcagaatctgatatgcttagattagacatgagcgagtatatggagaggcacactgtgagcaagctgatcggctctcctccagggtacattggatatggtgaaactggtactttgacagaagcggtcaggaggaaaccatttactgtggttttgttggatgagatagagaaagcccaccctgatattttcaacatccttctccaaatctttgaggatggacatttgacagactcacagggccgcagggtttccttcaagaatacattgattgtgatgacttcaaatgttggttctacatcaatttcaaagggaagacagagcataggtttcttgaaggaagataccgagtcaagctcatatgttgcaatgaaatccctagtaatggaggagctgaaggcgtttttccgaccagagttactcaacagaattgatgagatggtcatgttccgtcctctagagaagactcagatgctggccattcttgatatcatcctgaaggaagtgaagggtaggcttttggcccttgggataggcttagaagtgtctgatgccatgaaagacctgatctgccgagagggatatgacaagagctacggtgcccggccgctgcggagggctgtcacccacatgattgaggatgccatcagcgaggcgattcttttcggtgaattcaagcccggtgacacggtactgatggacattgatgacgaggggaagccgtgcatgagccatctggaccaacagatcgtccaggtcattaacacaacacgggcattctgaagttctgcaccggatgcccttttgttgtgattccagatttctagtataatagtagagagtagaggtctaattttttattctttcaagcgtcgagattaataattctttcatacgtagacagagtattccatatgtacatatcagtaagataggggaatttgggcagacactgatgttgttccaagattttatatccaactgtatattgccgaataggtaatatataccactctgaaattgtgaa

SEQ ID NO: 5520 - DNA, 2267 bp, Oryza sativa
ccctcaccgtccgatccgtcgtcccgtgggttcctggccgtccgattcgccggaggggagctcgtggcggccgttgcgccttcgcctccggccccttatatggcgtggcggggaggagaggagcatcttctcgcctgagattccgtcgacgccattgcttgcttgcttgttgcttccattccattccattccacacacgagtgaacgagcggggaaggttctagaaggttcggttagagttttctggtctgccatggcgtccactgtgacgacgccgagccggccggtatccgccgggtgccaccggcgctcgccgcggcggtcagcgcccgtcgtgctctccctcggcggcgggccgcggcggcgcacgccgtcgtccaccagctgctcggcgctcgcgtcgccggcgaagcagggcacggccaagctccctccgccgcagccgacggcgtcgaggaccgcggcggccgacgcggagcgggagcgggagcggacggactacaacgaggtggccgccgcgctggagagcatctacaagctgagccccgccgtggtcgaggagaaggacgccgacgaggaggacgagaagagcaaacagaccaagcggaagagaaaaggcagagtggggaggagccggaacgcgacggtgacggtgaggagcagccggaggaggaggcggggacagaggatggacctggggaagagggtggagatgaggaggagggaggaagaagagggcggcggcggcgccggcaaggtggaagacgaggagcgggggttcgaggagatgctgctccgggagcacgccgtgtccaccgacatgggcagcctcgactggaagcggatgaagatccctcccgtgctcacctccgcccagagcatccgcctcttcaggatcatgcagcccatgaaggcgatcatggaaatgaaggagaacctggagaacgaagtgcagagcgagccaaacgacgcacagctcgccgaggccatgaacatgtccgttcttcagatgaggcgccatctcgaggtcggccgagctgccaggaacaagctcatcaagcataatctccggctggtgctgtacacgatcaacaagtactacccggacatgtccaacgacgagaggttcgacgacatctgccaggcgggcgccaacggcttgatcacggcgatcgaccggttcgagcccaagcgcggcttccgcatctccacctacgccctcttctggatccgccactccatcgtccgcgccatcaccctctccaacttcacccgcttccccttcgccatggaatccgagaggcaggagatccacagggctcgggaggagctggcgttcgagctggggagggcgccgacggaggaggaggtgatgaagaaggtggggctgtctccggcgaggtaccgcgacgtggtgcggatgacgaggcccacctactccctccacgcgcgtaacagggtcacccaggaggagctcatcaacgaggtcaccgacgacgacgccatcggcgtcgacaccagcagccacaacaccctcctccgcctcgccatcgacgacctcctggattcgctgaagcccaaggagagcgtggtgatccggcagaggttcgggctggacgggagggggaagcggacgctgagcgagatcgccggaaacctcaacatctcgagggagatggtgcgcaagtacgagctcaaggcgctcatgaagctcaagcaccccacgcgagtggaatacctgcgcagatacatgtgaaaaccaccatgcaatcgtctcgtctctctgctgtgcataaaacatgtagtacaagcatgtattcctagcaatcttactaattccccaaacctgcatagcattagcaaataccaacaaccacaggtattcattctactctgcatattctgctgtatataatttctgcatgatcccctctgcattgcagattacagatacaaaatacactgagatgattccgtgttatagatacaggaacggtgtgtgtgtgtgtgtgtgtgtgtgtgtgtgtgtccacgagttttttttccaagtgaggttgcggtacatatgcacctcagatgtaagtaattcttacttagcatatagatacggtgcaggggatgatccgatccctgcttagcttagctcatacgctgtgcattcaaaagaaaagacatttccttttcctatcaactgatgctcagtctgtataatactttctgaagtctgaacctgaagaattgagtagcaactctgaacccgggagttg

SEQ ID NO: 5521 - DNA, 2127 bp, Oryza sativa
atcttctcgcctgagattccgtcgacgccattgcttgcttgcttgttgcttccattccattccattccacacacgagtgaacgagcggggaaggttctagaaggttcggttagagttttctggtctgccatggcgtccactgtgacgacgccgagccggccggtatccgccgggtgccaccggcgctcgccgcggcggtcagcgcccgtcgtgctctccctcggcggcgggccgcggcggcgcacgccgtcgtccaccagctgctcggcgctcgcgtcgccggcgaagcagggcacggccaagctccctccgccgcagccgacggcgtcgaggaccgcggcggccgacgcggagcgggagcgggagcggacggactacaacgaggtggccgccgcgctggagagcatctacaagctgagccccgccgtggtcgaggagaaggacgccgacgaggaggacgagaagagcaaacagaccaagcggaagagaaaaggcagagtggggaggagccggaacgcgacggtgacggtgaggagcagccggaggaggaggcggggacagaggatggacctggggaagagggtggagatgaggaggagggaggaagaagagggcggcggcggcgccggcaaggtggaagacgaggagcgggggttcgaggagatgctgctccgggagcacgccgtgtccaccgacatgggcagcctcgactggaagcggatgaagatccctcccgtgctcacctccgcccagagcatccgcctcttcaggatcatgcagcccatgaaggcgatcatggaaatgaaggagaacctggagaacgaagtgcagagcgagccaaacgacgcacagctcgccgaggccatgaacatgtccgttcttcagatgaggcgccatctcgaggtcggccgagctgccaggaacaagctcatcaagcataatctccggctggtgctgtacacgatcaacaagtactacccggacatgtccaacgacgagaggttcgacgacatctgccaggcgggcgccaacggcttgatcacggcgatcgaccggttcgagcccaagcgcggcttccgcatctccacctacgccctcttctggatccgccactccatcgtccgcgccatcaccctctccaacttcacccgcttccccttcgccatggaatccgagaggcaggagatccacagggctcgggaggagctggcgttcgagctggggagggcgccgacggaggaggaggtgatgaagaaggtggggctgtctccggcgaggtaccgcgacgtggtgcggatgacgaggcccacctactccctccacgcgcgtaacagggtcacccaggaggagctcatcaacgaggtcaccgacgacgacgccatcggcgtcgacaccagcagccacaacaccctcctccgcctcgccatcgacgacctcctggattcgctgaagcccaaggagagcgtggtgatccggcagaggttcgggctggacgggagggggaagcggacgctgagcgagatcgccggaaacctcaacatctcgagggagatggtgcgcaagtacgagctcaaggcgctcatgaagctcaagcaccccacgcgagtggaatacctgcgcagatacatgtgaaaaccaccatgcaatcgtctcgtctctctgctgtgcataaaacatgtagtacaagcatgtattcctagcaatcttactaattccccaaacctgcatagcattagcaaataccaacaaccacaggtattcattctactctgcatattctgctgtatataatttctgcatgatcccctctgcattgcagattacagatacaaaatacactgagatgattccgtgttatagatacaggaacggtgtgtgtgtgtgtgtgtgtgtgtgtgtgtgtgtccacgagttttttttccaagtgaggttgcggtacatatgcacctcagatgtaagtaattcttacttagcatatagatacggtgcaggggatgatccgatccctgcttagcttagctcatacgctgtgcattcaaaagaaaagacatttccttttcctatcaactgatgctcagtctgtataatactttctgaagtctgaacctgaagaattgagtagcaact

SEQ ID NO: 5522 - DNA, 2098 bp, Setaria italica
gcgccacgcaccccttcgcgccaggcacccgccctcctggcgcctgatccgccgtttggcggcgtcccggccgtcagatgcggcaccgcggctcgtggccgccgtcgcgccccgcccctccccttatatggcgcgcagccgcgcatctggctcgagatcccgtccacgccatttgcaccgcgtcgcatcgcttccacacgaccagcagcgagttgagctgaacgcctgtgcgccacaagaagcttctagattgaggcagtcgagctaagctagcccgccatgacgtccaccgtgaccacgcccagccggccgctcgccgccgggtgccgctgcgcggccgggccgcggcggtccggccccgctgtgctcgcgctcaacaatggtccgcggcggcgggcgccgtccacgagctgctcggcgctcgcgtcgcccgagaagcagcgcacggctaagctccccccgccgcagcgcccgtcgagggccccggcggaggagggggaggggacggactacaacgaggtggcggccgcgctggagagcatctacaagctcagccccgccgtggtcgaggagaagcacggcgaggacgacgaggccaagaaggacaagaagaagaggaagggcagagtgggcaggagcacggtgatcgtgaggagccggcggaggaggcgcgggaggaggatggatctggggaagagggtggagatgaagcagaaggagggcgatgccggcggcaagcaggaggaggagcgggagttcgaggagatgctgctccgggagcactcggtgtccacggacatgggcagcctcgactggaagcgcatgaagatcccgccggtgcttagctccgctcagagcgcgcgactcttcaagaccatgcagccaatgaaggcgatcttcgaagtgcaagagagcttgagggaggacttgcagagggatccgaccgacgctgagctcgccgaggccaccggcatgacggtccagcagctgcgccgccgcctcgacgtcggcagggccgccaggaacaaggtcatcaagcacaacctccggctggtgctgtacgccatcaacaagtactacccggacatggccaacgacgagaggttcgacgacctctgccaggccggcgccaacggcctcatcaccgccatcgaccggttcgagcccaagcgcggcttccgcatctccacctacgcgctcttctggatccgccactccatcgtccgcgccatgacgctctccaacttcacgcgcttccccttcgccatggaatcggagaggcaggagatcaacaaggcccgggaggagctggcgttcgagctcgggagggcgcccacggacgaggaggtgatcaagagggtgggcatctcccagcagaggtaccgcgacgtgctgcggatgacgaggcccacctactcgctgcactcgcggaaccgcgtgacgcaggaggagctcatcaacgaggtcaccgacgacgacgccatcggggtcgacgccggcaagcacaacacgctgctccgcctcgccatcgacgacctcctggactccctgaagcccaaggagagcctggtgatcaggcagcggttcgggctcgacggccgggggaagcgcacgctcagcgagatcgccggcaacctcagcatctcgcgggagatggtccgcaagtacgagctcaaggccctgatgaagctcaagcaccccacgcgggtggagtacctgcgcaggtacatgtgagctcatcgttcgtaccgtgccgtagcatcatgcatgcggtgcacagcctactagtactacaaaaacatagttactctgctgtatatatttctgcctccgctactccgcagtctctgcactgcacagtccatcgcactacactgaaatcactccgtgttatactagaagacactgtacatatacaggaatggtgtgtgtgtgaatcgtaatgagtgagttcattcgagtgaggttgtattgcagacctcgcatgcaattcttaccatacattatatatagtatacatgatgtaagaagtcgagcaatgtcccctgctttttgcagctccgcatggtaattagtaaatcatcatatttctgcaatt

SEQ ID NO: 5523 - DNA, 1455 bp, Panicum virgatum
gcgggaggaggatggacctggggaagagggtggagatgaagagcatggaggacgacgccggcggcggccggcaggacgaggagcgggagttcgaggagatgctgctccgggagcactcggtgtccacggacatgggcagcctcgactggaagcgcatgaagatcccgccggtgctcagctccgcgcagagcgcgcgcctctttaagaccatgcagcccatgaaggcgatcttcgaagtgcaagagagcttgcgggaggacttgcagagggacccgaccgacgccgagctcgcggaggccaccggcatgaccgtccagcagctgcgccgccgcctcgacgtcggccgggccgccaggaacaagctcatcaagcacaacctccggctggtgctgtacgccatcaacaagtactacccggacatggccagcgacgagaggttcgacgacctctgccaggccggcgccaacggcctcatcaccgccatcgaccgcttcgagcccaagcgcggcttccgcatctccacctacgcgctcttctggatccgccactccatcgtccgcgccatgacgctctccaacttcacgcgcttccccttcgccatggagtcggagaggcaggagatcaacaaagcccgggaggagctggcgttcgagctcgggagggctcccacggacgaggaggtgatcgggagggtgggcatctcccaggagaggtaccgcgacgtgctgaggatgacgcgccccacctactcgctgcactcgcggaaccgcgtgacgcaggaggagctcatcaacgaggtcaccgacgacgacgccatcggggtcgacgccggcaagcacaacacgctgctccgcctggccatcgacgacctcctggactcgctgaagcccaaggagagcctggtgatccggcagcggttcgggctggacggccgggggaagcgcacgctcagcgagatcgccggcaacctcaacatctcgcgggagatggtccgcaagtacgagctcaaggccctgatgaagctcaagcaccccacgcgggtggactacctgcgcaggtacatgtgagctcagctcagcattcggacctgccaccacgcattgcatgccggtgtaccagcatgttctagcagtactacaagaaaaaaaaaacagagtggttgctctgctgtatatatttctacccctccgctactctgcactgcgcagtgcacactatagactgcagagttcatccatgactgcactgaaatctgtccgtgttgtaatagaagacatgtacataaacaggaacagtgtgtgggtgagtgtcctgatgagaggtgagttcattcgggtgaggttgtattgcagacctcgcatgtaattcttaccatacattatattgtatatggatacgaatacgatacatggtgcgagaaactaagaaagtcgagcatcaagaaaactcatttcc

SEQ ID NO: 5524 - DNA, 2033 bp, Sorghum bicolor
gctcgagattccgtccacgccattgcgtccaactgcctccacacgacgagcaccccacccaccacggccaaagaaacccaacggcgcctgttgtgctgtgcctgtgcgccacaagacgaagcttcgaggatccaggggcaggcggctgtgtagctagctaggctgccatgacgtccaccgtgacgacgcccagcaggccgctcgccgccgggacccggccgcggcggtcctggcccgccgtgctctcgctcagcaagggcagcagcggcccgcggcggcgtaggccgccgtccacgagctgcgctgcgctcgcgtcgcccgacaagcagcgcacggccaacaagctcccggtgtcgtcgaggaaacagcagcagcaggaggaggaggaggaggtgagggcgacggactacaacgaggtcgcggcggcgctggagagcatctacaagctcagccccgccgtggaggtcgacgaggagaatgagcgccacggaggccacgacgacgacgacgagggcggcaagaaggccaagaagaagaggaaaagcagagtggcgggcaggagcacggtgatcgtgaagagccggcggcggcggcgcgggaggaggatggacctcgggaagcgggtggagatgaagagcgccgccgttagcagggagggggacgaagacgacgagggggagcgcgagcgcgagttcgaggagatgctgctgcgggagcactcggtgtcgacggacatgggcagccttgactggaagcgcatgaagatcccgccggtgctcacctcgtcgcagagcgcgcgcctcttcaagaccatgcagcccatgaaggccatcttcgaagtgcaggagagcttgcgagaggagctgcagagagaccccaccgacgcggagctcgccgaggccaccggcatgaccgtccaccagctccgccgccgcctcgacgtcggccgggccgccaggaacaagctcatcaagcacaacctccggctggtgccgtacgccatcaacaagtactacccagacatgggcaccgacgagcggttcgacgacctgtgccaggcgggcgccaacgggctgatcacggccatcgaccggttcgagcccaagcgcgggttccgcatctccacctacgcgctcttctggatccgccactccatcgtgcgcgccatgacgctgtcaagcttcacccgcttcccgttcgccatggagtcggagcggcaggagatcggcaaggcgagggaggagctggcgttcgagctcggccggccggccacggacgaggaggtgaggcggaaggtgggcatctccccgcagcggtaccgcgacgtgctgcggatgaccaggcccacctactcgctgcacgccaggaaccgggtcacgcaggaggagctcatcaacgaggtcaccgacgacgatgccatcggcgtcgacgccggcggcaggcacaacacgctgctccgcctcgccatcgacgacctcctggactctctgaaacccaaggagagcctggtgatcaggcagcgattcgggctggacggcaggggaaagcgcacgctcagcgagatcgccggcaacctcagcatctcgcgggagatggtgcgcaagtacgagctcaaggcgctcatgaagctcaagcacccaacaagggtggaatacctgcgcaggtacatgtgatgtgagcccactgatggagcttcttctgctgccgacctgtcgcaccatagcatggattcgatgatgtatagtatagtatgcattggctacatatggagtaactagtacaacattatacaacagagttactctgctttgcttgctgtatatatatgtttgtgtggctataccatctacttctcttctactgtatactagaagaagaaatgtacatatacaggaactcaggaacggtgtgtgcgtgtgggaatccagatgagtgagttcatttgagtgaggttgtattgcagacctcacatgcatgtaattcttaattaacatacatatattacctatggtacatataacatatgaaagaag

SEQ ID NO: 5525 - DNA, 2241 bp, Sorghum bicolor
gtcgccccgacgccttccggccgtcggatgcctcgtggcggccgttgttggtctggtctttggcggcacccgccgcggcaggcggcagccatatatggcgcggaggcgcgcgcgctccccgctcgagattccgtccacgccattgcgtccaactgcctccacacgacgagcaccccacccaccacggccaaagaaacccaacggcgcctgttgtgctgtgcctgtgcgccacaagacgaagcttcgaggatccaggggcaggcggctgtgtagctagctaggctgccatgacgtccaccgtgacgacgcccagcaggccgctcgccgccgggacccggccgcggcggtcctggcccgccgtgctctcgctcagcaagggcagcagcggcccgcggcggcgtaggccgccgtccacgagctgcgctgcgctcgcgtcgcccgacaagcagcgcacggccaacaagctcccggtgtcgtcgaggaaacagcagcagcaggaggaggaggaggaggtgagggcgacggactacaacgaggtcgcggcggcgctggagagcatctacaagctcagccccgccgtggaggtcgacgaggagaatgagcgccacggaggccacgacgacgacgacgagggcggcaagaaggccaagaagaagaggaaaagcagagtggcgggcaggagcacggtgatcgtgaagagccggcggcggcggcgcgggaggaggatggacctcgggaagcgggtggagatgaagagcgccgccgttagcagggagggggacgaagacgacgagggggagcgcgagcgcgagttcgaggagatgctgctgcgggagcactcggtgtcgacggacatgggcagccttgactggaagcgcatgaagatcccgccggtgctcacctcgtcgcagagcgcgcgcctcttcaagaccatgcagcccatgaaggccatcttcgaagtgcaggagagcttgcgagaggagctgcagagagaccccaccgacgcggagctcgccgaggccaccggcatgaccgtccaccagctccgccgccgcctcgacgtcggccgggccgccaggaacaagctcatcaagcacaacctccggctggtgccgtacgccatcaacaagtactacccagacatgggcaccgacgagcggttcgacgacctgtgccaggcgggcgccaacgggctgatcacggccatcgaccggttcgagcccaagcgcgggttccgcatctccacctacgcgctcttctggatccgccactccatcgtgcgcgccatgacgctgtcaagcttcacccgcttcccgttcgccatggagtcggagcggcaggagatcggcaaggcgagggaggagctggcgttcgagctcggccggccggccacggacgaggaggtgaggcggaaggtgggcatctccccgcagcggtaccgcgacgtgctgcggatgaccaggcccacctactcgctgcacgccaggaaccgggtcacgcaggaggagctcatcaacgaggtcaccgacgacgatgccatcggcgtcgacgccggcggcaggcacaacacgctgctccgcctcgccatcgacgacctcctggactctctgaaacccaaggagagcctggtgatcaggcagcgattcgggctggacggcaggggaaagcgcacgctcagcgagatcgccggcaacctcagcatctcgcgggagatggtgcgcaagtacgagctcaaggcgctcatgaagctcaagcacccaacaagggtggaatacctgcgcaggtacatgtgatgtgagcccactgatggagcttcttctgctgccgacctgtcgcaccatagcatggattcgatgatgtatagtatagtatgcattggctacatatggagtaactagtacaacattatacaacagagttactctgctttgcttgctgtatatatatgtttgtgtggctataccatctacttctcttctactgtatactagaagaagaaatgtacatatacaggaactcaggaacggtgtgtgcgtgtgggaatccagatgagtgagttcatttgagtgaggttgtattgcagacctcacatgcatgtaattcttaattaacatacatatattacctatggtacatataacatatgaaagaagagaacaacgaactccatgtttgcatagataatcatcatgcgtccaaaaacttcgtctccatggcattgacgatgatccatggttatac

SEQ ID NO: 5526 - DNA, 1848 bp, Zea mays
cgccattgcgtcgcactgcctccacacgacgactccacgaacacgagcggccacaagacgagatccaggcggctgtgtagctacgctgccatgacgtctaccgtgacgacgcccagccggccgctcgccgccgggagccgtccgcggcggtccggacccgccgtgctctcgctcagcaagggcggcggcggtcagcggcggcagcggcggctggcgccgtccacgagctgcgccgtgctcgcgtcgcccgacaagcagagcacggccaacaagctcccgctgtcgtcgaggaagcaggaggaggaggtggagaaggccacggactacaacgaggtcgcggcagcgctggagaccatctacaagctcagccccgccgtggaggtcgaggagaagaagcgccagggcggcaatgaagacgacggcggtggcgaggccaagaagaaaaggaagcgcagagtggcgggtaggagcacggtggtcgtgaggagccggcgtcggcgtggcgggaggaggatggacctcgggaagcgggtggagatgaagggcgcggccgccgctagcagagagcagcagcaggggggagaggagcaaggagagcgcgagttcgaggagatgctgctgcgggagcactcggtgtcgacggacatgggcagcctggactggaagcgcatgaagatcccgccggtgctcacctcatcgcagagcgcgcggctcttcaagaccatgcagcccatgaaggcgatcttcgaagcgcaggagagcttgcgagaggagctgcagagggaccccaccgacgcggaggtcgccgaggccaccggcatgaccgtccaccagctccgccgccgcctcgatgtcggccgggccgccaggaacaagctcattaagcacaacctccggctggtgccgtacgccctcaacaagtactaccctgacatgggcggcgacgagaggttcgacgagctgtgccaggcgggcgccaacgggctgatcaccgccatcgatcggttcgagccgaagcgcggcttccgcatctccacgtacgcgctcttctggatccggcactccatcgtgcgcgccatgacgctgtccagcttcacccgcttcccgttcgccatggagtcggagcggcaggagatcggcagggcgcgggaggagctggcgttcgagctcggccggccgcccacggacgaggaggtgcgggcgagggtgggcctctccccgcagaggtaccgcgacgtgctgcggatggccaggcccacatactcgctgcacgcccggaaccgcgtcacgcaggaggagctcatcggcgaggtcaccgacgccgaagccgtcggggtcgacgccggcggcaagcacgacgcgctgctccgcctcgccatcgatgacctcctggactctctgaaacccaaggagagcctggtgatcaggcagcggttcggcctggacggcagggggaggcgcacgctaagcgaggtcgccggcaacctcagcatctcgcgggagatggtgcgcaagtacgagctcaaggcgctcatgaagctcaagcaccccacaagggtggaatacctgcgcaggtacatgtgatcgggctgagctgagctgagcttcttctgctgctatggaatgcattgtaatccgaattcttctattattattgtataataatacaagactatagcagatatatagacgaaatgtacgtgtacaggaagacaggaatgaatggtgtgtgcgtttggggatccagatgagtgacttcatcttttaatttgcatgtaattaattcttaacgtacatacatacgaccgtcgtttatgtccattatctagataaagttcaagaatacgg

SEQ ID NO: 5527 - DNA, 1771 bp, Brachypodium distachyon
cgattcttccgtccatggcgtccaccgtgacgacgcccagcaggccgctcccgtcctccgctgggatcatcagccaacaccgccgccggtgctactgctgctgctcctgcaggcccgcggcggtgctcgcgctcgccggtggcggagctgctgcaaaaccgcggcggcgaagatctagtccggcggccagcaccagctgcgctgctctcaaatcgcccgagaagcagagcacggcggcggcggcggccaaggtccctccgcgccggcccgcgagaagaagcgccaccccggcgcccgaggaggccgcggcagctggcgccagcacggactacggcgaggtggccgccgtactcgagacgctgtaccagctgagccccaccgtcgttgaggaagacgaagaagagagttcgataaaggaggcggagaagaagaagcagaagcagaggaggaagacgaagacgctgccggcgatgaagacgacggtggtggtgaggagccggcggcgggggcggaggatggatctggggaagagggtggagatgcgggaggcggcggcgggtgggaagctgggcggcgacgacgaggcggcggaattcgaggaagctctgctaagggagcatggcgtgtcgacggacatgggcgggctcgactggcggcggaccaagatcccgcccgtgctctccgccgcgcacagcagccgcctcttcaagctcatgcagcccatgaaggcgatctttcaggtgaaggagaacctggagagcgagctggggagagagccgacggacgcagagctcggggcggccatgaacatggcggtgccccgcctgcgccgccaccgcgacgtcggccgggccgcccggaacaagctcatcaagcacaatctccggctcgtgctctacgcaataaacaggtactacccagacatggccggcggcggcgacggcgggaagttcgaggaggtgtgccaggcgggcgccaacgggctcatcacggccatcgaccgcttcgagccccggcgcggcttccggctctccacctacgcgctcttctgggtccgccactccatctcccgcgccatggcggcactctcctccttcacccacttccccttcgccatggaatccgagaggcgggagatcgggaaggcgagggaggagctggcgtgggagctggggcgggcgccgacggacgaggagacgatgaggaaagccggcgtgtcgccggcgaggtaccgcgacgtggcacggatgtcaaggccggcggggtcgctccacgcccggaaccgcgtgacgcaggaggagctcatcaacgaggtcaccgacgccgacgccgtcggggccgccgacacccaccggcacagcaaccggctcctccgcctcgccattgacgacctccttgattcgctgaagcccaaggagagcgtggtgatgaggcagaggttcggattggacgggagggggcggcggacgctgagcgagatcgcggggaacctgaggatctcgagggagatggtgcgcaagtacgagctcaaggcgctcatgaagctcaagcaccccacaagggtcgaatacctccgcagatacatgtagaacaagaagaaagcatcctcgttctgtttgcacgcgaccggcacatgtatatacgcaagatgacatagtcacgtagtagggatcatcattgattttgcgttcgatcaatacgtgtgtatatatgtacatggtgtggttcatgagctacctatttttttagacaaaagaaatttgtactgtaa

SEQ ID NO: 5528 - DNA, 2039 bp, Brachypodium distachyon
gccggtgaaggaaacgtctccccgtcagtcatcgttgcatagcttccacacgaacgaactcgccgagaaattctagacgcttccgtttgccgagatattctagagattcgagcgattcttccgtccatggcgtccaccgtgacgacgcccagcaggccgctcccgtcctccgctgggatcatcagccaacaccgccgccggtgctactgctgctgctcctgcaggcccgcggcggtgctcgcgctcgccggtggcggagctgctgcaaaaccgcggcggcgaagatctagtccggcggccagcaccagctgcgctgctctcaaatcgcccgagaagcagagcacggcggcggcggcggccaaggtccctccgcgccggcccgcgagaagaagcgccaccccggcgcccgaggaggccgcggcagctggcgccagcacggactacggcgaggtggccgccgtactcgagacgctgtaccagctgagccccaccgtcgttgaggaagacgaagaagagagttcgataaaggaggcggagaagaagaagcagaagcagaggaggaagacgaagacgctgccggcgatgaagacgacggtggtggtgaggagccggcggcgggggcggaggatggatctggggaagagggtggagatgcgggaggcggcggcgggtgggaagctgggcggcgacgacgaggcggcggaattcgaggaagctctgctaagggagcatggcgtgtcgacggacatgggcgggctcgactggcggcggaccaagatcccgcccgtgctctccgccgcgcacagcagccgcctcttcaagctcatgcagcccatgaaggcgatctttcaggtgaaggagaacctggagagcgagctggggagagagccgacggacgcagagctcggggcggccatgaacatggcggtgccccgcctgcgccgccaccgcgacgtcggccgggccgcccggaacaagctcatcaagcacaatctccggctcgtgctctacgcaataaacaggtactacccagacatggccggcggcggcgacggcgggaagttcgaggaggtgtgccaggcgggcgccaacgggctcatcacggccatcgaccgcttcgagccccggcgcggcttccggctctccacctacgcgctcttctgggtccgccactccatctcccgcgccatggcggcactctcctccttcacccacttccccttcgccatggaatccgagaggcgggagatcgggaaggcgagggaggagctggcgtgggagctggggcgggcgccgacggacgaggagacgatgaggaaagccggcgtgtcgccggcgaggtaccgcgacgtggcacggatgtcaaggccggcggggtcgctccacgcccggaaccgcgtgacgcaggaggagctcatcaacgaggtcaccgacgccgacgccgtcggggccgccgacacccaccggcacagcaaccggctcctccgcctcgccattgacgacctccttgattcgctgaagcccaaggagagcgtggtgatgaggcagaggttcggattggacgggagggggcggcggacgctgagcgagatcgcggggaacctgaggatctcgagggagatggtgcgcaagtacgagctcaaggcgctcatgaagctcaagcaccccacaagggtcgaatacctccgcagatacatgtagaacaagaagaaagcatcctcgttctgtttgcacgcgaccggcacatgtatatacgcaagatgacatagtcacgtagtagggatcatcattgattttgcgttcgatcaatacgtgtgtatatatgtacatggtgtggttcatgagctacctatttttttagacaaaagaaatttgtactgtaaatctgagtgggattgacaatacgtgtgtgtatatataggacggtctggtgtaattcttagcataagaagcggtgtaatttcagaatggcttcagagtccaattatgtttgttcaaatttgtcaatgcaacagtctaaggtgatttgaggatgactt

SEQ ID NO: 5529 - DNA, 867 bp, Pennisetum glaucum
ggtggcggtgggtacggtggcggcggcggcggtggtgggtacggcggcggcggtggcggctacacgcccggctactccggcaccggaacctgcgactactggaagagccacccggacgcgatcatctcgtgcatcgggtcgctggggagcatcctgggctccctgggcgacgtgtgcagcgccttcttcgggagcaagctgcagacgctgcaggacgcgctgtgcaacacccgcacggactgctacggcgacctcctccgcgagggcaccgccgcctacctcaactccatcgccgccaagaagcagtacgcctactccacgcagcaggtcaaggactgcatcgccgtcgcgctcacctccgaggtcgccgccgcggcgcaggccgccatgttcaagaaggccaactacgcctgccactattgatcggtcgatcgatgatgatgatgaagcttcggatccgtcgatcgtcagcgttgtcgtcgtcgtcgtgcttgttaaataagtccgtgtgtccatgatgatggatgaaggtccagacgtgtgtgtgtctcccccggatcgagtctcgccttgattatattagtttcagcccgtcgtacgtcttcccgcgcgcggccaagatgatgcatgatgccatgccgtctcgttgtccgctgcttcagtatgtagtgatgcttcctttcatgtcgttgttgctgctgatgtgataaataagatgagttggttggtagtgaaaaaggtagtggtgcttacgaagtgcatgtgtactcgcgcttgtttctgtcagcactggtggtggttgagaactttgagttgtactaatcgtgtacatggctacaactacacaatactgtcaacaacgacagg

SEQ ID NO: 5530 - DNA, 1195 bp, Zea mays
cgcgcgcccgcaggtgcagtgtcccagtgctacactcgcatgaactagcatcggccgctgctcctctctttctcctccaatcgtcggtggtcttttcgggcctgaaacatacgggagctagcagaggagagagctagagcaaaggaagagatcgatcgagagaggtagtaggcaagatgagcggcaaggctctcctagttgtcgccgtcgtcctcttggtgggcgtagcctctcggtgctcgggcagcaggggcctgcatcagcagggcgatcacgttgctgaacagaagtacggtaccggcaatgggtacggaggtggcggcggcgggtacggcggtgatgggggcggcggcggcggctacacgcccgggtactctggcaccgggacctgcgactactggaagagccacccggacgcgatcgtctcgtgcgtcgggtcgctgggcagcgtcctcggctccctgggcgacgcgtgcagcgccttcttcgggggcaagctgcagacgctgcaggacgcgctgtgcaacgcccgcgccgacggctacggcgacctcctccgcgagggcgccgcggcctacctcaactccgtcgccgccgccgccgctggcaagtacgcctacaccacgcagcaggtcaaggactgcatcgccgtcgcgctctcgtccgaggccgccgccgccgcgcaggccgccatgttcaacaaggccaactacgcctgccactattactagctagctagtcctcacagtttgccttcgatcgtctatctgcgtcgtctttccatgatgatgcatgacgacgcgcgcccgtctccttgtctggtgcagtagtagtgatgcttgctttcttgtcgttgtttgctgatgtgagaaataagacgatgctgggtagtaatagtaatataataacggtcgttgttcttacgaaatgcaccggtggatactcgcgcttgtttctgtctcgtcagcgctactggttgttgatatgcaatcataataattgtttggctatagacaaaaaaatgggtttttcaccaattttaaaaaccaaaaaatagcgataataattatgtaagtggatctacaagttggaaaacacagtagtacataatgacaataaataattacgtgagtggatctacaagttgaagagttgagaagagaatatgtgcatgaggttgattagaacgaaatta

SEQ ID NO: 5531 - DNA, 927 bp, Brachypodium distachyon
actcattcaagcccaaccatctctactgcctgctgctactggctactgttctctttgtccctcttaattttagaagcaaaggcaccgagtgagattaagatgggttgcaaggttcttctggtcacccttctattggtgggcatagcgtctcggagctctgccaggagcctggaggcaaatcacctgtctgagcagaagtccgggtacggaggcggtggtgggggctacggaagcggcggtggcggtggctatggaggaggcggcggcggcggtggctacggaggaggaggcggcggttacacaccgactccaacaccgacgacgcccagctacactggaacctgcgactactggaagagccacccggacaaaatcatctcgtgcgtgggctccctgggcagcatcgtgggctcgttcggcgacgtgtgcagctccttctacgggaccaagatacagaccctcaaggacgccctgtgcagcacccggaccgactgctacggcgaccttctgcgcgagggcgccgccgcgtacatcaactccatcgccgccaagaaggcccacttcgcctacaccacccaccaggtcaaggactgcatcgccctggcgctcacctctgaggtcgccgccgccgcgcaggccgccttgttcaagaaggccaaccaagcttgccactactaattaagccacctctacctgctacctggtagctagcgctggttaaataagtcatgtataccatacatgcgtcatgcgtacatgcgcgtataatttcctcagctagaatttgtgtgttttctttccatttgatgatgcatgccatgccacatcgttgtccgggcgcacctagtgatgcttacttgcttttcttgtcgttgtttgctgatgtaatacaattcaataatatgatttcaaagtttcttttttcta

SEQ ID NO: 5532 - DNA, 989 bp, Brachypodium distachyon
aacggtgggtgctgtgcgcttgtgtatatatatacctgcaggtgtagtgtctcaaggcactcattcaagcccaaccatctctactgcctgctgctactggctactgttctctttgtccctcttaattttagaagcaaaggcaccgagtgagattaagatgggttgcaaggttcttctggtcacccttctattggtgggcatagcgtctcggagctctgccaggagcctggaggcaaatcacctgtctgagcagaagtccgggtacggaggcggtggtgggggctacggaagcggcggtggcggtggctatggaggaggcggcggcggcggtggctacggaggaggaggcggcggttacacaccgactccaacaccgacgacgcccagctacactggaacctgcgactactggaagagccacccggacaaaatcatctcgtgcgtgggctccctgggcagcatcgtgggctcgttcggcgacgtgtgcagctccttctacgggaccaagatacagaccctcaaggacgccctgtgcagcacccggaccgactgctacggcgaccttctgcgcgagggcgccgccgcgtacatcaactccatcgccgccaagaaggcccacttcgcctacaccacccaccaggtcaaggactgcatcgccctggcgctcacctctgaggtcgccgccgccgcgcaggccgccttgttcaagaaggccaaccaagcttgccactactaattaagccacctctacctgctacctggtagctagcgctggttaaataagtcatgtataccatacatgcgtcatgcgtacatgcgcgtataatttcctcagctagaatttgtgtgttttctttccatttgatgatgcatgccatgccacatcgttgtccgggcgcacctagtgatgcttacttgcttttcttgtcgttgtttgctgatgtaatacaattcaataatatgatttcaaagtttcttttttctaagag

SEQ ID NO: 5533 - DNA, 1280 bp, Zea mays
cacattccaattccgccaccgccacttctttcttccccgcggacgcgtcgaaaagcgagcctctggggagactcgaggccactctgccttcccctcctatcctcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcgccagcaccagggccccgcgccgcaccgtcacgtgcttcgtgccgcaggacacggcggccccggccgctcccgtgccggcgctggacgaggaggccagggccgcggcggcgcggcgcgtcgcggagaaggaggcgcggaagcggtccgagcggcggacgtacctggtggccgccgtgatgtctagcctcggagtcacgtccatggccgtcgccgccgtgtactatcgcttcagctggcaaatggagggcggcgaggtgccggtgatcgagacgctgggcacgttcgcgctctccgtcggggcggcggtcgggatggagttctgggcgcggtgggcgcaccgggcgctgtggcacgcctccctgtggcacatgcacgagtcgcaccaccggccgcgcgagggccccttcgagctcaacgacgtgttcgccatcgtcaacgccgcgccggccatctccctcctcgcctacggcttcttccaccgcggcatcgtgcccggcctctgcttcggcgcgggcctggggattacgctgttcggcatggcctacatgttcgtccacgacggcctggtccaccgccgctttccggtcggccccatcgccgacgtgccctacttccgccgagtggctgcctcgcacaagatacaccacatggacaagttcggcggcgtcccgtatgggctcttcctgggaccaaaggagctggaggaggttggtggcctggacgagcttgttagcagtccggtgagtgaagctactgatactgaagacgcaggagaagaaaagacgcgtccagttgtatgcgttgtccgaacaagcgtgttcatgggccagagtgtgccaaatgagttctagctttaggcgagtgggccaaatgagtgtgggctgcgtcccagggtagtataagtactatgagtctgtaataatcaggacaagaagaatttaggtaaagtaatacatctatcgccatcttcctttcatt

SEQ ID NO: 5534 - DNA, 1499 bp, Secale cereale
gaaaccgaacctctcggcggcttgacgtctttaccttccttccggagtccactcagctctcttttcttccccattcgagctcctgagctccgtccctgtccatttatagcctgctcgaaagtgcacccgacccgaagggtgtgtagtaagagcgtccctccatggctgctggtctctccggctccaccatgaccagcttcgccgtcaagaaccctctgctggccgcggccgcgcgcttccggactctgccttcccgcgccggccggcctctcccgttctctccgttcacgcggacggcgcgcaggcgcgggcaagagaccgtcacgtgcttcgtcccgcaggagggccaggcgccgggcccggctcccgagcccgtgccttcgctggaggaagaggcggcgtccgcggcggcgcgccgcgtggcggagaggaaggcgcggaagcagtccgagaggcggacgtacctggtggccgccgtcatgtccagcctcggggtcacctccatggccatcgcctccgtgtactaccgcttcgcctggcaaatggagggcggcgaggtgccgatgaccgagatgctgggcacgttcgcgctctccgtcggcgctgcggtcgggatggagttctgggcgcagtgggcgcacaaggcgctgtggcacgcgtccctgtggcacatgcacgagtcgcaccaccggccgcgcgacgggcccttcgagctcaacgacgtctttgccatcatcaacgccctgccggccatcgccctcctcgcctacggcttcttccaccgcggcatcgtcccctgcctctgcttcggcgcgggcctcgggattacgcttttcgggatggcatacatgttcgtccacgacggcctggtccaccgccgcttccccgtcggccccatcgccgacgtgccctacttccggcgagtggctgccgctcacaagatacaccacatggacaagttcgagggcgtaccgtatgggctcttcctgggacccaaggagctggaggatgttggcggcctcgacgagctggagcaggagctcgccaggatcaaccggactcggagcatctgaactctggacatggcggcgtatggagctagaaggaacttgtgatctcatctagcagatgaactacatttcaagattttttttttacttttggttggttgctattgatttaattgatggtactggagaacgggagtccagaaccagaagcaatctgatgattaggcggtggtggtgtactccccgttactcggctgcagggggcgtggatgtgtccaaacagttctaggaagaagcacagatggttcatgaggttgttacatgatttttatttcttttcctgccttcgaggtctcacggcgtccacaattttgttttgtggagacccaagtccatgtcttgttcttatatatggctagaaactacgcttctgtgtataacaagtagagaaggttgtgaaccacttcaatgaaagtaaagttggcggtt

SEQ ID NO: 5535 - DNA, 1121 bp, Sorghum bicolor
gagcgagacagaccaggaactgacgcatttgaatcggaggccaccgctgcgctccgagggccctcctcgctcgccacccgctcacggagacagggagaggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgagcataaaaaatggagctgttcgctgcagctaaaaagcagccgccaccgccgccgctgtaacagtgattatccgagtgaaaaacagccccagctgcagccgcagctaacacgcccaatgctgttctactgtactacatacctcacctctaggctcatatgcatagttttaacactaaaataatcgctatggtattaaaaagaaaggtgaatagcttatttaatgatttatcgaagtaaatatatacatttgtatgtacactgtactggtttgacggcaagacattttatggtgaaaacttccacgtagtgttctgtttttatcgtaagctcggtgactggtgagggattccacggtgcctcaagtcctgaactcctgatcatgggattt

SEQ ID NO: 5536 - DNA, 1110 bp, Sorghum bicolor
cacgaagctggccgcggagcccgtgggagacgggcggtgcggaaagaggcaggggagggggaacgtcgtcgcgtcgcggtggagcgagacagaccaggaactgacgcatttgaatcggaggccaccgctgcgctccgagggccctcctcgctcgccacccgctcacggagacagggagaggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgagcataaaaaatggagctgttcgctgcagctaaaaagcagccgccaccgccgccgctgtaacagtgattatccgagtgaaaaacagccccagctgcagccgcagctaacacgcccaatgctgttctactgtactacatacctcacctctaggctcatatgcatagttttaacactaaaataatcgctatggtattaaaaagaaaggtgaatagcttatttaatgatttatcgaagtaaatatatacatttgtatgtacactgtactggtttgacggcaagacattttatggtgaaaa

SEQ ID NO: 5537 - DNA, 1037 bp, Setaria italica
gggaaattagcggcgcggagggaggccgcggtggagcaagggcggccaggaaccaagcccatttgaatcggtggccgccgctgcgccccggagcctcctcgctcgccacccgctcaccggagacagagagaggtcgatggcgagttcgctggcccgcctgggagcggcgctgccccgcgcgcgcccacgtcccggcgcgcgggtcctgccaccggggcggtgggacgccgcggcgctcggcgcctcccgccgcgccgcgccgaatgttggcagatgccaagttcattccgatgtcaaagtagcccctacatcggacctgaaggatggagacaactcatctaaaaattggaggatcaagatgctctatgatggtgattgcccgctctgtatgcgtgaggtaaacatgctgagagaaagaaacaaatcctatggagcaataaagttcgttgacataagctcgaaagattactctccagatgacaatcagggacttgattatgaaactgtcatgggaaggatacatgccattctttcagatggaactattgtcacagatgttgaggcatttagaagattatatgaggaagtaggacttggatgggtctatgctgttactaagtatgaacctgtagctaccatggcaaatgcagtatatggtgtgtgggcgaaataccgtatgcaaattacaggtcgacctccgctagaagagattatggcatcccgaaaagctgcaggcgaatgtaaagatgacaaagtatgcaagatgtgagcctgaaaatgttggtctgctctgctgcattcctcacctctagctatgcttagataggcacatacagagacttaacactaaaaataatcgtagtggtatgaaaagaatggagaatagattttataacagtttgttgaagtaaataatgatgcaattgtacactgtaccggtttgttgaaaagagtgaagatattttatgtgaaaacttccacaaactgttctcgtttttatcttaagctccgcgactggatcgcaccattcctccatg

SEQ ID NO: 5538 - DNA, 2442 bp, Oryza sativa
gttgcggagagaagagagagaagcaaggaacaaacggtcacggtggcgcaacgccgaccgaccaccagcaagcaaaggcaaccgcatttcaatcggcgcgccccgaagtaacccagtaacccacctcgatcgctcgacgcacgcacgccgcgtggagacgtcgcgagagatcgatccgaccgatggcgagctcgctggcacgcatgggtgcggcgctgccccgggtgcggccgcgcgccgcggcgcggttcccgccgccaccggggcggtgggactccgcggcggcgctccgccgcgctccggtgtacggtttcagatgtcaagttcactctgacgtcaaagtaggccctagttcagggttaaaggatggggaaaattcatctggaagttggaggatcaagatgctctatgatggcgattgcccactctgtatgcgtgaggtaaacatgctgagggaaagaaacaaatcctatggagctataaaatttgttgacataagctcgaaagattactctccacaagacaatcagaaccttgattatgaaactgccatggggaggatacatgctatactttcagatggaacaatagtcacagatgttgaggcatttagaaagctgtatgaggaagtgggacttggttggatttatgcagttactaagtatgagcctgtagctaaagtagcaaatgcaatatatggtgtgtgggccaaataccggatgcaaattacaggtcgacctccactagaggaaattatggaatccagaaaactagcagccgaatgcaaagatgataaagtgtgcaagatgtgagcaacggagcatcggtctgctgtggctaccattcccacatacgcttaggtagacacacaatcacacatacaaagctaatctcaccatacagatcattataatgcatagtgctatagataagattatgagaacgacgatacagtaatttgcctgagatgtaatagtatcatctgtacactgaataaatgacaaataaatcttcagaaaaaacaaagcagcagtatgattgatttttcatttcgcattgacttcttcgatactgcagtgagcttccttctcatcttcacgaaattctacggtttgagtcagttccaccttgagctgaccatattcaccgtatgctgcctgatcatgagccatctccatttcccttacagagcagctttgtgaacttaagaagcagcaagcaaccgaactttccatagaaccacagcacatcaagattgcaaattttgtagggcttcacaacttgcagtaacatctatctcatgaatatattatttttattgtgatacagctagcctattctgaaggattatcaagaatgttaagattatagtggtccctatcttttgaaagaaaaaaggaaaccgactgttatcaaaactctattctatgagactatgacgcactccattccaattaggatcagtcactctttactcacaagagattttttgacacaatccacgataccttcacagtcatcttcaggtattacacactcggtgtcagtttctaagcatttctgcatagagtgaggagaacgaaggtttccatgtgtttgacaggccttcatcgtcttgcaatgttctgcctcatcatctcgtatattgacaaatacatcatacaagttatctgcaacgggatatgaaaaacagtgaacccaacttcataggcaacacagcatatatactgttgaaaaaaaatcaggatccagaaactcagctaatgatcagctgaaagtgaatcaaaatgttggttcgatggatcttaaattagaactgtttgttaggaactttctgatgactttaatgacttgatcagatggatcagtgaaactgaactcacatgctacagataacatgcaagaatccaaagtttctgaaaagattaactcaaggaaactaataaaggaggaaagagagaaggacatccgtaccaattttaggtctcctagaacatgggactcttgctgtttgaaattcatctgggaaaacaaccatgtaagcaaagggaacagatggtaatgcttaatactgagcataaacgcttcaagtgtaaataaagccaaagcaagagctaaccgaataagtaaagatcctcattcaggtaatagtttaaagccgcctcgggagctggtagctttttcaactcatctgttagaaagaaagaaacatctgaaatcatggaactggaaaccagttgggaccaaaaaactttgcaacgcccagtgtgataccaaaattgttcaagaaagaccgagtaaaaaacgaactaataaaatggttcataatgactttagtctttcagatttattacagaaatggcagattgataattaagttcaacgaattcggtgtcacctcaacattgccaacttgatggtgcaagccaaaaagccaataag

SEQ ID NO: 5539 - DNA, 1493 bp, Oryza sativa
gcgtggagacgtcgcgagagatcgatccgaccgatggcgagctcgctggcacgcatgggtgcggcgctgccccgggtgcggccgcgcgccgcggcgcggttcccgccgccaccggggcggtgggactccgcggcggcgctccgccgcgctccggtgtacggtttcagatgtcaagttcactctgacgtcaaagtaggccctagttcagggttaaaggatggggaaaattcatctggaagttggaggatcaagatgctctatgatggcgattgcccactctgtatgcgtgaggtaaacatgctgagggaaagaaacaaatcctatggagctataaaatttgttgacataagctcgaaagattactctccacaagacaatcagaaccttgattatgaaactgccatggggaggatacatgctatactttcagatggaacaatagtcacagatgttgaggcatttagaaagctgtatgaggaagtgggacttggttggatttatgcagttactaagtatgagcctgtagctaaagtagcaaatgcaatatatggtgtgtgggccaaataccggatgcaaattacaggtcgacctccactagaggaaattatggaatccagaaaactagcagccgaatgcaaagatgataaagtgtgcaagatgtgagcaacggagcatcggtctgctgtggctaccattcccacatacgcttaggtagacacacaatcacacatacaaagctaatctcaccatacagatcattataatgcatagtgctatagataagattatgagaacgacgatacagtaatttgcctgagatgtaatagtatcatctgtacactgaataaatgacaaataaatcttcagaaaaaacaaagcagcagtatgattgatttttcatttcgcattgacttcttcgatactgcagtgagcttccttctcatcttcacgaaattctacggtttgagtcagttccaccttgagctgaccatattcaccgtatgctgcctgatcatgagccatctccatttcccttacagagcagcttgtgaacttaagaagcagcaagcaaccgaactttccatagaaccacagcacatcaagattgcaaattttgtagggcttcacaacttgcagtaacatctatctcatgaatatattatttttattgtgatacagctagcctattctgaaggattatcaagaatgttaagattatagtggtccctatcttttgaaagaaaaaaggaaaccgactgttatcaaaactctattctatgagactatgacgcactccattccaattaggatcagtcactctttactcacaagagattttttgacacaatccacgataccttcacagtcatcttcaggtattacacactcggtgtcagtttctaagcatttctgcatagagtgaggagaacgaaggtttccatgtgtttgacaggccttcatcgtcttgcaatgttctgcctcatcatctcgta

SEQ ID NO: 5540 - DNA, 2423 bp, Triticum aestivum
cccgcactgcgcccactccgatctccccagtcccctccaaatccctcgccggaaccctagccccgcgccgccgccatgcctccgcgccgctctaagggaggggccgggggcaaacccgaccccgaagccaccgacgccgagcccgtggagaccacggtcgacgccatgtccgaagacgaggccgacgacgacaactccaaggaggagtccgctgagagcggagctgaggatacggacggcgaggactccaaggaggaagccgccgagaccaaggccgaggagatggatgcggagcatcaagaggaagccgccgagaccaaggccgaggagacggtcgccgaacctgaagccaatggtgcagatgcggagaccaaagtcgaggcggcggatgccaaagtcgaagaggaagccgccgagagcgactctgagcgcgaggcggatgccggggaagccgatccagaagcggaagcagaggaaaccgacggcgagaatgacaagcaagccgctcgggccgacggcgagagtggagaggaagctgctgggtctggtggcgaggatgaagaagaagccgccggcacagacggcgacaacgccgctgaggttggtggcgagaaggtagatgcggattctgaagccgaaggtgagggtactgatgccgagcctgatgctcgcgaggaatcccctcctccctcccctccagcccgtagccgccgccgcaagcgagtggtcaaacctgacccgcccactgaggatgacgaggaagaggagacccctctgcccccacgccggcgccgacgtcgcaaagcaggagaacgtggcgactctccaccgccactgccggacaacctccggtgccgcagaagtgatggtaagaagtggcgctgctcagctcgtgcactccccactgtcagcttttgcgagtatcactatgccaaggctagcaagggcaagaaaccgccagccgatggggaggtccttgccgtggctctccaacggcaaaagaagaacaagagaaagggaagaaggcgcttaaatctggcgccagaatcaccaaaggccacaagggatctcccgaatggattgatgacaatctcaccggggagcagtggggcggtaggctctcctgtgacaacaaaggttggagtggacattcccgcaccacttcggcggtgctaccgttccaagaatgctgagccagtgcctgttggccctgtgaaggtcgttcctcatgcaatgagtaaagcaaaggcagcacagatgtcatgccaccgttgtgggttgaagaaggttgcacgcgttgtcaagtgcaagaactgtgaaaacaagtacttctgcaacagctgcatcaataaatggtattctgggatgtccaggaatgatataaagatcaaatgcccggtttgccgtggctgctgtgattgcaaaaagtgcacccttggtcagaccaagggaggtatgcagaaggaatcaccagctggtcaagggaaactaatcaggatcaaaatctgcaatcaccaattttacaagcttttaccattgaaacttgaccaggaacagcttgatgaattggaaatagaagctaaaatacaaggaacaaagttatccaatatccgcgtccaggtagctgaagacgaccagagcgggtcactttactgtaataactgtaagctgtccgtacaccaagtcttgagaagctgcccaagatgcccttttaagctgtgcctaagttgctgtcagaagatacgcgaagggaatatgtcaggcagcacccctgaagataaatttacacagcgactgttgcagcaagagtcagcccatgaggatggcagcataagttgcccttccattgagttgggtggctgtggcgactctctgctaaacttgatatatacaaccccgtccgacgaccagtcggaggaactcagctcaggagacgagctagatgctccaggcaatgactctggagttaaagatgcacaagctcattcctcgcctttagctgagagtaatggcagccttgccagattatccggtggtcagcaggaatccatgtccacataatctctggtgattttgcagcagatacccacccatgcatctttggggtgcgagatgggatatggtctgaggtgggtagaggttagagtggcttgtttagtgtgattatcggctgattttaggtctgtgacctacctggggatattctcgagtaattgtttggtgttgttcatctttgatttagacattatgtttgttgtcagtgtaaatagggtatgactatttatcatccatgagtcggaagcttgtatcggttcggtcgtactgtggttaatttagaaaactgtctgtactctatcggctattgcagtgttccagaaagtgagggattctattggattagtcgtctgaaataaaagtgactt

SEQ ID NO: 5541 - DNA, 2523 bp, Triticum aestivum
cttaaccccacccctctatctcggagacccctcgcagaaccagtaacccgcactgcgcccactccgatctccccaatcccctccaaatccctcgccggaaccctagccccgcgccgccaccatgcctccgcgccgctctaagggagggggcgggggcaaacccgaccccgaagccaccgacgccgagcctgtggagaccgcggtcgacgccatgtccgaagacgaggccgacgacgacaactccaaggaggagtccgctgagagcggagctgaggatacggacggcgaggactccaaggaggaagccgccgagaccaaggccgaggagatggatacggagcatcaagaggaagccgccgagaccaaggccgaggagacagtcgccgaacctgaagccaatggtgcagatgcggagaccaaagtcgaggcggcggatgccaaggtcgaagaggaagccgccgccgagagcgactctgagcgcgaggcagatgccgggaaggccgatccagaagcggaagcagaggaaaccgacggcgagaatgacgagcaagccgctcgggccgacggtgagagtggagaggaagctgctgggactggcggcgatgatgaagaagaagccgccgtcacagacggcgacaacgccgctgaggttcgtggcgagaacgtagatgcggattctgaagccgaaggtgagggtactgatgccgagcctgatgctcgcgaggaatctccccctccctcccctccagcccgtggccgccgccgcaagcgagtggtcaaacccgacccgcctactgaggatgacgaggaagaggagacccctctgcccccacgtcggcgccgacgtcgcaaagcaggagaacgtggcgactctccaccgccactgccggacaacctccggtgccgcagaagtgatggtaagaagtggcgctgctcagctcgtgcactccccactgtcagcttttgcgagtatcactatgccaaggctagcaagggcaagaaaccaccagccgatggggaggtccttgctgtggctctccaacggcagaagaagaacaagagaaagggaagaaggcgcttaaatctggcgccagaatcaccgaaggccacaagggatctcccgaatggattgatgacaatctcacccgggagcagtggggcggtaggctctcctgtgacaacaaaggttggagtggatattcctgcaccacttcggcggtgctaccgttccaagaatgctgagccagtgcctgttggccctgtgaaggtcgttcctcatgcaatgagtaaagcaaaggcagcacagatgtcatgccaccgttgtgggttgaagaaggttgcacgcgttgtcaagtgcaagaactgtgaaaacaagtacttctgcaacagctgcatcaataaatggtattctgggatgtccaggaatgatataaagatccaatgcccggtttgccgtggctgctgtgattgcaaaaaatgcacccttggtcagaccaagggaggtatgcagaaggaatcaccagctggtcaagggaaactaatcaggatcaaaatctgcaatcaccaattttacaagcttttaccattgaaacttgaccaggaacagcttgatgaattggaaatagaagctaaaatacaaggaacaaaattatccaatatccgcgtccaggtagctgaagacgaccagagcgggtcactttactgtaataactgtaagctgtccgtacaccaagtcttgagaagctgcccaagatgcccttttaagctttgcctaagttgctgtcagaagatacgcgaagggaatatgtcaggcagcacccctgaagataaatttacacagcgacttttgcagcaagagtcagctcatgaggatggtagcataagttgcccttccattgagttgggtggctgtggcgactctctgctaaacttgatatatgcaactccgtccgatgaccagtcggaggaactcagctcaggagacgagttagatgctccaggcaatgactctggagttaaagatgcacaagttcattcctcgcctttagcagagagtaatggcagccttgccagattatccggtggtcagcaggaatccatgtccacataatctctggtgattttgcagcagatacccacccatgcatctttggggtgcgagatgggatatggtctgaagtgggtagaggttagagtggcttgtttagtgtgattatcggctgattttaggtctgtgacctacctggggatattctcgagtaattgtttggtgttgttcatctttgatttagacattatgtttgttgtcagtgtaaatagggtatgactatttatcatccatgagtcggaagcttgtatcggttcggtcgtactgtggttaatttggaaaactgtctgtactctatcggctattgcagtgttccagaaagtgagggattctattggattagtcgtctgaaataaaagtgactcttgggtagttacattgaattggatctgtatatcctgatttccggtcctgtt

SEQ ID NO: 5542 - DNA, 2650 bp, Triticum aestivum
gcccgcactgcgcccactccgatctccccagtcccctccaaatccctcgccggaaccctagccccgcgccgccgccatgcctccgcgccgctctaagggaggggccgggggcaagcccgaccccgaagccaccgacgccgagcccgtagacgagaccacggtcgacgccatgtccgaagacgaggccgacgacgacaactccaaggaggagtccgctgagagcggagctgaggatacggacggcgaggactccaaggaggaaaccgccgagaccaaggccgaggagatggatgcggagcatcaagaggaagccgccgagaccaaggccgaggagacggtcgccgaacctgaagccaatggtgcagatgcggagaccaaagtcgaggcggcggatgccaaggtcgaagcggaagccgccgagagcgactctgagcgcgaggcggatgccggggaagccgatccagaagcggaagcagaggaaaccgacggcgagaatgacaagcaagccgctcgggccgacggcgagagtggagaggaagctgctgggtctggtggcgaggatgaagaagaagccgccggcacagacggcgacaacgccgctgaggttggtggcgagaaggtagatgcggattctcaagccgaaggtgagggtactgatgccgagcctgatgctctcgaggaatcccctcctccctcccctccagcccgtagccgccgccgcaagcgagtggtcaaacctgacccgcccactgaggatgacgaggaagaggagacccctctgcccccacgccggcgccgacgtcgcaaagcaggggaacgtggcgactctccaccgccactgccggacaacctccggtgccgcagaagtgatggtaagaagtggcgctgctcagctcgtgcactccccactgtcagcttttgcgagtatcactatgccaaggctagcaagggcaagaaaccaccagccgatggggaggtccttgccgtggctctccaacggcaaaagaagaacaagagaaagggaagaaggcgcttaaatctggcgccagaatcaccaaaggccacaagggatctcccgaatggattgatgacaatctcaccggggagcagtggggcggtaggctctcctgtgacaacaaaggttggagttgacattcccgcaccacttcggcggtgctaccgttccaagaatgctgagccagtgcctgttggccctgtgaaggtcgttcctcatgcaatgagtaaagcaaaggcagcacagatgtcatgccaccgttgtgggttgaagaaggttgcacgcgttgtcaagtgcaagaactgtgaaaacaagtacttctgcaacagctgcatcaataaatggtattctgggatgtccaggaatgatataaagataaaatgcccggtttgccgtggctgctgtgattgcaaaaagtgcacccttggtcagaccaagggaggcatgcagaaggaatcaccagctggtcaagggaaactaatcaggatcaaaatctgcaatcaccaattttacaagcttttaccattgaaacttgaccaggaacagcttgatgaattggaaatagaagctaaaatacaaggaacaaagttatccaatatccgcgtccaggtagctgaagacgaccagagcgggtcactttactgtaacaactgtaagctgtccgtacaccaagtcttgagaagctgcccaagatgcccttttaagctgtgcctaagttgctgtcagaagatgcgcgaagggaatatgtcaggcagcacccctgaagataaatttacacagcgactgttgcagcaagagtcagcccatgaggatggcagcataagttgcccttccattgagttgggtggctgtggcgactctctgctaaacttgatatatacaaccccgtccgacgaccagtcggaggaactcagctcaggagacgagctagatgctccaggcaatgactctggagttaaagatgcacaagctcattcctcgcctttagctgagagtaatggcagccttgccagattatccggtggtcagcaggaatccatgtccacataatctctggtgattttgcagcagatacccacccatgcatctttggggtgcaagatgggatatggtctgaggtgggtagaggttagtgtggcttgtttagtgtgattatcggctgattttaggtctgtgacctacctggggatattctcgagtaattgtttggtgttgttcatctttgatttagacattatgtttgttgtcagtgtaaatagggtatgactatttatcatccatgagttggaagcttgtatcggttcggtcgtactgtggttaatttagaaaactgtctgtactctatcggctattgcagtgttccagaaagtgagggattctattggattagtcgtctgaaataaaagtgacttttgggtagttacactgaattggatctgtatatcctgatttccggccctgttattgatatgtagcatccccatattcgtgtttcgtgattcctccagctcagcgaaaatgaattgcgtgtgcagctggggtaatcgcaaggccgccatggtgctacccacacccgctaggtattgcaaatgttgttcatatagagtgggattgtggaaattgctgttggagttt

SEQ ID NO: 5543 - DNA, 2577 bp, Secale cereale
gtaacccgcactgcccccgctccgatctccccaatcccctccaaatccctcgccggaaccctagccccgcgccgccgccgccatgcctccgcgccgctctaagggagggggcgggggcaagcccgaccccgaagccaccgacgccgagcccgttgacgaggctgtggcgaccgcggtcgacgcgggggacgccatgtccgaagacgaggccgacgacgacaactccgctgagagcggagctgaggatactgacggcgaggactccaaggaggaagccgccgagaccaaggccgaggtgatggatgcggagcatcaagaggaagccgccgagaccaaggccgaggagatggtcgccgcacctgaagccaatggtgcagatgcggagaccaaagtcgaggcggcggatgccaaagtcgaagaggaagccgccaagagcgactctgagcgcgaggcggatgccggggaagccgatccagaagcggaagcagaggaaaccgacggcgagaatgacaagcaagccgctcgggccgacggcgagagtggagaggaagctgcagggactggtggcgaggatgaagaagaagccgccggcacagacggcgacaacgctgctgaggttggtggccggaacgtagatgcggactctgaagccgaaggtgagggtactgatgccgagcctgatgctccggaggaatcccctcccccctcccctccagcccgtggccgccgccgcaagcgagtggtcaaacccgacccgcctactgaggatgacgaggaagaggagacccctctgcccccacgtcggcgccgtcgtcgcaaagcaggagaacgtggtgactctccaccgccattgccggacaacctccgctgccgcagaagtgatggtaagaagtggcgctgctcagctcgtgcactccccaccgtcagcttttgcgagtatcactacgcgaaagctagcaaggggaagaaaccgccagccgatggggaggtccttgccgtggctctccaacggcaaaagaagaacaagagaaagggaagaaggcgcttaaatctggcgccagaatcaccaaaggccacaagggatctcccgaatggattgatgacaatctcaccggggagcagtggggcggtaggctctcccgtcacgacaaaggttggagtggatattcccgcaccactccggcggtgctaccgttccaagaatgctgagccagtgcctgttggccctgtgaaggtcgttcctcatgcaatgagtaaagcaaaggcagcacagatgtcatgccaccgttgtgggttgaagaaggttgcacgtgttgtcaagtgcaagaactgtgaaaacaagtacttctgcaacagctgcatcaataaatggtattctgggatgtccaggaatgatataaagatcaaatgcccggtttgccgtggctgctgtgattgcagaaagtgcacccttggtcagaccaagggaggtttgcggaaggaatcaccaggtggtcaagggaaactaatcaggatcaaaatctgcaatcaccaattttacaagcttttaccgttgaaacttgaccaggaacagcttgatgaattggaaatagaagctaaaatacaaggaacaaagctatccaatatccgcgtccaggtagctgaagatgacccgagcgggtcactttactgtaataactgtaagctgtcggtgcaccaagtcttgagaagctgcccaagatgcccttttaagctgtgcctaagttgctgtcagaagatacgtgaagggagtatgtcaggcagcactcctgaagataaattcacacaacgactgttgcagcaagagtcagcccatgaggatggcagcataagttgcccctccattgagttgggtggctgtggcgactctctgctaaacttgatatatgcatccccgtccgacgaccagtcggaggaactcagttcaggggacgggctagatgccccaggcaatgactctggagttaaagatgcacaaactcattcctcgcctttagctgagagtaatggcagccttgccagattatccggtggtcagcaggaatccatgtccacataatctctggtgattttgcagcagatacccacccatgcatctttgaggtgcgagatgggatatggtctgaagtgggtagaggttagagtggcttgtttagtgtgattatcggctgattttaggtctgtggcctacctggggatattctcgagtaattgtttggtgttgttcatctttgatttagacattatgtttgttgtctatgtaaatagggtatgactatttatcatccatgagtcggaagcttgtattggttcggtcgtactgtggttgatctagaaaaactgtctgtactctatcggctattgcagtgttccagaaagcgagggattctattggattagtcgtctgaaataaaagtgactttggggtagttaaaattgaattggatactaaagtaaaaaaaaaaaaaaaaaaaaacaaaaaaaaaaaaaaaacaaaaaaaaaaaaaaaacaaaaaaaactagaagactacgaacgaacgacaacaacggagggaagag

SEQ ID NO: 5544 - DNA, 738 bp, Triticum aestivum
atctcctctgcaagctcttcttccatttccaaccgcaatggctgcgaggagaaccattcttctcgccatggctgccatggccatcctgagcacggcgtctgcggcaatctacaacgtgggcgagccgggcggcgcatgggacctcagcaccaactacggcacttgggcgtcctctaggaacttccaaaccaacgaccagatcgtcttcaagtactcccctcaggcacacgacgtcctcgaggtcagcaaggcagactacgactcttgtagcaccgccagccccgtcaccattctcaactccgggaatgatgttgtcaccctcaacgccaccggcacccgctacttcatctgcggattccctggtcattgtgcgggtggcatgaaggttaagattgatgtcatgccaggctcctcctctacgtcacctgccccggccagcggcccaagtgcaaccaacgcacccccgccgacacctgtctccaccgccaccaatgtggaggccaccgggtttggcctcgccgttttgcttgctgttgtcggcctcatggcttgagagtgcatctccacattcgcaggcacatgtgtactttatgtttagttaggaaattattactagcaattatctgtgtgtatactcaagtagttatgtgtatgttgcatgtatttgggctttgcgttttactgattcattttggaggatttgttaaaaaagattattttagtcttataaaaaaaaaa

SEQ ID NO: 5545 - DNA, 832 bp, Triticum aestivum
atctcctctgcaagctcttcttccatttccaaccgcaatggctgcgaggagaaccattcttctcgccatggctgccatggccatcctgagcacggcgtctgcggcaatctacaacgtgggcgagccgggcggcgcatgggacctcagcaccaactacggcacttgggcgtcctctaggaacttccaaaccaacgaccagatcgtcttcaagtactcccctcaggcacacgacgtcctcgaggtcagcaaggcagactacgactcttgtagcaccgccagccccgtcaccattctcaactccgggaatgatgttgtcaccctcaacgccaccggcacccgctacttcatctgcggattccctggtcattgtgcgggtggcatgaaggttaagattgatgtcatgccaggctcctcctctacgtcacctgccccggccagcggcccaagtgcaaccaacgcacccccgccgacacctgtctccaccgccaccaatgtggaggccaccgggtttggcctcgccgttttgcttgctgttgtcggcctcatggcttgagagtgcatctccacattcgcaggcacatgtgtactttatgtttagttaggaaattattactagcaattatctgtgtgtatactcaagtagttatgtgtatgttggatgtatttgggctttgcgttttactgattcattttggaggatttgttaaaaaagattattttagtcttatagaacatttgtcctgaaacacgttcgttctgaaccgtaagagcccagacttttgtaacttaaacttgcattacagaaagatatacacatagattggacatgcaa

SEQ ID NO: 5546 - DNA, 691 bp, Triticum aestivum
cctaccttataatctcctctgctagctctccttgcagttccaaccgcaatgactgccacgagaatcattcttctcgccgttgctgtgatggtcgtcctgagcaccgcgtcagcggcaatctacaacgtcggtgagcctggcggagcatgggacctcggcaccaactatggcacatgggcatcctccaggaactttcaaaccgatgaccaaatcatcttcaagtactcccctcaagcgcacgatgtcctcgaggtcagcaaggccgactatgactcctgcagcactgccagagccatcaccaccctcaactctgggaatgatgtcgtcaccctcagtgcctccggcacccggtacttcatttgcggcttccctggccattgcgcaggcggcatgaaggtcaagatagatgtcacgtctggctcctcctcgtcagccgccccagccagcggaccaagtgcaagcaatgctcccccgccaacccctgtctccgctgccaccaatgtggaggccaccgggtttggcctcgccgttttgcttgccgttgctggcctcctggcatgagtgcatctctgtagtcgcaggcacatgtgtactttgtgtatagtcaagtaattattactggcaactatctgtgtgtatagtcaagtagttatgtgtatgttggacatattctggttttgcgttttgctga

SEQ ID NO: 5547 - DNA, 689 bp, Triticum aestivum
taatctcctctgctagctctccttgcagttccaaccgcaatgactgccacgagaatcattcttctcgccgttgctgtgatggtcgtcctgagcaccgcgtcagcggcaatctacaacgtcggtgagcctggcggagcatgggacctcggcaccaactatggcacatgggcatcctccaggaactttcaaaccgatgaccaaatcatcttcaagtactcccctcaagcgcacgatgtcctcgaggtcagcaaggccgactatgactcctgcagcactgccagagccatcaccaccctcaactctgggaatgatgtcgtcaccctcagtgcctccggcacccggtacttcatttgcggcttccctggccattgcgcaggcggcatgaaggtcaagatagatgtcacgtctggctcctcctcgtcagccgccccagccagcggaccaagtgcaagcaatgctcccccgccaacccctgtctccgctgccaccaatgtggaggccaccgggtttggcctcgccgttttgcttgccgttgctggcctcctggcatgagtgcatctctgtagtcgcaggcacatgtgtactttgtgtatagtcaagtaattattactggcaactatctgtgtgtatagtcaagtagttatgtgtatgttggacatattctggttttgcgttttgctgattcattt

SEQ ID NO: 5548 - DNA, 753 bp, Secale cereale
tcaggttcaaacgatcaacacagcacctggcttacaatctcatctgctagctagctctcctttcagtttctaccgcaatggctgccacgagaaccattctcctcgccgtggccgcgatggccatcctaagcaccgcatcggcggcaatctacaacgtcggcgagccaggtggtgcatgggacctcagcactaactacggcacctgggcgtcctccaggaacttccaccccaacgaccagatcgtcttcaaatactctcctcaggcacatgacgtcctcgaggtcagcaaggtcgactacgactcctgcagcaccaccagtcccatcgccaccctcaactccgggaatgatgtcatctccctcaacgccaccggcacccgctacttcctctgcggctttccaggccactgcactgggggaatgaaggtcaagatcgatgtcgtatcaagccggtcctcttcctcaccggccccggccagcggccccagtgcaagcaacgcacccccgccggtgcccgtctcagccgccacctctatgggggccatagggtttggcctcatcatcttgctagccgttgccggcctcgtggcttgagtgcgtctctaaataaacatagaagttattattactattaagcatatgcgtgtacattggtatagtcaagtaattatactgtatgttttatgtattcagacttcaagttttgcgtattcattttggaggatgagtaataaaggttcttttagtatcaaaa

SEQ ID NO: 5549 - DNA, 2712 bp, Triticum aestivum
acttgctacacgaacgtgcgcagcgcagatataggcgagtcactgacgctagctgcgcacaaagcggcgagagctcagctcactcacggtcacgcgcaccgctagctcccatggactactcgacctccctcctccgcctcaccttcctcgccctcggcgccgccctggtcctcatcgtcgcccgctccgccttccgcctgccgctcgccatcgacgccccggccgcctccttcttgcacggcgccggcggctgcacccgattctcgccgtgggcctgccgctcaccacgaaccgagaagagcacgccacgccgcccgtcgcacgagtccgacgtgccgcgccacccgctcgacccgctcacggtgacggaggtcaaccgcgcgcgcgagctcctccgcgcgcacccgccgttcgcgtcggcgccgtcggccctggccgtgcacgcgctcgcgctcgacgagccagacaagcccgccgtccggcgctggcgaaagggcgcccacgcgatcccgccgcgccgcgccgtcgcggtcgtccgcttccagggggagtcccacgtgctcgccgtcgacctcgcggccggcaaggtcgcccctctgcccgtgccggcctccggctacccgacgatgaccatggacgagcagaccgccctctgcgcggcgccgttcagagacccggcgttcaacgccaccatccggcgccgcggcgtgcgcctggccgacgtcgcgtgcctgcccatctcccccgggtggtacggccccgccgaggacggcggccgccggctcatcaagagccagtgctactccaccgagggcaccgccaacttctacatgcgccccatcgagggcctcaccgtgctcatcgacatggacacccggaaggtggtccacatctccgaccgcggcgccggcatccccatcccggccgccaagaacaccgactaccgccttgccgccaacgacgacgccgatagattcgggtaccagacggtgcgggcgccgtcgatggagccggcgccggagggcccaggaatccagattgaggacgggcacacggtgcggtgggccgggtgggagttccacctcaaggcggacgcgcgcgcgggactggtcgtgtcccgcgcgacggtgcaggacccggccaccggggcgcggagggaggtgatgtacaagggcatggcgtcggagctgttcgtgccgtacatggacccgacggaggcgtggtacttcaagacctacatggacgccggcgagtacggcttcggcctgcaggccatgccgctggtgccgctcaacgactgcccgcgccacgcgcggtacatggacggcgtcttcgtcgccgccgacggccggccgtacgtgcgggagaacatgatctgcgtcttcgagcgctacgccggcgacatcgcgtggcgacactccgagagccccatcaccggcatggacataagggagtctcgtccgaaggtgacgctggtggcgcgcatggcggcgtcggtggccaactacgactacatcgtcgactgggagttccagaccgacggcctcatccgcatcaaggtcgggctcagtgggatcctgatggtgaagggcacgccctactcccacatgaaccaggtccggcaaaacgaggagatgcatggcaccctcctctccgagaacgtcattggtgtcatccatgaccactacgtcaccttccgcctcgacatggatgtcgatggcgccgacaactccttcgtccgcgtggacatggcccgccaagacaccgcgcctggcgagtccccacggaggagctacctcaaggccacacgtcatgtcgcgagcacggagaaggacgcccgggtccggctgaagctctatgagccggccgagttccacatcatcaacccgacgaagaagacacgtgtcggcaaccccgtgggctacaaagtcgtcccggccggcactgccggtagcttgctggaccccgaggaccctccgcagaagaggggcgcattcacaaacaatcagatttgggtcacgccctacaacaagaacgaagaatgggccggtgggctgttcgtgtaccagagcaaaggggaggacacgctggctacttggtcggagagggaccgtccgatcgagaacaaggacctggtgctgtggtacacgttggggttccaccacatcccttgtcaggaggacttccccatcatgcccactgtgtcgtccagcttcgacctcaagccagtcaacttcttcgagagcaaccccatcctcaagcagcggcccaccatggaaaaggacctccccgtctgtgccgctaccgcctaagaccaatcgacaggatacatatgtgctcgaagacaaagcccgggcacattgggttgttgcctgggccatgaggccgtgcgtaggcttccgggagcaccatgcagtgcccctagccttgcataatcatgcctccgcctctggctagccaatagtctagtatgtgtagctctatgtttgtgttgtatggtgcttctctcttcatgaatatgaagtgtatttaggctgtctaagaatcttggaccgatggtaataaattgggtgccgacgtgaaggaaaattaaaccattggattcatgtttaaaagtaatattgtattgttgtagtttgtaactattaatattatgcatataacaaatttgtggccagagttttagcttggacaatcaaaatacatcctaac

SEQ ID NO: 5550 - DNA, 914 bp, Triticum aestivum
atccgcaacggccatggccttcgtcgccatccacgcccgcctcgccgtccttccccctcgcctcagcgccgccgcctcgtctctccgctccgcccctccccgcacccgcctcccgccgctcaggacctcaaccggacacgtcttccgcagcctgcggtgccgacgccggccgtgtcgcgctcgcgccgcctccatctccatcaccgcgtcgctcgacctcaccgaggacaacgtccggcaggccatcgtcgacgccaaagccgagctggcccagctgttcgacacgtcggtcggcataacagggcaagttgatctggcggagctggacgggccgttcgtgaagctccggctgaagggcaagttctggcacacccgcgccaccgtcgtcgcgcggattggcaactacctcaagaaccgcataccggaaatcttggaggtggagatcgaggatgaggaccagcttgacgacagcccagcggcttactgagggtaaagaacatgcaggctcttgctgagggtgcctactttttcagtaccgggtttggtcggcgtaggctcatattttttgtaagcggaaaaggatgtggcaatgatgttgtatatttatgcgttagctaactcatgccaatgatgtttaagttggtgtgctcatcatactgaatttggaatgccactgcatcagaatgttactctagtcatgcgttcattatgtcttgtgatgtggacagcccccgggtagaactgaaagcccacaatcactcacagaatgggttcacatgatcccccatgagccatctataattaaactgtaatttctatgtaaatacggatgcggcgttatgttattctcgcacttcttacggcctcgcatcatatttttcatgtttgaagagaattttggtgctgtaagctga

SEQ ID NO: 5551 - DNA, 927 bp, Triticum aestivum
actcccgcccgcctcccactcgaaaagaaagataaggaggccccacccggcagcgtctgctctcagcatccgcaacggccatggccttcgtcgccatccacgcccgcctcgccgtcctcccccctcgcctcagcgccgccgcgtcgtctctccgctccgcccctccccgcacccgcctcccgccgctcaggacgtcaaccggacacatcttccgcagcctgcggtgccgacgccggccgtgtcgcgctcgcgccgcctccatctccatcaccgcgtcgctcgacctcaccgaggacaacgtccggcaggctatcgtcgacgccaaagccgagctggctcagctgttcgacacgtcggtcggcataacagggcaagttgatctggcggagctggacgggccgttcgtgaagctccgactgaagggcaagttctggcacacccgcgccaccgtcgtcgcgcggattggcaactacctcaagaaccgtataccggaaatcttggaggtggagatcgaagatgaggaccagcttgacgacagccccgcggcttactgagggtaaagaacatgcaagctgttgctgagggtgcctacttttcagtaccgggtttggtaagcgtaggatcatcttttttgtaaacggaaaggatatggcaatgatgttgtacacttatgcgttagctaactcctgccaatgatgcttaagttggtgtgctcatcatactgaatttggaatgcaactgcatcagtatgtcactgtagtcatgtgttcattatgtcttgtgatgtggacagcccccgggtagaactgaaagcccacaatcactcacagaattggttcacatagtcctccatgaaccatctgtaattcgattgtaatttctacgcacagacggatctggtgttatgttattctgataaaaaaaaaa

SEQ ID NO: 5552 - DNA, 1229 bp, Triticum aestivum
ctcctgcctgcctcccactcgaaaagaaagataaggaggccccacccggcagcgtctgctctcagcatccgcaacggccatggccttcgtcgccatccacgcccgcctcgccgtcctcccccctcgcctcagcgccgccgcctcgtctctccggtccgctcctccccgcacccgtctctcgcctctcaggacttcaaccggacacatcttccgcagcccgcggtgcaggcgtcggccgtgtcgcgctcgcgccgcctccatcaccgcgtcgctcgacctcaccgaggacaacgtccggcaggccatcgtcgacgccaaagccgagctggcccagctattcgacacgtcggtcggcataacagggcaagttgatctggcggagctggacgggccgttcgtgaagctccgcctcaagggaaagttctggcacacccgcgccaccgtcgtcgcgcggattggcaactacctcaagaaccgtataccggaaatcttggaggtggagatcgaagatgaggaccagcttgacgacagccccgcggcttactgagggtaaagaacatgcgagctgttgctgagggtgcctactttttcagtaccgggtttggtaggcgtaggatcatcttttttgtgagcggaaaggatatggcaatgatgttgtacacttatgcgttagctaactcctgccaatgatgcttaagttggtgtgctcatcatactgcatttgggatgcaactgcatcagtatgtcactgtagtcatgtgttcattatgtcttgtgatgtggacagccctcgggtagaactgaaagcccacaatcactcacagaattggttcacatagtcctccatgaaccatctgtaattcgattgtaatttctacgcacagacggatctggtgttatgttattctgatatgctgttcttgtgcttctcacgcgctcggatcgtatttttcatgtttgaataggattttggtgctgtaagctgatctcttatagtcatgtgcatccttgtgatgaaatgccgaagtcggtacaagtctgaatcttgatctcctgcatcggggttggggagtacttttgagaccattttctgttcgattgtcggatgttttggcagccgcgaactatgtcatgcacgaggctccaaccgcttgcgttcgcgtacatggattgatttgcaccagctacatctgattacagagacctgatattcaatgtactcttcaagg

SEQ ID NO: 5553 - DNA, 496 bp, Brachypodium distachyon
tctacacatccacaacggccatggccttcgtcgccatccacgcccgcctcctcgtcttccgccctcccctcgccgccgccgcctccgcctcctcgtctctccactcggctcctttccccgccggtctaccgcgcctcagtacagcagccggaaatcgctgcagcctacggcaccggcgccggcctggtcgcgctcgcgcggccgccatcacggcgtcgctcgacctcaccgaggacaacgtccggcaggccatcgtcgacgccaaagccgagctggcccagctgttcgacacgtcggtgggcataacagggcaagttgatctggcggagctggacgggccgttcgtgaagctccgcctcaagggaaaattctggcacacccgcgccaccgtcgtcgcgcggatcggcaactacctcaagaaccgtataccggaaatcttggaggtggagatagaagatgagaaccagcttgacgatagccccgcggcttactgagg

SEQ ID NO: 5554 - DNA, 2557 bp, Brachypodium distachyon
ttccactggaaaagataaggaggtccacctggcagcgtctgctctacacatccacaacggccatggccttcgtcgccatccacgcccgcctcctcgtcttccgccctcccctcgccgccgccgcctccgcctcctcgtctctccactcggctcctttccccgccggtctaccgcgcctcagtacagcagccggaaatcgctgcagcctacggcaccggcgccggcctggtcgcgctcgcgcggccgccatcacggcgtcgctcgacctcaccgaggacaacgtccggcaggccatcgtcgacgccaaagccgagctggcccagctgttcgacacgtcggtgggcataacagggcaagttgatctggcggagctggacgggccgttcgtgaagctccgcctcaagggaaaattctggcacacccgcgccaccgtcgtcgcgcggatcggcaactacctcaagaaccgtataccggaaatcttggaggtggagatagaagatgagaaccagcttgacgatagccccgcggcttactgaggtatcccccgtgcattaacaatatctggtgttcactaactatttcagacttgtgatgtattgaaactatccaattaggttctagctaggagaaacacctgagatcttgagatttctaatcagtgtagtagtatttttgccagtgcaattggtagaattctcttgttccaaaatggtggcacaacacaaccacataaccagttttgcaatatacactaccccgatgctatcaaagttggagttctgattcatgacgacaggagacatgaaaccacattcagtatctcgtaatttcattgcatatcagcatgtgccgatcaggggggcaagaactaaaatcataaaaaagttagaaccattgaagaatgaaaacatgcatcttgttatgcaatatgaatgaaaaattccatatctattaattttataagttggctctacgagcacagaggtaaaatgtagccttttagatttctaatttctacttttatagattttacgtcatcaatttaaacaaagtaaagataacatacgaagactcacacgctcacatcttgcgatattggaaatatttccgacgagtgtcgtagctagcgccttagacgatcgtcgcaactggaagaagcacggcgctgccggctgcgcaagaacagaagaaaacaattggatcgattttgatcgatcgggcgacgtgcagacgtgtgtggttttgcggcaaggctttctattgaccaacccgcttccttggctaagcagcccaatggcccaagatctggcccagctgggcggttctttgctgttgctgctggttagagagaattgtggcggggggtcgaaaatgctaaaagccagctgaagtcacagcgaccactgctgctgaaagttggtagatttgttacccccctgaatccgtccctggtgctgatggggggcagtgctgatggtactaaccacctgcaatggattaatgcccattgtcttttgtgaacccccattaaagtgcaatttaaatatatatgcaattgcctgatactttctcatgtttcagttgcttttgtacccacagttcaagtgcaattgcaaaaaaagaaatacaaaactaaaattgaaggaaaacaaatacagaactaaaaaaatgactgaaacttcacaaaattggctcaattgaccgaaacaacattgaacaaaaagaatgacttaaaattttgaaattttcaggtgcgtgtgttttagctattccattactataatggcctgaatgactgaagcgtagttgttgaaggaccaagtgtactagaagtctggaaccaactaaacacctttcttttgtagccacatggtttgggacttcaggaattggcagttgcatagatggattggtttgcaccagctacactctgattgcagggatacgagatttgaatgtatctgttcagggtaaaggacatgcaagctgtggagggggggggggggggggggctatttttcaatacaaggtttggtatgatcatgtttttgtaagtggaaaggatctagcaatgatgtgctcatgtgctgactgtattctttatattcattatattcatatgttaactactgcaaatgatgtttaggttggtgtggtcatcaactcatcatattgcatctataactaatgcatagggaattcctgtgttcattatgtcttgtgatgtggatggccctctggtagaaccataagttggttgcaaccataacatgctcacaagtgtcatggtggttcaattttcatttctaagtacagatggatgcggagttatgttatttcgatatctagtttttccatttcttaagcacttgggctatgttttaagaacttgaaaacaatttggtggtgttgtaagctgatatctacattcacgtaaatccttgtgatgcaatgtggaaccgagcattggaaactttaactgatgctgcttctgagacctatttctagtcaattgtcaaatgttttcgtggcaatgaactatctgacgagcaaggcg

SEQ ID NO: 5555 - DNA, 681 bp, Avena sativa
cacccggcagcgtctgctctccacatccgcaacggccatggcgttcgtcgccatccatgcccgcctcgccgtgttcccccctcgcctctccgcccccgccgccgcgtcgtctctccgctccgcttctttcgtttctcgtcttccgacgctcaggacgccaaccggaaacagacgccgcagcctacggtaccggcgccgtccgtgtcgcgctgctaccatcaccgcgtcgctcgacctgaccgaggacaacgtccggcaggccatcctcgacgcgaaagtcgagctggcccagctgttcgattcttcggtgggcatgacaggggaagttgatctggcggagctggacgggccgttcgtgaagctccgcctcaagggcaagttctggcacacccgcgccaccgtcgtcgcgaggatcggcaactacctcaagaaccgtataccggaaatattggaggtggagatagaagatgagagccagctcgatgacagtcctgcggcttactagggcaaagaacatgctgttggtgcctgctttttcagtaccgggttggttaggatcatatattttttgcaagtggaaaggatatatagcaatgatacgctcctgtgcagctgtgccgattgtatgtttatgtgttaactaactaactccggccaatgatgtttgagttggtgcggtca

SEQ ID NO: 5556 - DNA, 861 bp, Triticum aestivum
atggccttcgtcgccatccacgcccgcctcgccgtcctcctccctcgcctcagcgccgccgcctcgtctctccggtccgctcctccccgcacccgtctctcgcctctcaggacttcaaccggacacatcttccgcagcccgcggtgcaggcgtcggccgtgtcgcgctcgcgccgcctccatcaccgcgtcgctcgacctcaccgaggacaacgtccggcaggccatcgtcgacgccaaagccgaggcaagcaaggcatccttccctctcacatccacaccgaagaacatatctctggcccagctattcgacacgtcggtcggcataacagggcaagttgatctggcggagctggacgggccgttcgtgaagctccgcctgaagggaaagttctggcacacccgcgccaccgtcgtcgcgcggattggcaactacctcaagaaccgtataccggaaatcttggaggtggagatcgaagatgaggaccagcttgacgacagccccgcggcttactgagggtaaagaacatgcgagctgttgctgagggtgcctactttttcagtaccgggtttggtaggcgtaggatcatcttttttgtgagcggaaaggatatggcaatgatgttgtacacttatgcgttagctaactcctgccaatgatgcttaagttggtgtgctcatcatactgcatttgggatgcaactgcatcagtatgtcactgtagtcatgtgttcattatgtcttgtgatgtggacagccctcgggtagaactgaaagcccacaatcactcacagaattggttcacatagtcctccatgaaccatctgtaattcgattgtaatttctacgcacagaccggatc

SEQ ID NO: 5557 - DNA, 1622 bp, Hordeum vulgare
tggggaacttgcggaggagagtgaaggagcgtttctctctcccacgggtcgtcgccatcgccatcgtcatcgagcaccacgccaccaccaaccgtccaccggtggtggccactggccagcgaagccatgacgttatcccctcacacactctgcccaccccttctccccccgctcccgccaagttcaaaccgccgcccgccgccgcctcgctcccgcccctgcccccgcatactcctcccggcgctcgcgggccgccggagccgcgtacacctcgcgcggccgccgcgcgcgggtgcgggcgcaggggacggcatggcgtcgcaggacgcgcactaccccacgctgctcgagcacatgggccgggccggcgcgcccgccgacctcgccgtcctcgtcgcccacatccaggccgcctgcaagcgcatcgccgcgctcgtcgcgtcccccggcaacgccgacctctcgcgggccaagccggcggccgctgccggtggggcgtccgcggccgggcgcgacgcgcccaagccgctcgacgaattgtcgaacgagatcatcctgtcgtcgctccaaagctccggaaaagttgcagtggtggcgtccgaagaaaacgatctccccgtttggatgtgcgatgacggcccctatgttgttgtcaccgacccgctcgatggttctcgcaacatcgaggtgtcgatccccactggaacgatattcgggatatacgataggctggtggaactcgaccatctccctgtggaggagaaagctcagctcaattcactgcagagcggttctcgcctggtcgctgctggatacgtcctatattcatctgccaccatcttctgcatcagtttcggtgagggaactcatggcttcacgttggatagatcgacaggagaatttgttctgacgtatcctttcatgcaaataccccctagaggacagatatattcagtgaatgatgcgcggtatttcgactggccagagggcctgaagaagtacatcgacacgatcagacaaggcaaggggcagaatcccaagaagtactcggctcggtacgtgtgctcattggtcgctgattttcaccggacggtcatatacggtggagtcgcaatgaacccgagggatcaccttcggttggtatacgaggcaaatcctctcagtttccttgccgagcaggcaggggggcgaggctcggatggcaaaaccagaatcctctccattcagcctgtgaagctgcaccagaggctgccattgttccttgggagcatggaggacatgcttgagctagaaagctatggggatgtccagcagaaagtcaatcctggatacgatgtttaatgttaagcatgaggtgataccttcaggtattgtagcttacaatgaggtaaccattgtatatggcaaagtctatatttgcaagcacaatgttgtttctgtgtattgttttgtttgccttcttttgcctaggcaattgcagagtactgcataatggaggtcagaaaaatttgctgtagttcactgtggaaacaaaatatgcaatatggctatttgtttgtaacttccatacattttactctcggaaacatatacttacaagtgaccaatgttaaatatttaag

SEQ ID NO: 5558 - DNA, 1551 bp, Triticum aestivum
ccgcctccctcccgctcccgcccccgcgcagtccgccgcagcgaactcctcgccggggacggcatggcgtcgcacggctcgcaccccacgctgctcgagcacatgggccgggccggcgcgcccgccgacctcgccgtcctcgtcgcccacatccaggccgcctgcaagcgcatcgccgcgctcgtcgcgtcccccggcaacgccgacctctcgcgggccaagccggccgctgccggtgctgcatccgcggccggccgcgacgcgcccaagccgctcgacgaattgtcgaacgagatcatcctgtcgtcgctccaaagctccggaaaagttgcggtggtggcgtctgaagaaaacgatctccccgtttggatgtgcgacgacggtccctacgttgttgtcaccgacccgcttgatggttctcgcaacatcgaggtgtcgatccccactggaacgatattcgggatatacgataggctggtggaactcgaccagctccctgtggaggagaaagctcagcttaattcactgcagagcggttctcgcttggtcgctgctggatacgtcctgtattcatctgccaccattttctgcatcagtttcggtgcaggaacccatggcttcactttggatagatcaacaggagaatttgttctgacgcatccttccatgcaaataccccccagaggacagatatattcagtgaatgatgcgcggtatttcgactggccagagggcctgaagaagtacattgacacgatcagacaaggcaaggggcagcatcccaagaagtactcggctcggtacgtgtgctcgctggttgctgattttcatcggacgatcatatacggtggagttgcaatgaacccgagggatcaccttcggttggtttacgaggcaaatcctctcagtttccttgccgagcaggcaggggggcgaggctcagatggcaaaaccagaatcctctccattcagcctgtgaagctgcaccagaggctgccattgttcctggggagcatggaggacatgcttgagctagaaagctatggggatgtccagcagaaggtcaatcctggatacgatgtttaatgttaagcatgaggtgaaatcttcaggtattgtaatgaggtaaccgatgtagggcaaaatctacatttgcaagcacagtattgtctctgtatttatttatttatgccaccttgcctaggcaattgcagagtactgcacagtggaggtcagaagaatttgctgtagttcactgtgaaaacaaaatatgcaatatggctattttactttttgtaacttctatacattttactctcaagaatatataacttacgagtgaccaatgttaaatatttaaggcaatttttctggcaacccttgcattagcagatctatgtaagctgtagtagtaaccaattttgatgcagtaactgaacttattcatcaaacactagtgctgaaagcctaaaactgtgaaaatggaaggtcataacaaggacacatgaataaaccctgcagatgaccaaaatacattccactcttctatct

SEQ ID NO: 5559 - DNA, 1463 bp, Brachypodium distachyon
atgccgttatccgctttctgccttcccctttcccttccgctcccgacaacttcaaaccaccgccaccacccaccgccgccgtctctcccccgccccaaccccctcctcctccacctcccgccactcacgcgccgccgcgtccccctcgaccggccaccacgcgcgggcgccactgacatggccgcgcctgcagcggcggcctcgcccccgacgctgctcgagcacatgggccgcgccggcacgcccgccgacctcgcggtggtcatcgcacacatccagggcgcctgcaagcgcatcgcggcgctcgcggcgtccccagccaacgcggacctctcgcgggggaaggcgggcggcggagcggcggtcgtggcggccgggcgggacgcgcccaagccgctcgatgaattgtcgaatgagatcatcatgtcatcgctccaaagttcaggaaaagtcgcagtggtggcgtctgaagaaaatgatctccccgtttggatgtgtgatgatggtccgtatgttgttgttactgacccgcttgatggttctcgcaacattgaggtctccatccccactggaacaatatttggggtatacaataggctggtggaactcgaccatctccctgtggaggagagagctcaactcaattcactgcaaagtggtactcgcatggtcgctgctgggtatgtgctgtattcatctgccaccatcttctgtataagctttggcacaggtacccatggcttcacattggatcgttcgaccggagaatttattctaacgcatccttccatccaaataccacctagaggacagatatattcggtgaatgatgcacgatatttcgactggcctgagggcctaaagaagtacattgacacaatcaggcaaggcaaggggcagcatccaaaaaagtactctgctcggtatgtgtgctcgctggttgctgattttcatcggacactcatatacggtggagtggccatgaacccaagggatcatcttcggctggtttatgaggcaaatcctctcagtttcctggccgagcaggcaggaggtcgaggctcagatggcaagaccagaatcctttccattcagcccgtgaagctgcaccagaggctgccattgttcctgggaagcacggaggacatgcttgaattggaaagctatgaagatgtccagcagaaggtcaatcctggctatgaggtttagtgttatgcaggaggtgaaatcttgaggtattgtagcatagaacgatgtaaatggtgtacctatgggaagtttatttgcaggaccaacgttgtctctgtgtcttgttttttaacctatgcggttacagagaatcctgcatagtataagatagaataacttgctgcagttcgctgtgtcaatggaagatgatgtgaattttgggagctctcacataactttatttaaagaatataattagttccttgtgatttcac

SEQ ID NO: 5560 - DNA, 1495 bp, Brachypodium distachyon
tttccccgatcaacacgagtggccaaactatgccgttatccgctttctgccttcccctttcccttccgctcccgacaacttcaaaccaccgccaccacccaccgccgccgtctctcccccgccccaaccccctcctcctccacctcccgccactcacgcgccgccgcgtccccctcgaccggccaccacgcgcgggcgccactgacatggccgcgcctgcagcggcggcctcgcccccgacgctgctcgagcacatgggccgcgccggcacgcccgccgacctcgcggtggtcatcgcacacatccagggcgcctgcaagcgcatcgcggcgctcgcggcgtccccagccaacgcggacctctcgcgggggaaggcgggcggcggagcggcggtcgtggcggccgggcgggacgcgcccaagccgctcgatgaattgtcgaatgagatcatcatgtcatcgctccaaagttcaggaaaagtcgcagtggtggcgtctgaagaaaatgatctccccgtttggatgtgtgatgatggtccgtatgttgttgttactgacccgcttgatggttctcgcaacattgaggtctccatccccactggaacaatatttggggtatacaataggctggtggaactcgaccatctccctgtggaggagagagctcaactcaattcactgcaaagtggtactcgcatggtcgctgctgggtatgtgctgtattcatctgccaccatcttctgtataagctttggcacaggtacccatggcttcacattggatcgttcgaccggagaatttattctaacgcatccttccatccaaataccacctagaggacagatatattcggtgaatgatgcacgatatttcgactggcctgagggcctaaagaagtacattgacacaatcaggcaaggcaaggggcagcatccaaaaaagtactctgctcggtatgtgtgctcgctggttgctgattttcatcggacactcatatacggtggagtggccatgaacccaagggatcatcttcggctggtttatgaggcaaatcctctcagtttcctggccgagcaggcaggaggtcgaggctcagatggcaagaccagaatcctttccattcagcccgtgaagctgcaccagaggctgccattgttcctgggaagcacggaggacatgcttgaattggaaagctatgaagatgtccagcagaaggtcaatcctggctatgaggtttagtgttatgcaggaggtgaaatcttgaggtattgtagcatagaacgatgtaaatggtgtacctatgggaagtttatttgcaggaccaacgttgtctctgtgtcttgttttttaacctatgcggttacagagaatcctgcatagtataagatagaataacttgctgcagttcgctgtgtcaatggaagatgatgtgaattttgggagctctcacataactttatttaaagaatataattagttccttgtgatttcaccat

SEQ ID NO: 5561 - DNA, 1204 bp, Panicum virgatum
caacaaacgctcacatcggttttcgtcgcatcgaatccatcctccgcttcgtccacccaggtccgggcggcgccggggcggagaaaatggcctcggcggcgtcggcgccggtattcgagagggtggccgggatccgaaccatcgccgagtccggccgctttaaggcctggttcttggaccagttcggcgtccttcacgacggcaagaagccgtaccccggcgccattttggcattggagaagcttgcagtgaatggggcgaagatggtgataatcagcaattcctctaggcggtcgtctgtgacaatggataagctcaagagcctgggtttcgatacatcttgtttccttgcgaccatcaccagtggggagctcacacatcaacaccttctcaagaggaatgatccatggtttgctgcccttggaagaaagtgtatccatatcacctggggcaatcgtggtgcaatttctctagagggtcttggtttgcaagttgtggacaatgttgatgatgcagaatttatattagcccatggtactgaagcccttggttcaccttccggtgaccctcttcccaaaagtcttgaggagcttgagcaggttctaatgcttggcctagaaaggcagcttccaatggtggtagctaatccagattatgtcactgtcgaagctcgagatttacgtgtcatgcctggcactctggcagctaaatatgagaatctcggtggtgaagtgaaatggatggggaagcctgataaggtgatctataactcagcaatgtccctagctggagttgatgctcatgaatgtatcatggtgggtgattcactgcaccacgatgtcaaaggggcaaatgcatcaggaatcacatctgcgttcattactggagggattcatgcagctgaacttgggctcagtgaatctggagaaactactggggaggatgccatcaatacactctgtagcaagcatggatcatatccctcatatgttttgccttcatttacatggtagaaacacggtccagttatttcttttggggtgcacccttaacaccggaaagtgattttaggcaaacaactgttctggaagagtctcaggaggatgaagcccttggaggcattactttctgtacttaataattgccatgattgttcgataatcgttgattttgatcaataaaagctggatgcagctatgctatg

SEQ ID NO: 5562 - DNA, 1105 bp, Saccharum officinarum
ctgagagcctctagaaatcacgcgacgcgaccgaccaccatggccgccgccgccgcgctcctcctctcgccgcggctcgtgtcgctcccacctcacccgagcctcgccccaggcttcatcaagagaccaacgtctgaccccctcggccgccgtggcgccggcgcgaggctccgggccgtcggggacggacccggcgccgggctgcccgaccagaccacggtctacaacggcgcctacgggccttggaccgtggaggactccgacgtccgcgaggtgctgctgtaccggtcggggctggtgacagcggcggcgtcgttcgtggccgcggcctccgcggcgttcctgccggagggcaaccccgccgccggcgccggcgcggccgacctcctgtacgccgccggcgcctcggggctgggcctgtcgctgctcctcatccacatctacgtcaccccgatcaagcgcttcctccaggcgctgtgggccgtcggggtgctcggctccctcgggacctacctcgtcgccgctcgcccgctggacgagggcctcgtgcagtacgtgctggagcaccccgccgcgctctggttcgtcggccccacgttcgccgcgctcacaggcctcgtcttcaaggaaggtctctgctatgggaaattggaagctggcatcttaacgtttgttatccctggtcttcttcttggaatttgtctggtttaatggataacagcacaaagacaaccctcttaggagcgtggatgcttctttttacggttttcgcagctagaaagttccaacagcccatcaaggacgacattggggacaaatcagttttcatgttcaacgcactccctgaagaggaaaagaacgctttgatccagaaactcgagaggcaaaaggcacagcagcagtttgagtagacattattgtagcttgtcttggtgtagccaatagtttgtccatgaaagtttatagctgatgtatatgatagttctgaaaattgaaaaaaaaaacatcaaggcatatgaagatgagaatattgtaatcgagatgtaattgcaaatctgtttgatcacaggtaagttgtaattacacatataacagttttgttgtc

SEQ ID NO: 5563 - DNA, 1130 bp, Sorghum bicolor
gcccataagcccactgtgaatccgggaagcggccactggccaccaccgtgcaccgtcaccggaaacgaaacgaacgcccaaaatatcgcgtccgacgcatctgctggctgagagtcactgagagcctctagaaaccacgcgacgccaccgaccaccatggcagccgcgctcctcctctcgccgcggctcgtgtcgctccctcctcacccgagcctcgcccccggcttcaccttcatcaagagaccaacgtcttaccccctcggccgccgcggcgcgaggctccgggccgtcggggacggccccggcgcggggctgacctccgaccagaccacggtctacaacggcgcctacgggccctggaccgtggatgactccgacgtccgcgaggtgctgctgtaccggtcggggctggtgacggcggcggcgtccttcgtggccgcggcctccgcggcgctcctgccggagggcaaccccgcctccggcgccggcgccgccgacctcctgtacgccgtcggcgcctcggggctgggcctgtcgctgctcctcatccacatctacgtcaccccgatcaagcgcttcctccaggcgctgtgggccgtcggggtgctcggctccctcgggacctacctcgtcgccgcccgcccgctggacgagggcctcgtgcagtacgtgttggaccaccccgccgcgctctggttcgtcggccccacgttcgccgcgctcactggcctcgtcttcaaggaaggtctctgctatggaaaattggaagctggcatcttaacgtttgttatccctgggctgcttcttggacatctatctggtttaatggataacagcacaaagacaacccttttaggagtgtggatgcttcttttcacggttttcgcagctagaaagttccagcagcccatcaaggacgacattggggacaaatctgttttcatgttcaatgcgctccctgaagaggaaaagaacgctttgatccagaaactggagaggcaaaaggcacagcagcagtttgagtagacattgtagcttgtcttggtgtaagccaatattttgttgagctctcgtgccagaatcgagtaaatgcaaaattcatcactgaatggatgagatgaaggttgagg

SEQ ID NO: 5564 - DNA, 1786 bp, Sorghum bicolor
atctgctggctgagagtcactgagagcctctagaaaccacgcgacgccaccgaccaccatggcagccgcgctcctcctctcgccgcggctcgtgtcgctccctcctcacccgagcctcgcccccggcttcaccttcatcaagagaccaacgtcttaccccctcggccgccgcggcgcgaggctccgggccgtcggggacggccccggcgcggggctgacctccgaccagaccacggtctacaacggcgcctacgggccctggaccgtggatgactccgacgtccgcgaggtgctgctgtaccggtcggggctggtgacggcggcggcgtccttcgtggccgcggcctccgcggcgctcctgccggagggcaaccccgcctccggcgccggcgccgccgacctcctgtacgccgtcggcgcctcggggctgggcctgtcgctgctcctcatccacatctacgtcaccccgatcaagcgcttcctccaggcgctgtgggccgtcggggtgctcggctccctcgggacctacctcgtcgccgcccgcccgctggacgagggcctcgtgcagtacgtgttggaccaccccgccgcgctctggttcgtcggccccacgttcgccgcgctcactggcctcgtcttcaaggaaggtctctgctatggaaaattggaagctggcatcttaacgtttgttatccctgggctgcttcttggacatctatctggtttaatggataacagcacaaagacaacccttttaggagtgtggatgcttcttttcacggttttcgcagctagaaagttccagcagcccatcaaggacgacattggggacaaatctgttttcatgttcaatgcgctccctgaagaggaaaagaacgctttgatccagaaactggagaggcaaaaggcacagcagcagtttgagtagacattgtagcttgtcttggtgtaagccaatattttgttgagctctcgtgccagaatcgagtaaatgcaaaattcatcactgaatggatgagatgaaggttgaggaaacagaggttatctgctgaccacaagcctatgaacttgcatatcattgaggaaagcgacctgataatggtgtcacagaaacagatcacattcgcttacatatcatgagcaacctgataatggtccatccactgagttcagtctgaaactacaaactttatcaccacccaaagggcgcaagcaattctcttataactttcacatacagtacaactcaacatataataagcttgggaatgcaagtggcagatccccaagacattggctactacttggtagcacccaatcacacggtaaacgattgcataccatgcaaacagttcctagtaagttcttaaaacatcaaggaatttgctcagggccctgggtgacctaaacaagtagctatgaatcgccatttaacctatcaatggtacataaatctgagaatgcagttgcagagtcgactagtttgcatagatagcgccatttgagttcagagaggagccgttctggggaacatcagctccctctacttctgacaagaagccattctcaaagaatgccgaatggagggcttgtacacactgttttgcctcactgtcattgactaccaaggaaatgttcacctgcatgagtacataataagtattactgcaacatatagaaattccataaaagcttgttttatgttttgtaagaggggatggataccttggacgccccttgtgagatcatctggacattaacaccatttctacgtagaacattgaat

SEQ ID NO: 5565 - DNA, 1322 bp, Setaria italica
gtcgccctggcctctccccgtccccggaaacaagaacgctggaaatatccaggcgggtgcatagcagttgcagacagcctcaagaattgcccgaccatggccgccgccgcagccgcgctcctcctccagccgcgggtcgtgtcgctaccacctaaccccagactcgcccccaccttcaacaaaccagcgcctaccttcgcccccatcggccgccgccgcgccggcgcgaggctcagggccgtcggtgacggccccggcgccgggctcgccgaccagaccaccgtctacaacggcgtctacgggccctggaccgtcgaggactccgacgtccgcgaggtccttttgtaccggtccgggctggtcaccgccgcggcgtccttcgtggccgctgcctccgccgcgttcctccctgaggggaacgctgccggcgacgccatcaggcagagcatcgaccttctctacgccgccggcgccgcggggctggggctgtcgctggtgctgatccacatctacgtcaccccaatcaagcgcttcctccaggcgctgtgggcggtcggggtcctggggtccgtcgggacctacctcgtcgccgcgcagccgctggacgagggcctggtgcagtacgtgctggagcatccggccgcactctggttcgttggcccgacctttgctgcgctgacaggtctcgtcttcaaggaaggtctctgctatgggaaattggaagctggcatattaacctttgttatccctgggcttcttctcggacatctgtctggtttgatggataacagcacaaagtcaggccttttaggagtgtggatggttcttttcaccattttcgccgcaaggaagttccaacagcccatcaaggatgacattggggacaaatctgttttcatgttcaacgccctccctgaagaggaaaagaatgctctgatccagaagctcgagaggcaaaacgaacagaagtttgagtagagattgtaggcaggtggcgtagccaatagtttgtccatggaagtttgtagcagatgtatatgatagttccgaatatcacgacatgcgtcaatgcatagatgaagatgagaatattgtaaccgagatgtagatggaaatctcttaggttacaagtcagacaacaagcatacgttgtggatggcctatggactcaaggctatgcagcattgtctgtacgttttttgtttgcaacatcactgtatatatttttcagtttgttttgttgttctcccatgcattcttgggtaaacacgacattcatctgtatgaataagatgcatggaggtggagaaaagttatctgct

SEQ ID NO: 5566 - DNA, 1207 bp, Cenchrus ciliaris
  misc_feature (623)..(623): n is a, c, g, or t
  misc_feature (809)..(809): n is a, c, g, or t
  misc_feature (826)..(826): n is a, c, g, or t
  misc_feature (967)..(967): n is a, c, g, or t
  misc_feature (1034)..(1034): n is a, c, g, or t
  misc_feature (1060)..(1060): n is a, c, g, or t
  misc_feature (1113)..(1113): n is a, c, g, or t
  misc_feature (1143)..(1143): n is a, c, g, or t
  misc_feature (1145)..(1145): n is a, c, g, or t
  misc_feature (1155)..(1155): n is a, c, g, or t
  misc_feature (1178)..(1178): n is a, c, g, or t
  misc_feature (1180)..(1180): n is a, c, g, or t
  misc_feature (1182)..(1182): n is a, c, g, or t
  misc_feature (1191)..(1191): n is a, c, g, or t
  misc_feature (1194)..(1194): n is a, c, g, or t
  misc_feature (1202)..(1202): n is a, c, g, or t
  misc_feature (1205)..(1205): n is a, c, g, or t
ggagagcctcaagaaattgcacgaccatggccaccgccgtcgcagctgcgctcctcctccagccgcggttcgtgtcgctgccacctaaccccagcctcgcccccaccttcgtcaacaaaccagcgccttctttcgccgccatcagccgccgccgcgccggcgcgaggctcagggccgtcggtgatggccccggtgccgggctcgccgaccagaccaccgtctacaacggcgtctacgggccatggaccgtcgaggactccgacgtccgcgaggtcctgctgtaccggtccgggctggtcaccgccgcggcgtccttcgtggccgcggcctccgtcgcgttcctccctgaggggaacgccgccggcgatgccatcaggcagagcatcgacctcttctacgccaccggcgccgcggggttggggctgtcgctggtgctgatccacatctacgtcaccccaatcaagcgcttcctccaggctctgtgggcggtcggggtcctggggtccgtcgggacatacctcgtcgccgcgcagccgctggacgagggcctggtgcagtacgtgctggaccatccggccgcactctggttcgttggcccgacctttgctgcgctgacaggtctngtcttcaaggaaggtctttgctatgggaaattggaagctggcatcttaacctttgttatccccgggcttttttttggtcatctgtttggcttgatggataacagcacaaagtcaggccttttaggagtgtggatggttcttttcaccattttcgccgcaaggaagttccaacagcccatcaaggangacattggagacaaatntgttttcatgttcaatgcgctccctgaagaggaaaagaatgctttgatccagaagctggaaaggcaaactgaacagaagtttgagtagacggtataggtggtttgggcgtagccaatagtttgttcatggaagtttatagntgatgtatatgatagttccaaatatcacgacatacatcaatgcatagatgagatgaagctggagatnttttagcagatgttgtggatggcctntggcctcaaggctatgcagcattgtttgtacctttgttgtttgcaacgtcacngtatatatttttcagtttgttttgttgttntntcatgcattnttgggtaaatacattcattcatntntntgaacaagntgnttggaggnggnga

SEQ ID NO: 5567 - DNA, 1934 bp, Saccharum officinarum
acctcctccccactgcgccccattcccccgcggccgcaaccgtcgccgccgcagttcgcagcaagatcggcggggagacggacagacgggcgcggctcctgtatctatctgtcggtgggagaccgcgtgtgtcggttaggcggcgggtgggaaggaagaatggcggcgggcggcagatccgtcgcgtgctgtgccgccgtgctgctcgcggccgcgctgctcctctccgcaccgactaccacagaggcttatgattcgctggatccaaccggcaatatcactataaaatgggatattatgcagtggactcctgacggatacgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttgcttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccaaagaacttcactcttaagactccaggccctgggtacacatgtgggcgtgccattgttggcaggccgacgaagttttggagtgcggatgggcgcagggcaacccaagctctaatgacatggaatgtgacctgcacatattcccaatttcttgctcagaagactccatcctgctgtgtatctctctcatcgttttataatgacacaatcgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcacacatgtgcccgataagaatccactggcatgtgaagctcaactacaaggaatactggagagtgaaaatcactatcacaaacttcaactttcgcatgaattacacgcagtggaacttagtagctcagcatccaaactttgataatatcactcagttgttcagcttcaactacaaaccacttactccatatgggggtggcataaatgatacggcaatgttctggggtgtaaaattctacaatgatttgctgatgcaagccggcaaacttggaaatgtgcaatcagaactgcttctccgcaaggactcccggactttcaccttcgaaaagggatgggccttcccacgccgggtgtacttcaatggtgataattgtgtcatgccatctcctgaaaattatccatggctgccgaatgcaagccctctaacaaaacaaccattgacactcccactcttggtattctgggttgccttggctgctctgttggcttatgcatgatgagtgggatcaagaggtttagcaagcttcaagttgatgtcggattccatgaggtgcactgcaacaggtcatttgttcattcaaatccatggttgcacagaagagatgaggcgatgccaagaaaaagttgatatgtgtgtgtgtgtttttgtaagttaaggggccaaaatgtatttcttgtttggtatatagcagccctacagcactttggtgaacttagttactgcaaattaggtaattacagttgcaccttttgtattttatagcaaacccagaatttttcattggattatatgactgctcctcttgtagtaaatgcaaggcttccctgataagttttaaacattggtcgaatagaagagacaatggtgattgagatatctggaaaaaaaaaatcttgagatgataaaaagcatacaattgtc

SEQ ID NO: 5568 - DNA, 2308 bp, Sorghum bicolor
aggcgagctgcgctgcggagcagagtgaggggagtgtcgtgctgccgccgcagtaaaaaacaggggaggggaggcgagacgcggccgctgcctgccgcacatgctttaagtcccactccccaccgccccagatctccgacctcccccattcccccctcgcggccgcaaccgtcgccgccgcagtccggagcaagatcggcgggtagacggacagacgggccggcgggcgcggctctgtatcttatctgtcggtggagaccgcgtgtgtcggttaggcggcgggtggcaaggaagaatggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacatgtgggcgtgccattgttggcaggccgacaaagttttggagcgcagatgggcgcagggcaacccaagctctaatgacatggaatgtgacctgcacatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcccacatgtgcccgataagaatccactggcatgtgaagctcaactacaaggaatactggagagtgaaaatcactatcacaaacttcaacttccgcatgaattacacgcagtggaacttagtagctcagcatccaaactttgataacatcactcagttgttcagcttcaactacaaaccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatgatgagtgggatcaagaggtttagcaagcttcaagttgatgtcagattccatgaggtgcactgcaacaggtcatttattcattcaattccatggttgcacagaagagatgaggcgatgccaagaaaaaagttgatatgtgtgtgtgtgtttttgtaagttaaagggccaaaatgtatttcttgtttggtatatagcagccctacagcactttggtgaacttagttactgcaaattaggtaattacagttgcaccttttgtattttatagcaaacccagaatttttcattggattatatgactgctccacttcttgtagtaaatgcaaggcttccctgataatgttttaaagattggtcgaatagaagagacaatggtgattgagataactaaattctggcgtcttgatacattttgctgtagagattattgagctaaattgctaagctacaagcattcactgttcactgaaccaaaattacattactcaaaaacttagaacaagaatgagtgcagcactcgtttatgtgcaactggaaaccacaaactgcaatttgtatgtaataatcgggttacagagaaacaaacgttgccttgcagaatcaattaagattataatctgtcattaaccttggaataagaataattccgttgccttgcagaatc

SEQ ID NO: 5569 - DNA, 3505 bp, Sorghum bicolor
ttgttctatttattaaggattcaaacatttaaactaaggattcgaacgttaccgaacgtgctacttccaaaactcacgtgtcggtgttggatactccacggtagtatcaccacatcttgtaccacgattatcgcagtatcaccacatattgtaccagtatccgtatcctcgtatgccattttgatttgaacccactcctgctatccaaaggcagtcctgtgtgcatttcagtttcccacttaccgttaatcaccgtccctgcacatactagcagcaaaacaggtctagattctcagttttcacaaccgttaatcacctgtccttgtccctaagcgaacatcaccaacagctgtgtgtcaccaggggcattcccgtaaatgcacgccggaggttgaggcgtcacatctactccctcgcggcaagaaaccgttcccgatataaccccacgcccccgcaccgaggcgagctgcgctgcggagcagagtgaggggagtgtcgtgctgccgccgcagtaaaaaacaggggaggggaggcgagacgcggccgctgcctgccgcacatgctttaagtcccactccccaccgccccagatctccgacctcccccattcccccctcgcggccgcaaccgtcgccgccgcagtccggagcaagatcggcgggtagacggacagacgggccggcgggcgcggctctgtatcttatctgtcggtggagaccgcgtgtgtcggttaggcggcgggtggcaaggaagaatggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacatgtgggcgtgccattgttggcaggccgacaaagttttggagcgcagatgggcgcagggcaacccaagctctaatgacatggaatgtgacctgcacatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcccacatgtgcccgataagaatccactggcatgtgaagctcaactacaaggaatactggagagtgaaaatcactatcacaaacttcaacttccgcatgaattacacgcagtggaacttagtagctcagcatccaaactttgataacatcactcagttgttcagcttcaactacaaaccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatgatgagtgggatcaagaggtttagcaagcttcaagttgatgtcagattccatgaggtgcactgcaacaggtcatttattcattcaattccatggttgcacagaagagatgaggcgatgccaagaaaaaagttgatatgtgtgtgtgtgtttttgtaagttaaagggccaaaatgtatttcttgtttggtatatagcagccctacagcactttggtgaacttagttactgcaaattaggtaattacagttgcaccttttgtattttatagcaaacccagaatttttcattggattatatgactgctccacttcttgtagtaaatgcaaggcttccctgataatgttttaaagattggtcgaatagaagagacaatggtgattgagataactaaattctggcgtcttgatacattttgctgtagagattattgagctaaattgctaagctacaagcattcactgttcactgaaccaaaattacattactcaaaaacttagaacaagaatgagtgcagcactcgtttatgtgcaactggaaaccacaaactgcaatttgtatgtaataatcgggttacagagaaacaaacgttgccttgcagaatcaattaagattataatctgtcattaaccttggaataagaataattccgttgccttgcagaatcaattaagattataatctctagttcgctggctagagaactctaggagcctaattggttgcgtgttctcacataataaaagcttccggggcctctgagaacggcaaagggatgttttcctggttgttgtgggctactgcatcgttggaaaatgtcctgatgggtatatcctttaatgaaactagatcacagatgtaaacttcaatgaaactataccacagatttttacatttgatactaaagctgtagtctggaggtaagtacagaacggcagattcaataattgatcaaacagagcaactagctccatttaaactaaaaacagaaccataacaacgaatactatattactgcaactacatcataagaacaacaaacgaattcatggaaacaacttaccttagattggatgcaggaacaaattcttcctaaccatctaccatgaagaaaaacacccagcccttcatggtgctgctgctctgaagcctcggagctcagaactgggcatatgccacccatggcctggtatatatatccataagaaaccatatatgaagtgcagtctaaggatgggctgatggttcgccagtagcttttggtttgttggctggttagttcagagcaaaccccagcttgaagctcattaccctcagtcctcaccttccacatgttggcttttgctactcctttaagcaatgccatccaacccttccaggttactcaagatacatgatacttcaa

SEQ ID NO: 5570 - DNA, 2524 bp, Setaria italica
gaacgaaaggagcacgagagtgtgcctatttcattgataaagatggggttacatctgctaaaccggaaataaaaacgaaaggaaaaaaagcgttatacttcctccactatgttttgcaccactccaatttattatgcagttaattgaacaataaaagcggcaataaggatcgactttttcatcagcctcttgtgtatcgctgttcccgtgcaaagtccctgaagcgctagattttcagctttcacttaccgttaatcacctgtccgggctgtccctgtccccaagcgaacatcaccaacagctgtgcatcaccagaggggcattccggtaaatgtccgccggaggttgaggcgtccacatctactcccctcgcggcaagaaacgtccccgatataaccccacccgcaccgaggcgcggaaggaagcagccgctgcggagcagagtgtgtcgtgctggctgccgtcgcagtaaaaacaggggaggggagacgaggacgcggccgctgcctgccgcacatgctttaagtcccactccccaccgccccagatctccgcctctcttcccacctccccacattccccggcgcccccctccccgcgcggccgcaaccgccgccgctgtcaggagcgagatcggcggggcagacgggcgcggcgcttgtatctgtcggtgggagagacccgcggtgtcggtgaggaggcgggtgggaaggaagtgaaggtaggaaggatggcagcgggcggcagatccgtagcgtactgcgccgccgtgctgctcgcggccgcgctgctcctctccgcaccgactggcacagaggcttatgattccttggatccaaatggcaacatcactataaaatgggatattatgcagtggactcctgatggatatgtcgctgttgtcacaatgttcaactaccaacaattccggcacattggggcacctgggtggcagcttgggtggacatgggcaaagaaggaggtcatatggtcgatggttggggcacagactaccgaacagggtgactgttcgaagttcaagggcaacactccccactgctgcaaaaaagatcccacgatcgtcgatttacttccaggcactccatacaacatgcagattgccaattgctgcaaagcaggagttataaatacatttaaccaggacccggcaaatgctgctgcctccttccagattagtgtaggtcttgctgggactaccaataagactgttaaggtgccgaagaacttcactcttaagactccaggtcctgggtacacatgtgggcgtgccattgttggcaggccgacaaagtttttcacctcggatgggcgcagggcaacccaagctcttatgacatggaatgtgacttgcacatattcccaatttcttgctcaaaagactccatcctgctgtgtctctctttcatcattttacaatgacacaattgtgaactgcccaacatgctcttgtggctgccaaaatccaaatgggtcaaactgtgtgaatgaggattcacctaatctacaatctgcaattgatggccctggaaaatggactggtcagcctcttgtacaatgcacttcccacatgtgcccgataagaatccactggcatgtgaagctcaactacaaggaatactggagagtgaaaatcactatcaccaacttcaacttccgcatgaattacacgcagtggaacttagtcgctcagcatccaaactttgataatatcactcagctgttcagcttcaactacaaaccacttaccccatatggcagtggcataaatgatacggctatgttctggggtgtaaaattctacaatgatttgctgatgcaagctggtaaacttgggaatgtgcaatcagaactacttctccgcaaggactcccagactttcaccttcgaaaagggatgggccttcccacgccgagtgtacttcaatggtgacaactgtgtcatgccatctcctgaaaactatccatggttgcccaacgcaagccctctaacaaaacaaccgctgaccctcccacttttagtattctgggttgtgttggctactctgttggcatatgcatgatgagtgggatcaggaggtttagtgagcttcaagttgatgtcagattccatgaggtgcactgcaacgggtcatttgttcattcaattacatggttgcacagaagagatgacaccacgcagagaaaaaaagtttatgtgtgtgtgtttttgtaagttaaagggccgaaatgtatttcttgtttcgtatatactggccccacaacacttagttactgcaaactaggtaattacagttgcaccttttgtattttatagcaaactcagaatttttcattggattatatgacctcttcttgtagtaaatgcgcggttttcgttttgtaagatttgttgaacagaaaagacaatgatgattgagatcactaagttctggcatcttaattcattcctgctgctcactgagctttttgagctaaatagataacatctactaatggtcattttc

SEQ ID NO: 5571 - DNA, 1980 bp, Zea mays
gctgcggaagagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgcaaccgtagccgccgcactacggagcaagatcgtcgggtagacggacgggcgggcgggcgggcgcggctctgtatctatctgtcggtgggagaccgcgtgtgtcggttaggcggcgggtggcaaggaagaatggcggcgagcggcagatccgtcgcgtgctgtgccgccgcgctgctcgcggccgcgttgctcctctccgcaccgactgcaacagaggcttatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgcccaggaacttcactcttaagactccaggccctgggtacacatgtgggcgtgccattgttggcaggcctacgaagtttttcaccgcggacgggcgcagggcaacccaagctctaatgacatggaatgtgacctgcacatattcccaatttcttgctcagaagactccatcctgctgtgtatctctatcatcgttttataatgacacaattgtgaactgcccaacatgctcatgtggctgccagaacccaagtgggtcaaactgtgtgaatgaggattcacctaatctacaagctgcaattgatggccctggcaaatggactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaacttagttactgcagattaggtaattacagttgcaccttttgtattttatagcaaacccagaatttttcattggattctacgactgcccctcttgtagtaaatgcaaggcttccctgatactcctgttta

SEQ ID NO: 5572 - DNA, 1972 bp, Cenchrus ciliaris
  misc_feature (97)..(97): n is a, c, g, or t
  misc_feature (115)..(115): n is a, c, g, or t
  misc_feature (118)..(118): n is a, c, g, or t
  misc_feature (151)..(151): n is a, c, g, or t
  misc_feature (756)..(756): n is a, c, g, or t
  misc_feature (1081)..(1081): n is a, c, g, or t
  misc_feature (1704)..(1704): n is a, c, g, or t
  misc_feature (1729)..(1729): n is a, c, g, or t
  misc_feature (1881)..(1881): n is a, c, g, or t
  misc_feature (1884)..(1884): n is a, c, g, or t
  misc_feature (1896)..(1896): n is a, c, g, or t
  misc_feature (1919)..(1919): n is a, c, g, or t
  misc_feature (1945)..(1945): n is a, c, g, or t
  misc_feature (1955)..(1955): n is a, c, g, or t
  misc_feature (1961)..(1961): n is a, c, g, or t
ccgctgctgcctgccgcacatgctttaagtccacactccccaccgccccagatctccgtctcccttccaacctccccacattccccggcgcgccccntcccccgcggccgccgcngcngccgtcaggagcgagatcggcgcggctcctgtntctgtcggtgggaagagacccgcgtgtcggtgagaggaggcgggtgccggaaggaagtgaagtgaagtgaaggaaggatggcggcgggcggcagatccgtcgcgtgctgcgccgcggtgctgctcgcggccgcgctgctcctctccgcaccgactgccacagaggcatatgattccttggatccaaacggcaatatcactataaaatgggatattatgcaatggactcccgatggatatgtcgctgttgtcacaatgttcaactaccaacaattccggcacattggggcacctgggtggcagcttgggtggacatgggcaaagaaggaggtcatatggtcgatggttggggcacagactaccgaacagggtgactgctcgaagttcaagggcaacactccccactgctgcaagaaagatcccacaattgttgatttacttccaggcactccatacaacatgcagatcgccaattgctgcaaagcaggagttataaatacatttaatcaagacccggcaaatgctgctgcctccttccagattagtgtaggtctcgctgggactaccaataagactgttaaggtgccaaagaacttcactcttaanactccaggtcctgggtacacatgtgggcgtgctattgttggcaggccgacaaagtttttcacctcggatgggcgcagggcaacccaagctcttatgacatggaatgtgacttgcacatattcccaatttcttgctcaaaagactccaacctgctgtgtctctatgtcatcattttataacgacacaattgtgaactgcccaacatgctcttgtggctgccaaaatccaagtggatcaaactgtgtgactgaggattcacctaatctacaatctgcaattgatggccctggaaaatggactggtcagcctcttgtacagtgcactncccacatgtcccgataagaatccactggcatgtaagctcaactacaaggaatactggagagtgaaaatcactatcaccaacttcaacttccgcatgaattacacgcagtggaatttagtcgttcagcatccaaactttgataatatcactcagctgttcagcttcaactacaaaccacttaccccatatggtggtggcataaatgatacggctatgttctggggtgtaaagttctacaatgatctgctgatgcaagctggtaaacttgggaatgtgcaatcagaactacttcttcgcaaggactccaaggatttcacctttgaaaaaggatgggccttcccacgccgagtgtacttcaatggtgataattgtgtcatgccatctcccgaaaattatccatggttgcccaacgcaagccctctaacaaaacaaccattgacactcccactgttagtattctgggttgtgttggctactctgttggcatatgcatgatgagtgggatcaagaggtttagtgagcttcaagttgatggcagattccatgaggtgcgctgcaacaggccatttgttagttcaattccatggttgcacagaagagatgacaccccgccgagagaaaanatgtttacatgtgtgtgtgttcttntaatttaaagggtcaaaatgtatttcttgtttggtatatactggccccacaacacttcggtgaacttagttactgcaaattaggtaattacagttgcaccttttgtattttatagcaaactcagaatttttcattgaattatatgactgctnttnttgtagtaaatncgcggtttttgttttgtaagatntgttgaactgaaaagacaatgatgantgagatcacnaagttntggtgtattta

SEQ ID NO: 5573 - DNA, 1673 bp, Panicum virgatum
gctgctcctctccgcgccgactgccacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactaccgaacagggtgactgctcgaaattcaagggcaacactccccactgctgcaagaaagatcccacgatcgtcgatttacttccgggcactccatacaacatgcaaattgccaattgctgcaaagcaggagttataaatacatttaatcaggacccagcaaatgctgcttcctccttccagattagtgtaggtcttgctgggactaccaataagactgttaaggtgccgaagaacttcactcttaagactccaggtcctgggtacacctgtgggcgtgccattgttggcaggccgacaaagtttttcacctcggatggacgcagggcaacccaagctctaatgacgtggaatgtgacttgcacatattcccaatttctagcccagaagactccgtcctgctgtgtatctctctcatcattttacaatgacacaattgtgaactgcccaacatgctcttgtggctgccaaaatccaagtggctccaactgtgtgaatgaggattcaccgaatctacaatctgcaattgatggccctgggaaatggactggtcagcctcttgtacaatgcacctcccacatgtgcccgataagaatccactggcatgtgaagctcaattacaaggaatactggagagtgaaaataactatcaccaacttcaacttccgcatgaattacacgcaatggaacttagttgttcagcatccaaactttgataatatcactcagctgttcagtttcaactacaaaccacttaccccatatggtggtggcataaatgatacggcaatgttctggggtgtaaaattctacaatgatttgctgatgcaagctggtaaacttgggaatgtgcaatcagaactacttcttcgaaaggattcccaggctttcaccttcgaaaagggatgggccttcccacgtcgagtgtacttcaatggtgataactgtgtcatgccgtcccctgaaaattatccatggctgcccaatgcaagccctctaacaaaacaaccattgacactcccactctttgtattctgggttgtgttggctactctgttggcttatgcatgatgagtgggatcaagagatttagcgagcttcaagttgatgtcagattccatgaggtgcactgcaacaggccatttgttcattcaattccatggttgcacagaagagatgacaccacgccgagaaaagaaagtttatatatgtgtgtgtttttgtaagttaagggccaaaatgtatttcttgtttggtatatactggcaccacagcactttggtgaacttagttactgcaaattaggtaattacagttgcaccttatgtattttatagcaaactcagaattttccattgaattatgactgctcttcttgtagtaaatgtgcttcgttttgtaagatttgttgaacaggaaaggtgatgattgagatcactaaagttctggc

SEQ ID NO: 5574 - DNA, 2245 bp, Oryza sativa
gggggttgttgatacgtccacgagacgagccagcagcagccgcaccaactactgaaacccacacacaaacacagtggcgagcggcgagccgagtgccaccgacagaaagagggaggagaggctctgtcacctgcgccttttttattcccccgcggtagtgtcggtttccccttgccttgcctggcggttggcgcgtcgcatctacccctgctactagtagtaccacttctcgcggcgagaaaatgccgcaatatatttgcttccaccgaggcgcagagcggaggagagtgacgagctgacgcacgcggcgcggcggaccagctcaatttgcctgccgctcctcgtcttccggtggggcggaggagggggacgccgggcgggcgggcgctcgcattccggagcggggagcgcgagctcgatcgggcggggatatggcggtggggggagccgggagctccagatccgtggcgccgtgctgctgctgcgccgtgctgctcgcggcggcgctgctcttctccgcgccggccaccacagaggcttatgatgcgctggatccaaatggaaacatcacgataaaatgggacgttatgtcgtggactcctgatggctatgttgctgtggtcacgatgttcaactatcaacaattccggcacatccaggcacctgggtggcagctggggtggacatgggcaaagaaggaggtcatttggtcgatggttggagcacagaccactgagcagggcgattgctcaaagttcaagggtggcacgccccactgctgcaagaaggatcccacagttgttgatctgcttccgggcaccccatacaacatgcaaatcgctaattgctgcaaagctggagttataaatacatttaaccaggacccatcaaatgctgcttcttccttccagatcagtgtaggtcttgctgggactaccaacaagacagttaagttgcctaagaacttcactcttaaggccccaggtcctgggtacacgtgcgggcgtgctatgattgtcaggcctactaagtttttcaccggggatgggcgcagagcaacccaagctctaatgacatggaatgtgacctgcacatactcccaatttcttgctcagaagactccttcctgctgtgtatctctctcatcattttataatgacacaattgtgaactgcccaacatgctcttgtggctgccaaaacaatgggacaagtcctggaagctgtgtaaatgagaattcaccttatttacaatctgccattgatggccctggcaaatggaccggtcagcctcttgtccaatgtacttctcacatgtgcccgatcagaatccactggcatgtgaaactcaactataaggaatattggagagtgaagatcacgattacgaacttcaactaccgcatgaattacacacagtggaatttggtcgctcaacatcctaacttcaataatatcacccagctgtttagcttcaactacaagccacttactccatatggaagcaagataaatgatactgcgatgttctggggagttaagttctataacgatttgctcatgcaagctggtccacttggaaatgcacagtcagaacttcttctgcgtaaggattccaaggacttcacctttgacaagggatgggccttcccacaccgcgtgtacttcaatggtgataattgtgtcatgccacctccggatgcatatccatggttgcctaatgcaagtcctctgacaaaacaaccattgacactctcggttttggtattttcgattgtgttggctactttgctggcttatgcatgatgagtgaaaccaagaaattcggtgagcttcaagttgtcaggttccatggtgtgcactgcaacagatcatttgttcattcagttccacggttgcatagaagagaagatgtcacgctgaggaaagctgatatgtgtgtgtgtgttgtatgttaaaagaaggccaaaatgtatttcttttttggtatatatactggccacagcattttggtgaacttagttactgcaaactagataattacagttgcaccttttgtatgttatagcaaccagaaattcaattgaattatatgacttcccttcttgtagtacatgtatagactccgtaataatgttctgtatgattttgtgaacagaaaggatgctgttgattgagatcatttagttttgtttcttgtttcctggtatattgagctaagtaatcgaactgatgttagtgttcaa

SEQ ID NO: 5575 - DNA, 2167 bp, Oryza sativa
ggcgagccgagtgccaccgacagaaagagggaggagaggctctgtcacctgcgccttttttattcccccgcggtagtgtcggtttccccttgccttgcctggcggttggcgcgtcgcatctacccctgctactagtagtaccacttctcgcggcgagaaaatgccgcaatatatttgcttccaccgaggcgcagagcggaggagagtgacgagctgacgcacgcggcgcggcggaccagctcaatttgcctgccgctcctcgtcttccggtggggcggaggagggggacgccgggcgggcgggcgctcgcattccggagcggggagcgcgagctcgatcgggcggggatatggcggtggggggagccgggagctccagatccgtggcgccgtgctgctgctgcgccgtgctgctcgcggcggcgctgctcttctccgcgccggccaccacagaggcttatgatgcgctggatccaaatggaaacatcacgataaaatgggacgttatgtcgtggactcctgatggctatgttgctgtggtcacgatgttcaactatcaacaattccggcacatccaggcacctgggtggcagctggggtggacatgggcaaagaaggaggtcatttggtcgatggttggagcacagaccactgagcagggcgattgctcaaagttcaagggtggcacgccccactgctgcaagaaggatcccacagttgttgatctgcttccgggcaccccatacaacatgcaaatcgctaattgctgcaaagctggagttataaatacatttaaccaggacccatcaaatgctgcttcttccttccagatcagtgtaggtcttgctgggactaccaacaagacagttaagttgcctaagaacttcactcttaaggccccaggtcctgggtacacgtgcgggcgtgctatgattgtcaggcctactaagtttttcaccggggatgggcgcagagcaacccaagctctaatgacatggaatgtgacctgcacatactcccaatttcttgctcagaagactccttcctgctgtgtatctctctcatcattttataatgacacaattgtgaactgcccaacatgctcttgtggctgccaaaacaatgggacaagtcctggaagctgtgtaaatgagaattcaccttatttacaatctgccattgatggccctggcaaatggaccggtcagcctcttgtccaatgtacttctcacatgtgcccgatcagaatccactggcatgtgaaactcaactataaggaatattggagagtgaagatcacgattacgaacttcaactaccgcatgaattacacacagtggaatttggtcgctcaacatcctaacttcaataatatcacccagctgtttagcttcaactacaagccacttactccatatggaagcaagataaatgatactgcgatgttctggggagttaagttctataacgatttgctcatgcaagctggtccacttggaaatgcacagtcagaacttcttctgcgtaaggattccaaggacttcacctttgacaagggatgggccttcccacaccgcgtgtacttcaatggtgataattgtgtcatgccacctccggatgcatatccatggttgcctaatgcaagtcctctgacaaaacaaccattgacactctcggttttggtattttcgattgtgttggctactttgctggcttatgcatgatgagtgaaaccaagaaattcggtgagcttcaagttgtcaggttccatggtgtgcactgcaacagatcatttgttcattcagttccacggttgcatagaagagaagatgtcacgctgaggaaagctgatatgtgtgtgtgtgttgtatgttaaaagaaggccaaaatgtatttcttttttggtatatatactggccacagcattttggtgaacttagttactgcaaactagataattacagttgcaccttttgtatgttatagcaaccagaaattcaattgaattatatgacttcccttcttgtagtacatgtatagactccgtaataatgttctgtatgattttgtgaacagaaaggatgctgttgattgagatcatttagttttgtttcttgtttcatcaggtgtattgagctaagtaatcgaattaactgatgcttatgttc

SEQ ID NO: 5576 - DNA, 1723 bp, Brachypodium distachyon
aaatggcggttggcggcggcaccgggagctccagatccgcggcctgctgcggcgccgtgatgctcgcggcggtgctgctcttcttggcaccggccaccacagaggcttacgattcactggatccaaacggcaacatcacgataaaatgggatatcatggagtggacagctgatggttatgttgcagtcgtcacaatgttcaactaccaacaattccgacacatctctgcgcctggttggcaactggggtggacgtgggcaaagaaggaggtcatctggtcgatggtgggggctcagaccactgagcagggcgattgctcaaagttcaagagcagccctccccactgctgcaagagagatcctacaattgtcgatctgcttcctggcaccccatataatcagcaaattgccaactgctgcaaagcaggagttataaatacatttaaccaggacccatcaaatgctgcttcctccttccaggttagtgtaggtcttgctgggactaccaataagacggttaaggtgcccaaaaacttcactctcaaggccccaggtccagggtacacatgtggccgtgctcttgttggcaggcctactaagtttttcacctcagacgggcgccgggcaacccaagctcttatgacttggaatgtatcctgcacatactcccaatttcttgctcagaagactccaagctgctgtgtatctctctcgtcgttttataatgacactattgtgaactgcccaacgtgctcttgtggctgccaaaacaataacactcgtccaggaagctgtgtgaatgagaattcgccttatttacaatctgccatcgatggccctggcaaatatactggccagcctcttgtccaatgtacttcccacatgtgcccgataagaatccactggcatgtgaagctcaactacaaggactactggagagtgaaagtcactattacaaacttcaactaccgaatgaattacacacagtggaacttagtcgtccagcaccccaactttgataatatcacaaagctgtttagcttcaactacaagccgcttaccccgtatggaggcggaataaatgatactgcgatgttctggggaatgaaattctacaatgatttgctcatgcaagctggtccgcttggaaatgcacagtcagaaatacttatgaagaaggactctgcgactttcaccttcgataaaggatgggccttcccacgacgtgtgtacttcaatggcgataactgtgtcatgccatctcctgatgcatatccgtggttgcctaatgcaagccctctaacaaaacaaccattgacgctaccgctcttggtattctggactgtgttggctactttgctggcttatgtataatgaatgagatcaagagatgcagcaagcttcaagttgctgtcaggctccatgaggtatggggcaacgggtaatttgttcatacaatttcactagtgttgtacacaagaaatggcgtcgcatagaggaaagctgatatatgtgttttttgtattttaaaagggccaaaaatgtatttcttttttcttcttgtttactggccacaacactttggtgaactttagttactgcaatttaggtaattacagttgcccctcttgtattttatagcataccaggaattttcatgaattatatgactacctttcttgtagtaaatgtatgggttctgtaactgttggttgagataattt

SEQ ID NO: 5577 - DNA, 2890 bp, Brachypodium distachyon
atagagaaaccgtgaagatacaaataatagatctataggcattgatttgaaaacccatgatattttttaaaatcttgttttatattcgaagttcgattgtgtcttgctttcttaggaatcaataaagcgttcgaaaaaacatccgcccccgacagctgtagagggcattttggtcgaaacgccccacaggttgtcccgtcgcgtctactcgcccatcgctcatcggcggaaagaaacgtacagtccacagaggcgcggaagcctgctcgcatcactgttgcctgcggaagagagagtatccgcggagtagcgggcgaagaaatggcggttggcggcggcaccgggagctccagatccgcggcctgctgcggcgccgtgatgctcgcggcggtgctgctcttcttggcaccggccaccacagaggcttacgattcactggatccaaacggcaacatcacgataaaatgggatatcatggagtggacagctgatggttatgttgcagtcgtcacaatgttcaactaccaacaattccgacacatctctgcgcctggttggcaactggggtggacgtgggcaaagaaggaggtcatctggtcgatggtgggggctcagaccactgagcagggcgattgctcaaagttcaagagcagccctccccactgctgcaagagagatcctacaattgtcgatctgcttcctggcaccccatataatcagcaaattgccaactgctgcaaagcaggagttataaatacatttaaccaggacccatcaaatgctgcttcctccttccaggttagtgtaggtcttgctgggactaccaataagacggttaaggtgcccaaaaacttcactctcaaggccccaggtccagggtacacatgtggccgtgctcttgttggcaggcctactaagtttttcacctcagacgggcgccgggcaacccaagctcttatgacttggaatgtatcctgcacatactcccaatttcttgctcagaagactccaagctgctgtgtatctctctcgtcgttttataatgacactattgtgaactgcccaacgtgctcttgtggctgccaaaacaataacactcgtccaggaagctgtgtgaatgagaattcgccttatttacaatctgccatcgatggccctggcaaatatactggccagcctcttgtccaatgtacttcccacatgtgcccgataagaatccactggcatgtgaagctcaactacaaggactactggagagtgaaagtcactattacaaacttcaactaccgaatgaattacacacagtggaacttagtcgtccagcaccccaactttgataatatcacaaagctgtttagcttcaactacaagccgcttaccccgtatggaggcggaataaatgatactgcgatgttctggggaatgaaattctacaatgatttgctcatgcaagctggtccgcttggaaatgcacagtcagaaatacttatgaagaaggactctgcgactttcaccttcgataaaggatgggccttcccacgacgtgtgtacttcaatggcgataactgtgtcatgccatctcctgatgcatatccgtggttgcctaatgcaagccctctaacaaaacaaccattgacgctaccgctcttggtattctggactgtgttggctactttgctggcttatgtataatgaatgagatcaagagatgcagcaagcttcaagttgctgtcaggctccatgaggtatggggcaacgggtaatttgttcatacaatttcactagtgttgtacacaagaaatggcgtcgcatagaggaaagctgatatatgtgttttttgtattttaaaagggccaaaaatgtatttcttttttcttcttgtttactggccacaacactttggtgaactttagttactgcaatttaggtaattacagttgcccctcttgtattttatagcataccaggaattttcatgaattatatgactacctttcttgtagtaaatgtatgggttctgtaactgttggttgagataatttaggtttgttttcttgccaccatctgatctttgaaccaagttggtgagcttatccattttagtgttcagtgcctctctagctgagcattttacgaacttgaaattgtaaccattcgacaacaaattccgtgcttgcttggtttcgtgcatcaggttccccctaagagcatgtacagtgcaaagtgcttaacgtgctgcttacaaaattaaaccagaggtgcctagttaagcacctgtcctatagaaacaagtattgtaagcacttccctaagcactttgcattgtacatgctctaagtgggttaattgtaatcataggcagatgcatggatatacttctggaggggaagtggatagacgaagtattgttgacaagatttctgttttctcacttccatttgcagcatttctcggtctatcggatgtttctgaattcaaacaggaactgacgccatgatatgatatgctcatctactctaatctctgtgtctgaacaaattgtcctacagctagtttggacttcggagcacgcactgacgggcgccagacatatttttctgtttgagatggagagatcctccctaaataatcttcggagaaacgttattgattgaacaagaggaactagttttaattgaaacaaagaaaccattaaaagaaacataataacattgttgcgaaatgcttcacctatatatcagcacagaagtccccggaaatattttaccttagagatgatgctggatgcaatacctccatgggaccattctctgtgacttgctttgaagggagccatgctttggtttgtgcccagcttcgcgctgctgctcttccgaaatctcagagatca

SEQ ID NO: 5578 - DNA, 4267 bp, Brachypodium distachyon
ataaaaaagaatagtaaatgacgagtgagtggtcatgataacaaaccgtaaatcacacgttcaaagaaaaagttcacacagtacaagatttgacgttcggagtgcagacacgctgatttgtctatctgaatacatcgacatgcaatgcaaatacaaacatagcacaattcttttctcgcgaactagatcttttggttaaataaaacaatactacgcagagttagagaacacttgataaaacactagtagttgcaacaaaatccggtggcggctccgtgctttcaagtctcggtgacctccatggatgaagcgcaaaagccaaaatgcacaaagtttgccctaaagtcaaaagttttgagtagtcgcacgagtcgtgtttacctcacgaagtaaaaaccaaataccaattagtacaatatgtttagagttatacgccttacaagataggattttcaggaaaaaaatttaggaacggagcgtaaaagcatgggccaaaatgttggccacattatgtcaagaaattttagttccataagatgacacctccatggatatcctatggccagaacgccaaaagcagactatctacccaataaatattggtcatgggatcttctatcttcgaacaacaccgagtgtctcgtcgaatgcaagaggaaccatcaaaatctccaatgagggaacaaaagaaaagaagcttcaactgttagtgtctttgggacacaaagtgatctaaaattaatttactccactttcaaaaagttattttttcattcgatcatcggggttaataatcctccacaatcccaactggcaactgcgatcaatcaatttcattaacttcgttaaaatctcaatgagccaatcaatcatgtcgtgttatcaccgtagggactgccatcctttccaaagtaccgatcagatttggctctccaaaaatatgaaaattgacgtaaaaccaaacagtggtcaaagttaatcaaatttggcgtaatttgacgaggcagaaaactcaaaacccaaacgatggccaaagttaatcaaaaccggcatagtttgccgaggccaaaatctggaacacaaacaccggaaaaaatctgacaccgacaagcccccctgtcacgaggggcatttcggtcaaaacgccttggaggaggttggactgtcgcgctcacatctactcgctcatcgcggaaagaaacgttccttccccccgcgatataatttccaccgaggcgcgggacgaagaagcctccaggagcagcgcgcgtctcgtcgcagtaaaaacagcggccgcacatgctttaagtccctacactcccaccaccatcgcctcgccctcagtcgcctccctcccagctccaaccccccagatctccggctcccccctccccggcaggcgcgcaccgccgctgcactgccgcatccgctgcggctcagggatcgtcgggtgcttgtagtgcggaaaaaaatagtgtcagtggagtagcgaggggggagaaaaatggcggttggtggcgacgccgggagctccaggtccgcggcctgctcctgcgccgtgctgctcgcggcggtgctgctcttctcggcaccggccaccacagaggcttatgattcactggatccaaacggcaacatcacgataaaatgggatattagggaatggactgctgatggttatgtcgcagtcgtcacaatgttcaactaccaacaattccgacacatctctgcacctgggtggcaactagggtggacatgggcaaagaaggaggtcatttggtcgatggtgggggctcaggccactgagcagggtgattgctcaaagttcaagagcagccctccccactcttgcaagagagatcccacgattgtcgatctactcccaggcaccccatacaatcagcaaattgccaattgctgcaaggcaggagttatagatacatttaaccaggacccatcaaatgctgcttcctccttccaggttagtgtaggtcttgctgggactaccaacaagacggttaaggtgcccaaaaacttcactcttaaggccccaggtccagggtacacgtgcggccgtgctattgttggcaagcctactaagtatttcacctcagacgggcgccgggcaacccaagctcttatgacatggaatgtaacctgcacatactcccagtttcttgctcagaagactccaagctgctgtgtatctctctcatcattttataatgacactattgtgaactgcccaacgtgctcttgtggttgccaaaacaataacactcgtccaggaagctgtgtaaatgagaattcgccttatttacaatctgccatcgatggccctggcaaatatactggccagcctcttgtccaatgtacttcccacatgtgcccaataagaatccactggcatgtgaagctcaactacaaggactactggagagtgaaagtcactattacaaacttcaactaccgaatgaattacacacagtggaacttagtcgtccagcaccctaactttgataatatcacaaagctgtttagcttcaactacaagccgcttaccccatatggaggcggaataaatgataccgcgatgttctggggaatgaaattctacaacgatttgctcatgcaagctggtccgcttggaaatgcacagtcagaaatacttctgaagaaggactctgcgacattcaccttcgataaaggatgggccttcccacgacgtgtgtacttcaatggtgataactgtgtcatgccgtctcctgatgcatatccgtggttgcctaatgcgagccctctaacaaaacaaccattgacgctgccactcttggtattctcaattttgttggctactttgctggcctatgtataatcaatgagatcaagagaatcagggagcttcaagttgctgtcaggttccatggggtgcaggacaacggttcatttgttcattcaattccacgtttgcacagaagaggcaggcgccgcacagaggaaagctgatatatgtgtgttttgtaagttaaaggggccaaaaatgtatttcttgtttggtatatactggccacaaccctttggtgaacttagatactgcaatttaggtaattacagttgcgccttttgtattttatagcagcagaatttttattgaatcatatgactgcctttcttgtagaaaatgtatgggttccataataatattctgatacattgtgaaacggagaggaggccgttggttaagataattgagcatgttttcctgcgactctctgatctttgacaagttgatctgattgaaagaaaatgtatgggttccataataatattctgtatacattgtgaaacggagaggagaccgttagttaagaaaattgagcctgttttcttgcgactctctgatctttgacaagttgatctgattggtttcagtgttcagtgcgttagacaatacgaaccaaaagaagcataccacagccttcaaggctagaagaaatcataactcgaatatcaggaaagctacaacagaaggtatgaggcggtgtttctctatctgcacattttaggaacttgaaattgcaaccattaacaacaaagagtgtgcttgtgatttttcacgtaccaggttcctcataaggtatgttctacgggttgattattatggacaaatgtgtaaatgtactcctcgaagaaatgtcgagaagtattgttgatgagatttctgttttttctgaatacccttcgaaaatttccatctgtaccttttctccgtctatcggatgtttctgaattcaaagaggtaagatgcttatacgctgcggcgttgtgccacaaacttgcatcgtatcgtaaggcagaaaccgaaattgacgacaagacatgctcatctagtctttctttttctgaaacaaatgttatacaactagttttcttaagtaagttctacagctagtttggagaacatttggaaacggaatgaagcacgctacataatttcctgtctaatatggggacatatttcctaaatagtactcgggtaaggtcactgataaaacaagaggaacttgtattattcgaaacaaagaaaccaccacaagaaacatgagttcacggaaaaacacttaccttaaagaggacgctggatccaaaccctccatggcacccttctctgaggaattaagcataccgggccttctttgaagggagacatgctttgtggtttgtgcccatcttcatgctgctgctcttctgaagcctcagagaccgg

SEQ ID NO: 5579 - DNA, 2035 bp, Brachypodium distachyon
ccgtgagggagcacgactcgcagacggacgcgcgtctcgtcgcagtaaaaactggggagacggccgcggccgcacatgctttaagtcccactccctcctctccaccaccaccacctgctcagtcgcctcagatctccagctcccccccatcatcggcgggcgcggccgcattcctcgccgtacagagcgaagcggggatcggtgggtgggtaggtgcagctgctgctggagagtgtcggtggtgtcagtggagtagcgaggggggagaaaaatggcggttggtggcgacgccgggagctccaggtccgcggcctgctcctgcgccgtgctgctcgcggcggtgctgctcttctcggcaccggccaccacagaggcttatgattcactggatccaaacggcaacatcacgataaaatgggatattagggaatggactgctgatggttatgtcgcagtcgtcacaatgttcaactaccaacaattccgacacatctctgcacctgggtggcaactagggtggacatgggcaaagaaggaggtcatttggtcgatggtgggggctcaggccactgagcagggtgattgctcaaagttcaagagcagccctccccactcttgcaagagagatcccacgattgtcgatctactcccaggcaccccatacaatcagcaaattgccaattgctgcaaggcaggagttatagatacatttaaccaggacccatcaaatgctgcttcctccttccaggttagtgtaggtcttgctgggactaccaacaagacggttaaggtgcccaaaaacttcactcttaaggccccaggtccagggtacacgtgcggccgtgctattgttggcaagcctactaagtatttcacctcagacgggcgccgggcaacccaagctcttatgacatggaatgtaacctgcacatactcccagtttcttgctcagaagactccaagctgctgtgtatctctctcatcattttataatgacactattgtgaactgcccaacgtgctcttgtggttgccaaaacaataacactcgtccaggaagctgtgtaaatgagaattcgccttatttacaatctgccatcgatggccctggcaaatatactggccagcctcttgtccaatgtacttcccacatgtgcccaataagaatccactggcatgtgaagctcaactacaaggactactggagagtgaaagtcactattacaaacttcaactaccgaatgaattacacacagtggaacttagtcgtccagcaccctaactttgataatatcacaaagctgtttagcttcaactacaagccgcttaccccatatggaggcggaataaatgataccgcgatgttctggggaatgaaattctacaacgatttgctcatgcaagctggtccgcttggaaatgcacagtcagaaatacttctgaagaaggactctgcgacattcaccttcgataaaggatgggccttcccacgacgtgtgtacttcaatggtgataactgtgtcatgccgtctcctgatgcatatccgtggttgcctaatgcgagccctctaacaaaacaaccattgacgctgccactcttggtattctcaattttgttggctactttgctggcctatgtataatcaatgagatcaagagaatcagggagcttcaagttgctgtcaggttccatggggtgcaggacaacggttcatttgttcattcaattccacgtttgcacagaagaggcaggcgccgcacagaggaaagctgatatatgtgtgttttgtaagttaaaggggccaaaaatgtatttcttgtttggtatatactggccacaaccctttggtgaacttagatactgcaatttaggtaattacagttgcgccttttgtattttatagcagcagaatttttattgaatcatatgactgcctttcttgtagaaaatgtatgggttccataataatattctgatacattgtgaaacggagaggaggccgttggttaagataattgagcatgttttcctgcga

SEQ ID NO: 5580 - DNA, 1911 bp, Triticum aestivum
cggaagtcacggcgcgcctccgtgtctcgtcgcagcccaccacctgtcctctgcccgctgtccgcctcccgccccagatctccacctccccccacctccgtccgctccgactggagcagcggcctgtggagcagagagagtgtgggcggggcacgaaatggcggcgcttggtggctgcgccgtgctgctcgcggcggcgctgctcctctccgcgccggccgccacagaggcgtacgattcgctagatccgaacgggaacatcaccataaaatgggatcttaaagagtggactcctgatggttatgttgcaatggtcacaatatacaactaccagcagttccggcacatatcggcgcccgggtggcagctggggtggacgtgggccaagaaggaggtcatctggtccatggtgggggctcagaccaccgagcagggcgactgctccaagttcaagaccaaccctccccattgctgcaagagagatccgaccgtcatcgatcttctcccaggaacaccgtacaaagaccaagtcggcaactgctgcaagggaggagttataagtacgtttaaccaggacccagcaaatgctgcctcctccttccagatcagtgtaggtcttgctgggactaccaataagacggttaagctgcccaaaaacttcactcttaagaccccaggcccgggctacacatgcggccgtgctactgttgtgaggcccaccaagtttctcatcggtgacgggcgcaggacgacccaagctcttatgacatggaatgtaacctgcacctactcccagtttcttgctcagaagaccccaacctgctgcgtagctctctcgtcgttttataataacactattgtgggctgcccaacatgctcttgcggctgccaaaacaataatactcatccaggaagctgtgtaaatcccaactcaccttatttacaatctgccatcgatggccctggcaaatacaccggccagcctcttgtccagtgcacttcccacatgtgcccggtaaaagtgcactggcatgtcaagctcaactacaaggactactggagagtcaaagtaaccatcacaaacttcaactaccgcatgaactacacagactggaacctggttgtccagcatcccaacttcaacaacatcacaaagctcttcagcttcaactacaagccgctctccccgtacggaggccgcataaacgacagcgcgatgttctgggggatgaagttctacaatgatctgctcaaccaagccggtccgttcggaaacgcgcagacggagatacttctgcagaaggacccggagaccttcaccttcgagaaagggtgggcctttccgcggcgtgtctacttcaacggcgacaactgcgtcatgccgcctcccgacgcctatccatggctgcctaacgcgagccctccgatgaagcaaccgtggacgctcgagctcttggtgttctggaccgcgctggccgccctgctggcctactatgtctgatgagcggtgtcggcgagcttctgtcgggttccacgaggtgcgcggcgaagggtcatctgttcattcggttccacagttgcatataagagacggggtgacgaatgctgatgtgtgtatatgtgttctgctaagttaaatagggccaaaaattgtagtggccgcaaagctttggtgaactgatcaattgaattgtatggctgtagtaaattaaatgtatgagttacataattatgcttgggtgaaatggaggggatgctgttggtcagatgatctagcattgttttgctgacccctctgttgttgctggaagcaagttgctgagctgattcattttgatctttagtgctagctagagaccatatgaatctgaatactttgtacctggcccgggcggccgctcaagaacgctg

SEQ ID NO: 5581 - DNA, 1794 bp, Triticum aestivum
ggcgggggacgaaatggcggcgcttggtggctgcgccgtgctgctcgcggcggcgctgctcctctccgcgccggccgccacagaggcatacgattcgctagatccgaacgggaacatcaccataaaatgggatcttaaagagtggactcctgatggttatgttgcaatggtcacaatatacaactaccagcagttccggcacatatcggcgcccgggtggcagctggggtggacgtgggccaagaaggaggtcatctggtccatggtgggggctcagaccaccgagcagggcgactgctccaagttcaagaccaaccctccccattgctgcaagagagatccgaccgtcatcgatcttctcccgggaacgccgtacaaagaccaagttggcaactgctgcaagggaggagttataagtacgtttaaccaggacccagcaaatgctgcctcctccttccagatcagtgtaggtctttctgggactaccaataagacggttaagctgcccaaaaacttcactcttaagaccccaggcccgggctacacatgcggccgtgctactgttgtgaggcccaccaagtttctcatcggtgacaggcgcaggacgacccaagctcttatgacatggaatgtaacctgcacctactcccagtttcttgctcagaagaccccgacctgctgtgtagctctctcgtcgttttataataacactattgtgggctgcccaacatgctcttgcggctgccaaaacaataatactcatccaggaagctgtgtaaatcccaactcaccttatttacaatctgccatcgatggccctggcaaatacaccggccagcctcttgtccagtgcacttcccacatgtgcccggtaaaagtgcactggcatgtcaagctcaactacaaggactactggagagtcaaagtaaccatcacaaacttcaactaccgcatgaactacacagactggaacctggttgtccagcatcccaacttcaacaacatcacaaagctcttcagcttcaactacaagccgctctccccgtacggaggccgcataaatgacagcgcgatgttctgggggatgaagttctacaatgatctgctcaaccaagccggtccgttcggaaacgcgcagacggagatacttctgcagaaggacccggagaccttcaccttcgagaaagggtgggccttcccgcggcgcgtctacttcaacggcgacaactgcgtcatgccgcctcccgacgcctatccgtggctgcctaacgcgagccctccgatgaagcaaccgtggacgctcgagctcttggtgttctggaccgcgctggccaccctgctggcctattatgtctgatgaacgatgtcggcgagcttctgtcgggttccacgaggtgcgcggcgaagggtcatctgttcattcggttccacagttgcatataagagacggggtgaggaaagctgatgtgtgtatatgtgttctgctaagttaaatagggccaaaaatgtagtggccgcaaagctttggtgaactgattaattgaattgtatggctgtagtcaattaaatgtatgagttacataataatgtttgtgtgaaatggaggggatgctgttggttagatgatctagcaattgttttcctgacccctctgttgttgctggaagcaagttgctgagctgatccattttgatcttcagtgctagttagagacaacatgaatcagaagattttgtacgactccgcatctgttgttcactcgctcatcactactctttcaataaagggcgtttt

SEQ ID NO: 5582 - DNA, 1707 bp, Secale cereale
caacgcagggttcgtacctcggcagcagtccggccgggtggcagctgttccgctgccaagagtgtcggcggggccggaatggcggcgctttctcgctgcgctctgctgctcgccgcggcgctgctcctctccgcgccggccgccacagaggcgtacgattcgctagatccgaacgggaacatcaccataaaatgggatattctctcctggactgctgatggctatgttgcaatggtcacaatgtacaacttccagcagttccggcacatatctgcgcccgggtggcagctggggtggacctgggccaagaaggaggtcatctggtccatggtgggggctcagaccaccgagcagggcgactgctccaagttcaagaccaaccctccccattgctgcaagagagatccgaccgtcatcgaccttctcccggggacaccgtacaaagaccaagtcgccaactgctgcaagggaggagttataagcacgtttaaccaggacccggctaatgctgcctcctccttccagatcagtgtgggtctttccgggactaccaataagacggttaagctgcctagaaacttcactcttaagacccctggtccgggctacacatgcagccgtgctactgttgtgaggcccaccaagtttctcatcggtgacgggcgcaggacgacccaagctcttatgacatggaatgtaacctgcacatactcacagtttcttgctcagaagaccccaacctgctgtgtagctctctcgtcgttttataacaacactattgtgggctgcccaacatgctcttgcggctgccaaaacaataacactcatccaggaagctgtgtaaatcccaactcaccttatttacagtccgccatcgatggccccggcaaatacaccggccagcctcttgtccagtgcacttcccacatgtgcccggtaaaagtgcactggcatgtgaagctcaactacaaggactactggagagtcaaagtaaccatcacaaacttcaactaccgcatgaattacacagattggaacctggttgtccagcaccccaacttcaacaacatcacaaagctcttcagcttcaactacaagccgctctccccgtacggaggccgcataaatgacagcgcgatgttctgggggatgaagttctacaatgatctgctcaatcaagccggtccgtttggaaacgcacagacggaaattcttctgcaaaaggaccctgagaccttcaccttcgaaaagggttgggccttcccgcggcgcgtctacttcaacggtgacaactgcgtcatgccgcctcccgacgcctatccgtggctgcctaactcgagccctccgacgaagcaaccgtggacgcttgagctcttggtgttctggaccgcgctggccatcctgctggcctattatgtctgatgatgaacaatgtcggcgagcttctgtcgggttccacgaggcgcgccgcgcggtgaagggtcgtcttctgttcattcggttccacagctgcatataagagattggggtgaggaaagctgatgtctgtatatgtgttctgctaagttaagtagggccgaaaatgtagtggccgcgcgaagctttggtgaactgattaattggttgtatggctgtagtcaattaaatgtatgaggtacataataatgtttgtgctgagctaattcatttttaatctttcagtgctag

SEQ ID NO: 5583 - DNA, 1812 bp, Secale cereale
tcaggaatcgcggcgcgcccccgtgtctcgtcgcagtccaccacctgtcctctgcccgctgtccgccacccgtctcccgccccagatctccagctcccccccacctcccaagcagggttcacctggcagcagtccggcgggtgcagctgttccgctgccaagagtgtcggcggggggcgaaatggcggcgctttctggctgcgccgtgctgctcgccgcggcgctgctcctctccgcgccggccgccacagaggcgtacgattcgctagatccgaacgggaacatcacgataaaatgggatattctctcctggactgctgatggctatgttgcaatggtcacaatttacaacttccagcagttccggcacatatctgcgccggggtggcagctggggtggacctgggccaagaaggaggtcatctggtccatggtgggggctcagaccaccgagcagggcgactgctccaagttcaagaccaaccctccccattgctgcaagagagatccgaccgtcatcgaccttctcccggggacaccctacaaagaccaagtcgccaactgctgcaagggaggagttataagcacgtttaaccaggacccagctaatgctgcctcctccttccagatcagtgtgggtctttctgggactaccaataagacggttaagctgcctagaaacttcactcttaagacccctggtccgggctacacatgcagccgtgctactgttgtgaggcccaccaagtttctcatcggtgacgggcgcaggacgacccaagctcttatgacatggaatgtaacctgcacatactcacagtttcttgctcagaagaccccaacctgctgtgtagctctctcatcgttttataacaacactattgtgggctgcccaacatgctcttgcggctgccaaaacaataacactcatccaggaagctgtgtaaatcccaactcaccttatttacagtccgccatcgatggccctggcaaatacaccggccagcctcttgtccagtgcacttcccacatgtgcccggtaaaagtccactggcatgtcaagctcaactacaaggactactggagagtcaaagtaaccatcacaaacttcaactaccgcatgaattacacggactggaacctggttgtccagcatcccaacttcaacaacatcacaaagctattcagcttcaactacaagccgctctccccgtacggaggccgcataaatgacagcgccatgttctgggggatgaagttctacaacgatctgctcaatcaagccggcccgttcggaaacgcgcagacggaaatacttctgcagaaggacccggaaaccttcaccttcgaaaagggctgggccttcccgcgccgcgtctacttcaacggcgacaactgcgtcatgccgcctcccgacgcctatccgtggctgcctaacgcgagccctccgatgaagcaaccgtggacgctcgagctcttggtgttctggaccgcgctggccaccctgctagcctattatgtctgatgatgaacaatgtcggcgagcttctgtcgggtgcgcacctcgtggcacccggcaaagggtcatctgttcattcggttccacagttgcatataagagatggggtgaggaaagctgatgatgtgtgtatatgtgttctgctaagttaaatagggccagaaatgtagtggccgcgaagctttggtgaactgattaattgaattgtatggctgtagtcaattaaagagaaaatcggctatttgccactttcgatattgggcttcgcaaaaatgccactctcaatattggct

SEQ ID NO: 5584 - DNA, 2984 bp, Sorghum bicolor
aattgcgtacctgatcggcatgggtggggccttccgaagcacacgttggttgtgtggctcactggcactgcgccactcagctctgcaacgacgcaaccacctgaccatggcatcccctgcgcgccctcggcgctcgtcgcccgcccatcgccgtcggagacgagcacggagcacctatacctagtagccgtataaaggcggcagggcctagccccacaggacgcacaagctagtgcgggctttcccccctagattctctctcgcgcgaccgctttcccttctcctggccatggcccacgagcgggagccgctcctgcagcaacgacagaccggcgtcggcaatgccgccgccggtgctaagggctcgtcctcggcgccggcgccggcggcctctgccgcgctgccgtcgctggctaggaccgtgctcaagttcctgatgtgggcggtgttcctcacctgggccgcggggatcttcctgtacccgaccaagcccgtgcaggcagtgttcacgaagtgggtcaggctcagcaaggagtccatgttcggcatcgccgggggtattttcctggccttcagcgcgcccattctgatcattgcgcttctggcatatgtctacatctcattcttcccgagtgagcgtgtggtggaaaaaaagaagctgcggtcactgagtttcaggctctggactttccctgttcttgtagacggcccctttggagttgtctctgcagctgagttcatcggaattgtcctgtttataatttttgttgtctactcaatgacctattatgccgtggagagcgtgagccttgtctcaaaatttgaccttccatcaatgactcagagtgaattgatactggatgtcattggcgcccgttttggggcggttgggttgttctgcatgctcttcctcttcctgccagtcgcaagaggctcagttctcctccggcttatcgatattccatttgagcatgctacaagataccacgtctggttgggtcatctcactatggctctctttacattgcatggcttgttctttgtgatctcatggtccatggaagggcgcctccgtgaagaaatgagagaatggaatgaaactggagtagcaaacctgcctggtgtgatcagcttggcagccggcctacttatgtgggtgacatcacttcacccagtgaggaagaggttctttgagctcttcttctacacccaccagctctacgtcatcttcatcgtgttcttggcgttccatgtcggcaacttcctcttcagtatttcggccggggttgtgttcctcttcatgctcgaccgctttttaaggttctggcagtcaagggccaaagttgacatcatttcagccgcctgccgcccatgtgggacggtggagctagtattttcaaaaccaccaggcctccgctacaatgctttgagtttcatcttcattcaagtgcgcgagctatcgttcttgcagtggcatccgttcagtgtatcttcaagtcccatggatgggagataccacatgtcggttctcataaaaatactcggcacatggactgaaaaactgaggagcatcatcaccgatgtccaggacaagaacaggggtgactctgagttgcaatgcggacgcatgacagcctgcgtggaaggcccgtatgggcatgaatcaccctaccacttgatgtacgagaatctcatcttggtggcaggaggcattggaatatcgccgttcttggcgatcttgagcgacataatccacaggatcgaggagggcaagcaatgcatgcccaagaacgtgctggtcctttggtcagtcaagaagtccaaggagctttctctcttgtccgctgttgatgctcagaccatcagttcatctgtctcggacaggttgaaactggacatccaggccttcgtgactcaagaatccttgcccccattggaggacggcatcgtcgtggacgaccgcaaagtccctggcatgttcgtcaagaacggttcgaccatgtctggtctggtcggcaccggggacaacttctgggcggccatgtacttcctggcgtccacgctcggcttcctcctggcgttcaccctggtggaggcttactacgtgaagccgcacaacgtggtggcgtggtggtaccggagcctcctgttcatgctgtgcatggttgccggcgtcgccctacccggcggcctcgtggttctcctgtggcatctgtcggagaagcagaggatggagggcgacaagtgggacgccgccgccgattcccagtcaccgcgcgccgagcagacaggccccgcggctgcggcaggtggcggtgacgacgacgctgtccccggcgtcagcctcgccgccctgcggacgacccggtacgggtgccggccgaacttcgaagcggagttcgcggcgttcgcggagcgcgccggggacgcggcggacgtgggcgtgctggtgtgcggaccgccggggctgcagacgagcgtggcgagggagtgcagggcgcggaacctccgccgccgcggcggcggcggggcggagaagagcaggagcagcgcggtcttccatttcaacagccacagcttcgacctctaatcatacacgtctccggtcggtgggttcaacgagcggaattaaattgggtggaccctgggtcaccatcatgtatgttgcacagcacacacacacacggtagttgcatatacatgttgatcctgtatgatatcgtgtatatatatatctatgtatatagctgataattactatgttagtaaagttacaagagatgtataaatctgtatgcgtgttagcgcatatgcatgcatggtagaagcacgaaggttaaaaggctgacaaaacacgtgaatggtccgatcgcgaaaaaaaaacacgtgaaataatcatgtcatgtgtttttgcgtctaatgcgtgaatttctattttcttatggctctgtgagtctgtcaaggtatgctatgtatgttgcgtt

SEQ ID NO: 5585 - DNA, 3384 bp, Sorghum bicolor
ttgcgtacctgatcggcatgggtggggccttccgaagcacacgttggttgtgtggctcactggcactgcgccactcagctctgcaacgacgcaaccacctgaccatggcatcccctgcgcgccctcggcgctcgtcgcccgcccatcgccgtcggagacgagcacggagcacctatacctagtagccgtataaaggcggcagggcctagccccacaggacgcacaagctagtgcgggctttcccccctagattctctctcgcgcgaccgctttcccttctcctggccatggcccacgagcgggagccgctcctgcagcaacgacagaccggcgtcggcaatgccgccgccggtgctaagggctcgtcctcggcgccggcgccggcggcctctgccgcgctgccgtcgctggctaggaccgtgctcaagttcctgatgtgggcggtgttcctcacctgggccgcggggatcttcctgtacccgaccaagcccgtgcaggcagtgttcacgaagtgggtcaggctcagcaaggagtccatgttcggcatcgccgggggtattttcctggccttcagcgcgcccattctgatcattgcgcttctggcatatgtctacatctcattcttcccgagtgagcgtgtggtggaaaaaaagaagctgcggtcactgagtttcaggctctggactttccctgttcttgtagacggcccctttggagttgtctctgcagctgagttcatcggaattgtcctgtttataatttttgttgtctactcaatgacctattatgccgtggagagcgtgagccttgtctcaaaatttgaccttccatcaatgactcagagtgaattgatactggatgtcattggcgcccgttttggggcggttgggttgttctgcatgctcttcctcttcctgccagtcgcaagaggctcagttctcctccggcttatcgatattccatttgagcatgctacaagataccacgtctggttgggtcatctcactatggctctctttacattgcatggcttgttctttgtgatctcatggtccatggaagggcgcctccgtgaagaaatgagagaatggaatgaaactggagtagcaaacctgcctggtgtgatcagcttggcagccggcctacttatgtgggtgacatcacttcacccagtgaggaagaggttctttgagctcttcttctacacccaccagctctacgtcatcttcatcgtgttcttggcgttccatgtcggcaacttcctcttcagtatttcggccggggttgtgttcctcttcatgctcgaccgctttttaaggttctggcagtcaagggccaaagttgacatcatttcagccgcctgccgcccatgtgggacggtggagctagtattttcaaaaccaccaggcctccgctacaatgctttgagtttcatcttcattcaagtgcgcgagctatcgttcttgcagtggcatccgttcagtgtatcttcaagtcccatggatgggagataccacatgtcggttctcataaaaatactcggcacatggactgaaaaactgaggagcatcatcaccgatgtccaggacaagaacaggggtgactctgagttgcaatgcggacgcatgacagcctgcgtggaaggcccgtatgggcatgaatcaccctaccacttgatgtacgagaatctcatcttggtggcaggaggcattggaatatcgccgttcttggcgatcttgagcgacataatccacaggatcgaggagggcaagcaatgcatgcccaagaacgtgctggtcctttggtcagtcaagaagtccaaggagctttctctcttgtccgctgttgatgctcagaccatcagttcatctgtctcggacaggttgaaactggacatccaggccttcgtgactcaagaatccttgcccccattggaggacggcatcgtcgtggacgaccgcaaagtccctggcatgttcgtcaagaacggttcgaccatgtctggtctggtcggcaccggggacaacttctgggcggccatgtacttcctggcgtccacgctcggcttcctcctggcgttcaccctggtggaggcttactacgtgaagccgcacaacgtggtggcgtggtggtaccggagcctcctgttcatgctgtgcatggttgccggcgtcgccctacccggcggcctcgtggttctcctgtggcatctgtcggagaagcagaggatggagggcgacaagtgggacgccgccgccgattcccagtcaccgcgcgccgagcagacaggccccgcggctgcggcaggtggcggtgacgacgacgctgtccccggcgtcagcctcgccgccctgcggacgacccggtacgggtgccggccgaacttcgaagcggagttcgcggcgttcgcggagcgcgccggggacgcggcggacgtgggcgtgctggtgtgcggaccgccggggctgcagacgagcgtggcgagggagtgcagggcgcggaacctccgccgccgcggcggcggcggggcggagaagagcaggagcagcgcggtcttccatttcaacagccacagcttcgacctctaatcatacacgtctccggtcggtgggttcaacgagcggaattaaattgggtggaccctgggtcaccatcatgtatgttgcacagcacacacacacacggtagttgcatatacatgttgatcctgtatgatatcgtgtatatatatatctatgtatatagctgataattactatgttagtaaagttacaagagatgtataaatctgtatgcgtgttagcgcatatgcatgcatggtagaagcacgaaggttaaaaggctgacaaaacacgtgaatggtccgatcgcgaaaaaaaaacacgtgaaataatcatgtcatgtgtttttgcgtctaatgcgtgaatttctattttcttatggctctgtgagtctgtcaaggtatgctatgtatgttgcgttgcaagatttagtagtgaaaatgttatctttaggtccctttgggattcctgggtaaaaattgttttgtagtgctaggttacctttgatttgaagatacaatttttcttttcatttaaaagaggtgtttttagcaaagaataatttgttgaggaggggttgaaaaggtgacactaagattagtcttaatgggggttcataagagtgtcatgtacattaaatatgttgacgtagcactatatattggttcataagactgtcatgtacattaaatatattgatgtggcactatattgatgaagagaaatatgatgagagttttatgggagcagagatagtttcatggggatggaactcttttgcactgtctccaaaatacaagtgttttgaaaactgagctatgaa

SEQ ID NO: 5586 - DNA, 966 bp, Setaria italica
gcctgccccactttatccgcggcgcgccgagagccctcccgccggcctcagaggctgagacacccagctgctgcgccccgtgctattagccttagccgccgacgtgcccccacgcctaacgcctcggcaccgcgccgcgacgtcacccggccctagtgacgacaccgaccagttcactgcgcgccgccgtgcgacaccatggccccgaccgccccagctgccacgggagcggcgagccccgccgcgccgaccgtcgccaagggcgaggccaaggccgccgcgcgctccgtcgggctccggctgcccgcgctgccgccgctgcccggcctcggcctcgcggcgcagggacagacccgcgccgtctccgtctgcaagctgctggcgaggaacgtggtggccatggccgcgggggagccagcggcgccgaatgctgccaacgaggagttcaccgagttcgtcaacgccctgaaacaggagtgggacaggatcgaggacaagtacgcggtgaccacgctcgccgtcgcggccacgctcggcatgtggagcgccggtggagtagtatcggcgattgacaggctccccgtggttccaggcctgatggaggctgttggaattggatacagtgggtggttcgcgtaccggaacctgctattcaagtctgacagggatgctttctttgcaaaggtcagggaggtctacgaggatataatcagcggctaataggcggagcactaatgcaagctcaacaaaactaagttcactctacgaggacctattagtctgctgctgttcagtttgttgtccctgtatattttcagtagagcatctaatttgatccttactcaatgtatggataaatactttggatattactcgtacataacatttaatcgttttagtcatttgtttcttcgaatttgccaaggccgatgaatttcagctgtaaggcaatacagcatttggaat

SEQ ID NO: 5587 - DNA, 1733 bp, Glycine max
aaatggctaccacttctgcttcattcgctcgcttctccgtcatatcgcgaccttcttcgtcaaatccccaattcatcctcttcaacgccgctccccgaaccggaacccctcattcccgaaccggttcggcccggttcaggtgcttggccggccagaccgggttcttcacgaaactagggcggttgataaaggagaaggcgaagagcgacgtggagaagctcttctcgggattctccaagacccgcagcaacctcgccgtcatcgacgagcttctcctctattggaacctcgccgacaccgaccgcgtcctcgacgaactcgaagaggctcttttagtgtccgattttggaccaagaatcactattaaaatagtggagaatttgcgtgaggatatattttcagggaagcttaaatcagggaatgagataaaggaagcactgaagaggaacgttttggaattattaacttccaaggggagtaaaactgaacttcaacttggatacaggaagccagctgtaataatgatagttggtgttaatggtggagggaagactacatctttgggaaagctggcctatagattgaagaatgaaggggctaagatattgatggcagctggtgatacatttagagcagctgctagtgatcagttggaaatatgggccgaaaggactgggtgtgagattgttgtggctgaatcagagaaagcgaaagcatcatcagtgctttcacaggctgtaaaaaagggaaaagagctaggttttgatattgtattatgtgatacatctgggcgtttacacactaattacagcctaatggaagagttgatttcctgtaaaaagtctgttgctaaagtcgttcctggtgcacctaatgagattctactggttctggatgggactaccggtttgaatatgttgccacaagcgagagaattcaatgatgttgtgggtgttactggtttagttttgaccaaactggatggttctgctagaggtggctgtgtggttagcgtggttgatgagcttggaatccctgtaaaatttgtgggtgttggtgaaggtgttgaagaccttcaaccttttgatgcggaagcctttgtcaatgccatttttatgtaaaccaatattgtgggtttgaatcatttattagcagaaacagcttgacatggaatattcagagcaacaccaggtcacaggaaagatggcacttgattatggaaaccgttatttgggggtggggggcaagcattgcgaataagtgtacatgattttgaggtgcagagctgttgcttgaggaacgctgagtattttgcatgctgtagctggaagattctgacgcgatgcaaatgagaaatggggtttataatcactcctgtttatgaacagaagggttttattgtggtgtgcgtgtagatgatacttagaaaggaaaatgtaaacagtaaacacattgctccattgtctgtcaacttctgattaatgacaaatttttatttctttgacctcttaacgaggttaacctactatatttatggtgagaaataatcaattatctgtctatggggaaaacaaagcaataaatagtttattctacttttttcatgataccaccatgattttgaggagtaaaattgattcttggtgttatgcgaacacattatgtgtcgtacatacatagccatgaacactcttagtaagaacccattcaaagttgagcattcgtgcacaata

SEQ ID NO: 5588 - DNA, 2090 bp, Cajanus cajan
gtggttgagcaaagtgtggagcacttagaagttagaagcagcagaaatggctaccacttctgcttcgttcgctcgcttctccgtcatctccaaactttcctcccatccacaattcatcctcttcaacatcgctactccaaccggaaaccctcattcacgaaccggcgcggcccgcttcaggtgctcggccggtcagaccgggttcttcacgaaactggggcggttgttaaaggagaaggcgaagagcgacgtggagaaggtgttctcgggtttctccaagacccgcaacaacctcgccgtcatcgacgagcttctcctctattggaacctcgccgacaccgaccgagtactcgatgaactcgaagaggctcttttagtgtctgattttgggccgaaaatcactattaagatagtggagaatttgcgcgaggacatactttcagggaagcttaaatcagggaatgagataaaggaagcactgaagaggaatgttttggaattgctaacctccaagggcagtaaaactgaacttcaacttggattcaggaagccatctgtaataatgatagttggtgttaatggtggagggaaaacaacatctttgggaaagctggcttatagattgaagaatgaaggggctaagatattgatggcagctggtgatacatttagagcagctgccagtgaccagttagaaatatgggctgaaaggactgggtgtgagattgttgtggctgaatcagagaaagcaaaagcatcatcagtgctttcacaggctgtaaaaaagggaaaagagctgggttttgatattgtattatgtgatacatctgggcgtttacacactaattacagcctaatggaagagttgatttcttgtaaaaagtctgttgccaaagtcattcctggtgcacctaacgagatcctacttgttctggacgggactactggtttgaatatgttgccacaagcgagagaattcaatgatgtcgtgggtgttactggtttaattttgaccaaactggatggttctgctagaggtggctgtgtggtcagcgtggttgatgagctcggaatccctgtaaaatttgtgggagttggtgaaggtgttgaagaccttcaaccctttgatgcggaggcctttgtcaatgccatttttatgtaaaccaacagtgtgggttcggtatgtacatcattacttgtccttttcatttaatggaaatgcagtagagtgccacatcagcattttcgttaaatatgggatgataagtgagcatatgaatcaaaattgcacaattaaaatagtgaaaggattaaattcgcaaaaagaaaaaggggcacaatgttcacgaaattgagaaagtaaattgactatagagggcaagtaagccaatttgaaatatttccacttgccacttggggtgtaaaggatgcggtaagcttggtgttaaagcctttttctttggtttagtttctgtataaaaattccaaaatgaaaaatggattgttactactattttgtgtttcttgcacattgcacattggctgtttcaactttcaatcttttcttctgacattgttgtatatgtcaccatttggaatcattcatcagcagagcagctagcttgacgtgaatattcagagcaacaccagatcacaggaaagatgacactttattgttgaaccttactcgggagaggcgaagcattgcgaatttgtaaatgattttgaggtgcagagttgttgctattgaggcacgcagagtgtatataatcatccttttgcatgctgtggctggaaatttctgacagtgcaagtgggtcatgggctttattttcactcctgtttatgaaccgaaggattttatttgtgatgtgcatagaggtcatacttagaggaaaatttaaacagtaacacatgctccattctctgtcagcatctgattaatgacgcatgtttttatttctttgacttctcaacgaggttaatttggtgtatcgtccatggttgtcgaaggcacggtgacagaagtggttaatggatggaatttttcacggatgtgtcagtaaaacttgcatggaggcatgcctaag

SEQ ID NO: 5589 - DNA, 1565 bp, Phaseolus coccineus
tggttcagcgaactgcgcagaactcagcagtagcagaaatggctaccatttctgcttccctagctcgcttctgcgttatctcgcgaccttcctccaactcacagtatatcctcttcaacgtcgcgcctcgaaccggaacccccaattcccgaaccggctcggcccggttcaggtgctcagccggccaggccgggttcttcacgaaactgggccgtttgattaaggagaaggcgaagagtgacgtggagaaggtgttctcgggattctccaagacccgcaacaacctcgccgtcatcgacgagcttctcctctactggaacctcgctgacacagaccgagtccttgacgaactcgaagaggctcttttagtgtctgattttggcccgaaaatcactattaaaatagtggagaatttgcgtgaggatatattgtcagggaagcttaaatcagggaatgagataaaggaagcattgaagaggaatgttttggaattgttaacctctaagggaagtaaaactgaacttcaacttggattcaggaaaccggctgtaataatgatagttggtgttaatggtggagggaagacaacatctttgggaaagctggcctatagattgaagaatgaaggggctaagatattgctggcggctggtgatacatttagagctgctgctagtgatcagttggaaatatgggccgaaaggactggatgtgagattgttatggctgaatcagagaaagcaaaagcatcatcagtgctttcacaggctgtaaaaaagggaaaacagctcggttttgatgtagtattatgtgatacatctggtcgtctacacactaattacagcttaatggaagagttgatttcctgtaaaaagtctgttgctaaagtcattcctggtgcacccaatgagatcctactggttctggatgggaccactggtctgaatatgttgccacaagcaagagaattcaatgatgttgtgggtgtcactggtttaattttgaccaaactggatggttctgctagaggtggctgtgtggttagcgtggttgatgagcttggaatccctgtaaaatttgtgggtgtcggggaaggtgttgaagaccttcaaccctttgatgcggatgcctttgtcaacgccatttttatgtaaaccaatattgtgggtttgttgaatgtcacccatacaatcttcttccatagcaacagccgatcacaggaaaatggcacttagttatggaacccttctcggaagaggccaggtattgcgaatatgttgacatgatttttgaagtgccagagctgttgttgctcttgaggcacgctgagtgtatataatcttccttttgcatgctgtggctgaagtagtttctgacaatgcaattgggacatggggtttatattcactccttttatgaaccaaagcatttcattgtggtgtgcacatatatagatgatgcttgaaggaaactgtaaacagtaaatacatcctccattatcagtcaacacaagcatcaaccacgtaactaattaatagaattaaatatttgttattttgttttac

SEQ ID NO: 5590 - DNA, 1536 bp, Phaseolus coccineus
  misc_feature (38)..(38): n is a, c, g, or t
  misc_feature (42)..(42): n is a, c, g, or t
  misc_feature (44)..(45): n is a, c, g, or t
  misc_feature (334)..(334): n is a, c, g, or t
  misc_feature (339)..(339): n is a, c, g, or t
gtagcagaaatggctaccatttctgcttccctagctcncttntnngttatctcgcgaccttcctccaactcacagtatatcctcttcaacgtcgcgcctcgaaccggaacccccaattcccgaaccggctcggcccggttcaggtgctcagccggccagaccgggttcttcacgaaactgggccgtttgattaaggagaaggcgaagagtgacgtggagaaggtgttctcgggattctccaagacccgcaacaacctcgccgtcatcgacgagcttctcctctactggaacctcgctgacacagaccgagtccttgacgaactcgaagaggctnttttngtgtctgattttggcccgaaaatcactattaaaatagtggagaatttgcgtgaggatatattgtcagggaagcttaaatcagggaatgagataaaggaagcattgaagaggaatgttttggaattgttaacctctaagggaagtaaaactgaacttcaacttggattcaggaaaccggctgtaataatgatagttggtgttaatggtggagggaagacaacatctttgggaaagctggcctatagattgaagaatgaaggggctaagatattgctggcggctggtgatacatttagagctgctgctagtgatcagttggaaatatgggccgaaaggactggatgtgagattgttatggctgaatcagagaaagcaaaagcatcatcagtgctttcacaggctgtaaaaaagggaaaacagctcggttttgatgtagtattatgtgatacatctggtcgtctacacactaattacagcttaatggaagagttgatttcctgtaaaaagtctgttgctaaagtcattcctggtgcacccaatgagatcctactggttctggatgggaccactggtctgaatatgttgccacaagcaagagaattcaatgatgttgtgggtgtcactggtttaattttgaccaaactggatggttctgctagaggtggctgtgtggttagcgtggttgatgagcttggaatccctgtaaaatttgtgggtgtcggggaaggtgttgaagatcttcaaccctttgatgcggatgcctttgtcaacgccatttttatgtaaaccaatattgtgggtttgttgaatgtcacccatacaatcttcttccatagcaacacccgatcacaggaaaatggcacttagttatggaacccttctcggaagaggccaggtattgtgaatatgttgacatgatttttgaagtgccagagctgttgttgctcttgaggcacgctgagtgtatataatcttccttttgcatgctgtggctgaagtagtttctgacaatgcaattgggacatggggtttatattcactccttttatgaaccaaagcatttcattgtggtgtgcacatatatagatgatgcttgaaggaaactgtaaacagtaaatacatcctccattatcagtcaacacaagcatcaaccacgtaactaattaatagaattaaatatttgttattttgttttac

SEQ ID NO: 5591 - DNA, 1711 bp, Cicer arietinum
gtgtgtcgtcctcgcctccgtcgactcgtcgctcgtcagccggtcgtacgtcgttaactagacgtactaacggacgtaagaaggaagaagcgaagggggagtagaagaaaggaaaggaaaaggacaacgaagaagaagagagaggggcggtaaataaaggtacaataactcaataagacttacatgatcgaaacgacgtcatatttgcacacgttatcttcttcttcttcttctagttctgggaaaactacaagctcgtagcagaaatggctactactgcctctgcttcattcactcgcttctctattatcccaaaaccaccttcccaaccgcatttcatcctatacaacttccctaatcgaaccggcacatcccggttcacctgttcagccggtcaggccgggttattctctaaactaggccggttactaaaggagaaagcgaagagcgatgtagagaagttattctcgggtttctcaaagactcgtaacaacctctccgtcatcgatgagcttctcctctattggaacctctctgacactgatagagtcctcgatgaactcgaagaggctcttttagtgtctgattttggaccgaaaatcactatgaagatagtggagaatttgcgcgaggatatactttcagggaagcttaaatcagggaatgagataaaggaagcactgaagaagaatgttttggatctgttaaccaaaaaggggagtaaaactgaacttcaacttggattcaggaaaccagctgtaataatgatagttggtgttaatggtggtgggaagacaacatctttgggaaagctggcttatagattgaagaatggaggtgctaagatattgtttgcagctggtgatacattcagagcagctgctagtgatcagctggaaatatgggctgaaaggactgggtgtgagattgttgtggctgagtcccagaaagccaaagcatcatcagtgctttcacaagctgtaaaaagaggaaaggagctaggttttgatgttgtgttatgtgatacatctgggcgtttgcatactaattacagcctaatggaagagttgatttcatgtaaaaaggctgttgctaaagtagttgccggtgcacccaatgagatcctactcgttctggatgggactactggtttgaacatgttgccacaagcaagagaattcaatgaagttgtgggtgttactggtttaattttgaccaaactggatggttctgcaagaggtggctgtgtggtcagtgtggttgatgagcttggaatccctgtaaaatttgtgggtgttggtgaaggggttgaagatcttcaaccctttgacgcggaggcctttgtcaatgccattttcatgtaaaccagttacaggctttgatgtatatgctacagttcagaatatatattcgcagaagaggttgacacgaatatgaagagcaacacttgatcacaggaaagataacttttaataattgaaatcattcttcagaggcaaagctttgcaaaaggtaaaatgattttggggtgcggagctattcttgctttggaggcagctgagagtatatattcctttcacattggttggcagtttctgacattgtgacagagtgatggggtttattttccactcttggcattgaactcagggattttgttgcggtgcttgtaaatgatagtacagaaaacatgaagattgaacataatgtc

SEQ ID NO: 5592 - DNA, 1550 bp, Arachis hypogaea
gaagaagggaaaaaaatggcttcttcttcttcttcgatgtgcgcttcttactcttcagtaatctcgagacctttttataattctcaaccgcaattcgcgttcttccgtaccgggaaactcggttcggttcccgattcgggtgggcggttcaggtgtatggctggtcaaaccggattcttcacgaagcttgggaggctaataaaggagaaggcgaagagcgacgttgagaagatattctccggcgggttcacgaagacgcggaaaaacctcgccgtcatcgacgagcttcttctctattggaatctctccgacaccgatcgagtactcgacgagctcgaagaggctcttttggtgtctgattttggaccaaaaatcactattaagatagtggagaatttgcgtgaggatatattgtcagggaagctcaaatcaggcactgagataaaggaagcactgaaacagaatgtcttggatttgttgacgactaaggggagtaaaactgaacttcaacttggattcaggaagccagctgtaataatgatagttggtgttaatggtggtggaaagacaacatctctgggaaagctggcgtatagactgaagaaagaaggggcaaagatactgatggctgctggtgatacatttagagcagctgctggtgatcagctagagatatgggctgaaaggactgattgtgagattgttagggctgaatcagagaaagccaaagcatcatcagtgcttacacaagctgtgaaaaagggaaaagaactaggtttcgatattgttttatgcgatacatctggacgtttacacactaattacagcctaatggaagaattgatttcttgtaaaaaggcagtgagcaaagtcgttgctggtgcccctaatgagatcctactggttctggatggaactacaggtttgaatatgctgccacaggcaagagagttcaatgaggttgtaggtgttacgggtttaattttgaccaagctggatggttctgcaagaggcggctgtgtggtcagtgttgttgatgagcttggaatccctgttaaatttgtgggtgttggtgaacgtgtagaagaccttcaaccctttgatgcagaggcctttgtcaatgccatcttttcgtaaaccaatgttaggttatgttaatatggatcatttattagcagaaaagcttggcatggatatgaagagccaataccaggtcataggaaagactggcagtgaagccatgcttaggagagggaaggcaatcaaggcattacaaaactgtgtaaatgattttgtggtgcagagacgatattgcttttgatgcacgttagggtgtatagaaacatttttcattctctgtggctcagtttttgacaacacaaaggtgtttatatgatgtgcatgtaaacatgtgccccattgtttgtaatatatctgtttgattaatgatatgtttttcttgcttagatttctcaggttttagtttcaaccatcatcaattcatcatctatgcaaatttgcacttgtaaaggaaatttacccttaataat

SEQ ID NO: 5593 - DNA, 1327 bp, Medicago truncatula
gccgaacctaaaatcaatatctattttgtcaaatttgggcacgttatcttcttctgcttcagtgaaaactagtaaaaaacttcaaccttctctcaaaaatggctactaccacctccgcttcattctctcgcctctccattcccccaaaatcaccctctcaaccacaattcctcatcttcacctccccatttcaaactaaatccccctcatctcgaacccggttcacatgctccgccggtgaaaccggtttattcacaaaactcggccggttactaaaagaaaaagcaaaaagcgatgtagagaaactcttctccggtttctcaaaaactcgtaacaatctctccgtcattgatgagcttcttctttattggaatctctctgatactgataaagttcttgatgaacttgaagaggctttattagtttctgattttggaccgaaaattactattaagattgtggagaatttaagggaggatatactttctggtaagcttaaatcagggagtgagattaaggaagcactgaagaagaatgttttggatttgttaagcaacaaggggagtaaaactgaacttcaacttggatataggaaaccagccgtaataatgatagttggtgttaatggtggtgggaagacaacttctttgggaaagctggcttatagattgaagaatggaggtgctaagatactgttggcagctggtgatacattcagagcagctgctagtgatcagctagaaatatgggctgaaaggactgggtgtgagattgttgtagctgagtctgagaaatccaaagcatcagcagtgctttcacaagctgtaaaaagaaggaaaagagctaggttatgatattgtattatgtgatacatctggacgtttacacaccaattacaggctaatggaagagttaatttcttgtaaaaaggctgttgctaaagtagttgctggtgcacccaatgaaatcttactggttctggatggaactactggtttgaatatgttgccacaagccagagaattcaatgaagttgtgggtgtaactggtttaattttgaccaaactggatggttctgcaagaggtggctgtgtggtcagtgtggttgatgagcttggaatccctgtaaaatttgtcggtgttggtgaaggtgttgaagaccttcaaccctttgatgcagaggcctttgtcaatgccatttttctgtaaaccataagtaggcttaggctatgctacgattcagaatcacatatttacacgaatatgcagagcaacattaggtcacaggaaagagaaagacaacattttatcatttaatccattcttg

SEQ ID NO: 5594 - DNA, 1663 bp, Medicago truncatula
gccgaacctaaaatcaatatctattttgtcaaatttgggcacgttatcttcttctgcttcagtgaaaactagtaaaaaacttcaaccttctctcaaaaatggctactaccacctccgcttcattctctcgcctctccattcccccaaaatcaccctctcaaccacaattcctcatcttcacctccccatttcaaactaaatccccctcatctcgaacccggttcacatgctccgccggtgaaaccggtttattcacaaaactcggccggttactaaaagaaaaagcaaaaagcgatgtagagaaactcttctccggtttctcaaaaactcgtaacaatctctccgtcattgatgagcttcttctttattggaatctctctgatactgataaagttcttgatgaacttgaagaggctttattagtttctgattttggaccgaaaattactattaagattgtggagaatttaagggaggatatactttctggtaagcttaaatcagggagtgagattaaggaagcactgaagaagaatgttttggatttgttaagcaacaaggggagtaaaactgaacttcaacttggatataggaaaccagccgtaataatgatagttggtgttaatggtggtgggaagacaacttctttgggaaagctggcttatagattgaagaatggaggtgctaagatactgttggcagctggtgatacattcagagcagctgctagtgatcagctagaaatatgggctgaaaggactgggtgtgagattgttgtagctgagtctgagaaatccaaagcatcagcagtgctttcacaagctgtaaaaagaaggaaaagagctaggttatgatattgtattatgtgatacatctggacgtttacacaccaattacaggctaatggaagagttaatttcttgtaaaaaggctgttgctaaagtagttgctggtgcacccaatgaaatcttactggttctggatggaactactggtttgaatatgttgccacaagccagagaattcaatgaagttgtgggtgtaactggtttaattttgaccaaactggatggttctgcaagaggtggctgtgtggtcagtgtggttgatgagcttggaatccctgtaaaatttgtcggtgttggtgaaggtgttgaagaccttcaaccctttgatgcagaggcctttgtcaatgccatttttctgtaaaccataagtaggcttaggctatgctacgattcagaatcacatatttacacgaatatgcagagcaacattaggtcacaggaaagagaaagacaacattttatcatttaatccattcttgagaggccaagcttcgcagaaggtgaaaatgattttggggaagcgaagctattcttgctttgaaggtaactcagctggtataacccctttgcatgctttgtggttggcagtttcggacaatacgacaatggtttatttccactcttggcattgaacttgaagattttgttgtggtgtccatgtaaatgaatgataccacagaaaacatgagctaacatatggtccattatttgtcaatgattatgtgattatttttttccttcctttcttcaacttctcaatgaggtgtcttatttcattgtttttgtcatccggggacaacttttgaacaaggcac

SEQ ID NO: 5595 - DNA, 1593 bp, Quercus alba
gagagaaggcaaaaatggcagcttcctctgctaacctctcgctcctctccaaaccttcaacagcttcgtcaccaccacaccttctctttaacctccctaagaccctctccgccaatccccgacccggaacttcccggttcaaatgctcggccgggcagaccgggttcttcacccggctggggcgtttgattaaagagaaggccaagagtgacgtggagaaggtattctcgggcttctcaaaaacccgcgagaatctcgccgtcatcgacgagctcctactctactggaacctcgctgatacagacaaagtcctcgacgaactcgaagaggctttactagtgtctgattttgggccaaggatcaccattaagattgtggagagcttgcgggaagatatattgtcgggaaagcttaagtcagggagtgagattaaggatgcattgaagaagagtgtgttggaattgataactacgaggggtagtaaaaccgagcttcaactcggattcaggaaaccagccgtggttataattgttggtgtcaatggaggtggcaagacaacatcacttggaaaactggcctatagactgaaaaacgaaggggccaagatactgatggcagcaggtgatacttttagagcagccgctagtgatcagctggagatatgggctgagaggactgggtgtgagattgttgtggctgaaaaagataaggctaaagcatcatcagttctttcacaagctgtgaaaagagggaaagaacaaggttttgatgtagttttatgtgacacatctggacgtctccacactaatttcagtctgatggaagagttgattgcctgtaaaaaagctgtggggaaaattgttccaggtgcaccaaatgagatcctgctagttttggatgggacaactggtttgaacatgctaccacaagcaagagagttcaatgaagtggttggaattacgggattgattttgacaaaacttgatggttctgccagaggtggctgtgtggtcagtgtggttgatgagcttggcatccctgtaaagtttgtgggtgttggagaaggtgttgaagaccttcaaccctttgatgcggaggcctttgttaatgccatattttcataaagcgtaaaaagtggccagcaaattaaccggtttttctctttacaattcagcagcagcgctcagcataatagcaaagacactataatgaaagcaagcaaagcaataaaagataaaagagagcccgaagtaaagaggttaaccttgaggccactcttttaaagatgcattattatactagagtgtgaagaagtgacctggggctgcggagtaaaatagctgttgttgagactctgcacacaattcttttctgctttttgtggctgacagtggtgacaatttggtctgtgtgagagaacagagaatctctagttgatcactagtttaacttatttttcccatgtaaaaaaagagtaaaaatagtactactgataatgtgaaattcatgcatcattgtttccaatttctagcccatgaggccatgacggatccagcattattgtggcttttaatgtggtgttaacgacccatg

SEQ ID NO: 5596 - DNA, 1388 bp, Gossypium hirsutum
tccaaacgacgtcgttgggagaatgctatccactccgagtccttcgcttcatctcacagaattcagtttaccgagagccatagaaatggcttcttctgctcagttctccctcactttcaaaccctcaccgtcaccgctcttttccaacttccctcgaacccggttcagtcctttcacaaccgctaggccaatcgcttcccgtttcaaagtcctggctagtcagaccgggttcttcactcggctcggccggttgatcaaggaaaaggccaagagtgacgtcgaaaagatcttctcaggtttctccaaaaccagagacaacctcgccgtcatcgacgaactcttattatactggaacctcgccgacaccgatcgcgtcctcgatgaacttgaagaggctttgttggtatccgattttgggccaagaattactattaaaatagtggaacgcttgcgggaggatattctaagtggaaaacttaaatcaggaagtgaaataaaggatgcattgaagaagagtgtgttggatctcttaacaacgaaggggagtaacaccgagcttcgacttggattcaggaagccagccgtgatcatgattgttggcgttaatggaggtggcaagacaacatcacttggaaagctggcttatagactaaagaatgaaggggcaaaaatattgatggctgcaggggacacattcagagcagctgctagtgatcaactagagatatgggccgagagaactggttgtgagatagttgtagctgaaaaagagaatgcgaaagcatcatcagtgctttcgcaggctgtgaaaagaggtaaagagcaaggttttgatgttgtcttatgtgacacatctggacgccttcacaccaattacagcttgatggaagagttgatagcatgtaagaaggctgtcgaaaaagttgttcgtggtgcacctaatgagatactactagttcttgatgggaacaccggattgaatatgcttcctcaagctagagagttcaatgaggttgttggaataactggttttattttgacaaaacttgatggttctgctagaggtggctgtgtggtcagtgtggttgatgagcttggcattcccgtgaagtttgtcggtgttggtgaaggtgttgaagaccttcaaccctttgatgcagaggcatttgttaatgccatattttcgtgagaaatattgttggattgtaatcgtttgagaccagtttggcttatgtcaggcttctacacgcatattgttgtaagaacgcggtcacaagagtactcgttcggatgtgtgaaaaagcttcagcaagataatgatgatgcaaatttttgggtctatacattattcctctgtcctaatatttgagcattatgatcttgtcttc

SEQ ID NO: 5597 - DNA, 1364 bp, Gossypium hirsutum
gaatgctatccactccgagtccttcgcttcatctcacagaattcagtttaccgagagccatagaaatggcttcttctgctcagttctccctcactttcaaaccctcaccgtcaccgctcttttccaacttccctcgaacccggttcagtcctttcacaaccgctaggccaatcgcttcccgtttcaaagtcctggctagtcagaccgggttcttcactcggctcggccggttgatcaaggaaaaggccaagagtgacgtcgaaaagatcttctcaggtttctccaaaaccagagacaacctcgccgtcatcgacgaactcttattatactggaacctcgccgacaccgatcgcgtcctcgatgaacttgaagaggctttgttggtatccgattttgggccaagaattactattaaaatagtggaacgcttgcgggaggatattctaagtggaaaacttaaatcaggaagtgaaataaaggatgcattgaagaagagtgtgttggatctcttaacaacgaaggggagtaacaccgagcttcgacttggattcaggaagccagccgtgatcatgattgttggcgttaatggaggtggcaagacaacatcacttggaaagctggcttatagactaaagaatgaaggggcaaaaatattgatggctgcaggggacacattcagagcagctgctagtgatcaactagagatatgggccgagagaactggttgtgagatagttgtagctgaaaaagagaatgcgaaagcatcatcagtgctttcgcaggctgtgaaaagaggtaaagagcaaggttttgatgttgtcttatgtgacacatctggacgccttcacaccaattacagcttgatggaagagttgatagcatgtaagaaggctgtcgaaaaagttgttcgtggtgcacctaatgagatactactagttcttgatgggaacaccggattgaatatgcttcctcaagctagagagttcaatgaggttgttggaataactggttttattttgacaaaacttgatggttctgctagaggtggctgtgtggtcagtgtggttgatgagcttggcattcccgtgaagtttgtcggtgttggtgaaggtgttgaagaccttcaaccctttgatgcagaggcatttgttaatgccatattttcgtgagaaatattgttggtaaagtgatccgtttatataatccttttgataacatcttatcaatcaccatgttcattggaattaaaccagtgcaatttcttcatgtttcttagaattgtaatcgtttgagaccagtttggcttatgtcaggcttctacacgcatattgttgtaagaacgcggtcacaagagtactcgttcg

SEQ ID NO: 5598 - DNA, 1135 bp, Citrullus lanatus
gtccttggagctgaaaaaaagttatggccgcggcctcactctctcaactctcctttctctcaaatccttcacctcgaagcttaatcgttccatcgcttcggccaaccactcctttccacggcggtggttctcgtttcagatgctccgccggtcagacgggattcttcactcggcttggcaggctgcttaaggagaaggccaaaagcgatgtcgagaagatcttctcgggcttctcaaaaacccgagacaaccttgccgttattgatgagcttctcctatactggaacctcgcggaaaccgatagagttctcgacgagctcgaagaggcattattggtttctgatttcgggccaaggatcaccattaagatcgtggacagcttgcgtgatgacatattggcagggaagcttaaatcaggcagtgaaataaaggatgcattaaagaagaatgttttggagttgttgacggggaagggtagcaaaactgatcttcaacttggattccggaaaccagctgttattatgatagttggtgttaacggaggtggaaagacaacatctcttggaaagctggcttttagattgaaaaacgaaggggccaaaatattaatggcagctggtgatacatttagagcagctgctagtgatcagttggaaatctgggcagatagaaccggatgtgagattgttgttgctgaaaaagacaatgccaaagcatcatcagttctatcacaggctgtaaagaaaggaaaagaaggtggttttgacattgttttatgtgatacatctggacgtctacatacgaattatagcttgatggaagagttaatagcatgtaagaaagctgtagccaaagttattccaggggcacctaatgagatcttgcaggtattagatgggactactggtttgaatatgctgccacaagcaagggagtttaatgatgtagttggaattactggtttaattttgacaaaactagatggttctgctagaggtggttgtgtggtcagtgtggtcgatgagcttggcatccccgtaaagttcattggcgttggtgaaggattagaagatcttcaaccttttgatgcagaggcctttgttgatgccatattttcatgatttgtacaatatgg

SEQ ID NO: 5599 - DNA, 2282 bp, Prunus persica
ctgaaaaggaatggcttcgcctttgccttcgtctctccatcggctttcactcctctccaaaccttcaccacctcaaaaccaccgcctccttgtaaccccgacccgacccgaactttcccggttcgaatgccgggcgggccagaccgggttcttcacccggctcggaaggcttatcaaggagaaggccaagagcgacgtagagaagctcttctcgggattctccaagactcgcgataatctcgctgtcatcgacgagctcttgctctactggaatctcgctgacactgatcgagtcctcgacgaactcgaagaggctctgctggtatcggattttggtccaaaaatcacaattaagattgtggaaagtttgagggaggacatagttgctgggaagctgaaatctggaagcgaaataaaggaagcattgaagaagagtgtgctggacttgttaactacaaaagggagcaaaactgaacttcaacttggatacaggaaaccagctgtggttatgattgttggcgttaatggaggtgggaagacaacatctcttggaaagctggcttacagattgaagaaggaaggggccaaggtattgatggcagcaggagatacatttcgagcagctgcctgtgaccagctggagatatgggctgggaggacggggtgtgagattgttgtagctgaaaaagagaaggctaaagcagcatcagttatttctcaggctgtgaagagagggaaagaacaaggttatgatattgtcttatgtgacacctctggacgtctgcacactaattacagcttgatggaagagttgattgcatgtaagaaagctgtgagcaaagtcattcctggtgctcctaatgagatcctacaagttctggatgggacgacgggtttaaacatgcttccgcaagcaagagaattcaatgagattgttgggataactggtttgatattgacaaaacttgatggctctgctagaggtggctgtgtggtcagtgtggtaaatgaactcggcatccctgtaaagtttgtgggtgttggtgaaggtgtagaagacctccaaccctttgatgcagaggcctttgttaatgccatattttcgtaaccctaaaggatgagaattacataatcccctaaatctgtgtgctggcggcgggtccttgtccagccatataagcaactatttaatttgattggggaaaatgaggtcaggatgaaacttcacacgtggaaccacacatttagtcttcagatgatcaggatattactggcatactgctcatatggcaagtatcatattgctgctgttagatgaaactcgactagaattgatgcaaagttgtgaagccttaagctgcagggcggttgctgctgtataggattgaagagtggttctaacccttcatacggcactgatagggagacaatttcaactccaattgattaattgaacggattcttcttgtccttcaattttttttgttttttaagggaaaaacttatctgagtctccaacgcatgcatttgagtgtaatatccctgtatctttgcttctctccaatggtttgattgagtgtaagttatttcgctggcaacaagtttagggtttctacttgggtacctcatttcctatattctataataattgtgttatagaaaagttcttaatctccagattcataatttggcaacgggacgtcccagttttcgtgagtctggatttgaactcaattgctatcgcagtgagatttcttccactcctcactacagaaccatcacctatcacccctgcctataagcaagtttcgttgcaaagacgagaaaaataaaataaatagatatatgtggccaatgtaatgaaactatatacgataaagtttgtaaaccatgcagtaacagaaatccttcagaatttacaacccaaactttttaagtgccaacatccatcctctcaactctctccgccctcctccatcctttctcgatcttactgcctcagtctcgctcatatcctcttctcactctcagatgatcagatctcaccgggctttcatcaaaggtaagaaatctatgattgaattgatggcttgctcttcactgaattaaaagtgtatcaacatttctctcgtctcatagagaacacaatggaaatcatgccaccaccgacaagtgtgtgatatgtcgttttccttgctaaatgcatgtttgagcaatgagttttaagttgccagccacaattactcctccattatttattttcattaaaattccaataaata

SEQ ID NO: 5600 - DNA, 1132 bp, Cucumis sativus
tggaaaaaagttatggccgcggcctcactctctcaactatcctttctctcaaatccttcaccccgaagcttatttgttccatcgctccggccaacaactcctttccggcgaatccacggcgatggttctcgtttcagatgctctgccggtcagacgggattcttcactcggcttggcaggctgctgaaggagaaggccaaaagtgatgtggagaaggtcttctcaggcttctcaaaaacccgagacaaccttgctgttatcgatgagcttcttctgtattggaacctcgcggaaaccgatagagttctcgacgaactcgaagaggcattattggtttctgatttcgggccaaggatcaccattaagatcgtggacagcttgcgtgatgacatattggctgggaagcttaaatctggtagtgaaataaaggaagcgttaaagaagaatgtcttggagttgttgaaagggaaggggagcaaaactgaccttcaacttggattccgcaaaccagctgtgattatgatagttggcgttaacgggggtggaaagacaacatcccttggaaagctggcttttagattgaaaaacgaaggggccaaaatattaatggcagcgggtgatacatttagagcagctgctagtgatcagctggaaatttgggcagatagaactggatgtgagattgttgttgctgaaaaagagaatgccaaagcgtcatcagttctatcacaggctgtaaagagaggaaaggaaggtggttttgacattgttttatgcgatacatctggacgtctacatacaaattatagcttgatggaagagttaatagcatgtaagaaagctgtggccaaagttattccaggggcacctaatgagatcttgcaggtattagatggtacgactggtttgaatatgctgccacaagcaagggagttcaatgatgtagttggaattactggtttaattttgacaaaactagatggttctgcaagaggtggttgtgtggtcagtgtggttgacgagcttggaattcctgtaaagtttgttggcgttggtgaagggttagaagatcttcaaccttttgatccagaggcctttgttgatgccatattttcatgatttgtgcaataag

SEQ ID NO: 5601 - DNA, 1806 bp, Gossypium raimondii
tagaccgttgcatccaaacgacgtcgttgggagaatgctatccactccaagtccttcccttcatctcacacaattcagtttaccgagagccatagaaatggcttcttctactcagttctccctcactttcaaaccctcaccgtcaccgctcttttccaacttccctcgaacccggttcggtcctttcacaaccgctaggccaatcgcttcccgtttcaaagtcctggctagtcagaccgggttcttcactcggctcggccggttgatcaaggaaaaggccaagagtgacgtcgaaaagatcttctcaggtttctccaaaaccagagacaacctcgccgtcatcgacgaactcttattatactggaacctcgccgacaccgatcgcgtcctcgatgaacttgaagaggctttgttggtatccgattttgggccaagaattactattaaaatagtggaacgcttgcgggaggatattctaaatggaaaacttaaatcaggaagtgaaataaaggatgcattgaagaaaagtgtgttggatctcttaacaacgaaggggagtaacaccgagcttcgacttggattcaggaagccagccgtgatcatgattgttggcgttaatggaggtggcaagacaacatcacttggaaagctggcttatagactaaagaatgaaggggcaaaaatattgatggcagcaggggacacattcagagcagctgctagtgatcaactagagatatgggctgagagaactggttgtgagatagttgtagctgaaaaagagaatgccaaagcatcatcagtgctttcgcaggctgtgaaaagaggtaaagagcaaggttttgatgttgtcttatgtgacacatctggacgccttcacaccaattacagcttgatggaagagttgatagcatgtaagaaggctgtcgaaaaagttgttcgtggtgcacctaatgagatactactagttcttgatgggaacaccggattgaatatgcttcctcaagctagagagttcaatgaggttgttggaataactggttttattttgacaaaacttgatggttctgctagaggtggctgtgtggtcagtgtggttgatgagctcggcattcccgtgaagtttgtcggtgttggtgaaggtgttgaagaccttcaaccttttgatgcggaggcatttgttaatgccatattttcgtgagaaatattgttggattgtaatcgtttgagaccagtttggccgatgtcaggcttctacaggcatattgttgtaagaactcagtcacaagagtactcgttcgccagcaaggattaaaaaggtggttctgatgtgtgaaaaagcttcagcaacagatgtgtgaaaaagcttcagcaacataatgatgatgcaaattttttggtctatacattattcctctctcctaatatttgagcattatgatcttgtcttcatcaatgagcaaattcattagttgataagtacaaaaccaaaagctcacgcttctaagaaagattagtaaatgaaaagtgctattcaaatagtttgtctctattccattttttaggataatgttgcatctgcttttatcaacctgtaatatgcataagtatgccacaaaagtgcagttaaccagaaactaatggaaaacccatttgatttaattaaccagattcaattttcggtcccctctttgttaagctctaaattaggcatattaaacagatcgtttagacttgataattttgtgtaacaatttgacacattaatctatattcctattggtctacattatatttgatcaagaa

SEQ ID NO: 5602 - DNA, 1764 bp, Citrus clementina
cctggaataacaattcgaggagtgagaaatggctatggcttcagctactcccacccgtctcccactgatctccaaacacacttccttctacttgaccaactgcctccctcagactcgattctctcattgcacggcgatacgaccagccacgaaccggttcaaatgctcagccggtgggcagaccgggttcttcacccgtctagggcggttgattaaagagaaagccaagagtgacgtggagaagatattttctggattctccaaaacccgagacaacctcgccgtcattgacgagctactactttactggaacctcgctgacacagacaaagtgctcgatgaactggaagaggctttgttagtgtctgattttgggccaagaatcactattaagattgtggagagtttacgagacgatatactagcagggaagctcaaatcaggacccgacattaaggatgcattgaagaatagtgtattggatttgctgactaagaaagggaacaagactgagcttcaacttggatacaggaaaccagctgtggtcttgattgttggtgtcaatggtggtggaaaaacaacatcactaggaaagctggcatatagattaaagaacgaaggggcaaagatactgatggcagcaggtgacacttttagagcagccgctagtgatcaactggaaatatgggcagagaggactggttgtgagattgttgtggctgaaggagagaaggccaaagcatcatcagttctttcacaggctgtgaaaagagggaaagaacagggttttgatattgttttgtgtgacacatctggacgtctccacacaaactacagcctgatggaagagttggttgcatgcaagaaagctgtgggcaaagttgttaacggtgcacctaatgagatcctactagttctggatgggactactggcttgaatatgcttccacaagcaagagaatttaatgatgttgtcggaataactggtttaattttgacaaagctggatggttctgctagaggtggctgtgtggtcagtgtcgtcgatgagcttggcattcctgtaaagtttgtgggtgttggtgaaggtgtggaggacctacaacccttcgatgcagaggcctttgttaatgccatattttcatgagaactgaaagtgattcattgttcaatcaaactattagttttttggcgaaataggatggctaaaggctgagcagttaactctattaaaaagtgcaagaccatttatgaggacatggatgcagcattaatgggattgcaagtatgagaagagtttatttataagaataaattcttaccagttagtgaatataggtgcatgcttgatgtagggcagtgtaactaaattgcttttctggatgatgtcgttacatgacagttggtagaatactagaatttctcctaaaaaatgagaaagatagaaaaaggaaaaaaagaaaaaagaaaaaaaaaagcaaggatttcaagtcaaatagtcaatcttcccctaaagaacaagtattaaagcatcatcaaataatgcagagaggaagagaaagcaaacgaaaagctcggaagtgaaagcaaagtccgcccatcaacattaattttttcataaaaatgatgaagtcgatatccattatgacaaactcgggggatttggcctctccaaaaagtaaaagtaaaagttaaaaaaaaaaaaaaactctggagagttggttgtttattttagtttaaataatggacccaaatgtttttttt

SEQ ID NO: 5603 - DNA, 1767 bp, Citrus sinensis
cctggaataacaattcgaggagtgagaaatggctatggcttcagctactcccacccgtctcccactgatctccaaacacacttccttctacttgaccaactgcctccctcagactcgattctctcattgcacggcgatacgaccagccacgaaccggttcaaatgctcagccggtgggcagaccgggttcttcacccgtctagggcggttgattaaagagaaagccaagagtgacgtggagaagatattttctggattctccaaaacccgagacaacctcgccgtcattgacgagctactactttactggaacctcgctgacacagacaaagtgctcgatgaactggaagaggctttgttagtgtctgattttgggccaagaatcactattaagattgtggagagtttacgagacgatatactagcagggaagctcaaatcaggacccgacattaaggatgcattgaagaatagtgtattggatttgctgactaagaaagggaacaagactgagcttcaacttggatacaggaaaccagctgtggtcttgattgttggtgtcaatggtggtggaaaaacaacatcactaggaaagctggcatatagattaaagaacgaaggggcaaagatactgatggcagcaggtgacacttttagagcagccgctagtgatcaactggaaatatgggcagagaggactggttgtgagattgttgtggctgaaggagagaaggccaaagcatcatcagttctttcacaggctgtgaaaagagggaaagaacagggttttgatattgttttgtgtgacacatctggacgtctccacacaaactacagcctgatggaagagttggttgcatgcaagaaagctgtgggcaaagttgttaacggtgcacctaatgagatcctactagttctggatgggactactggcttgaatatgcttccacaagcaagagaatttaatgatgttgtcggaataactggtttaattttgacaaagctggatggttctgctagaggtggctgtgtggtcagtgtcgtcgatgagcttggcattcctgtaaagtttgtgggtgttggtgaaggtgtggaggacctacaacccttcgatgcagaggcctttgttaatgccatattttcatgagaactgaaagtgattcattgttcaatcaaactattagttttttggcgaaataggatggctaaaggctgagcagttaactctattaaaaagtgcaagaccatttatgaggacatggatgcagcattaatgggattgcaagtatgagaagagtttatttataagaataaattcttaccagttagtgaatataggtgcatgcttgatgtagggcagtgtaactaaattgcttttctggatgatgtcgttacatgacagttggtagaatgctagaatttctcctcaaaaaatgagaaagatagaaaaaggaaaaaaagaaaaaagaaaaaaaaaagcaaggatttcaagtcaaatagtcaatcttcccctaaagaacaagtattaaagcatcatcaaataatgcagagaggaagagaaagcaaacgaaaagctcggaagtgaaagcaaagtccgcccatcaacattaattttttcataaaaatgatgaagtccatatccattatgacaaactctggggatttggcttctccaaaaagtaaaagtaaaagtaaaagttaaaaaaaaaaactctggagagttggttgtttattttagtttaaataaaggacccaaatgtttttttt

SEQ ID NO: 5604 - DNA, 1624 bp, Gossypium hirsutum
accgagagccatagaaatggcttcttctactcagttctccctcactttcaaaccctcaccgtcaccgctcttttccaacttccctcgaacccggttcggtcctttcacaaccgctaggccaatcgcttcccgtttcaaagtcctggctagtcagaccgggttcttcactcggctcggccagttgatcaaggaaaaggccaagagtgacgtcgaaaagatcttctcaggtttctccaaaaccagagacaacctcgccgtcatcgacgaactcttattatactggaacctcgccgacaccgatcgcgtcctcgatgaacttgaagaggctttgttggtatccgattttgggccaagaattactattaaaatagtggaacgcttgcgggaggatattctaaatggaaaacttaaatcaggaagtgaaataaaggatgcattgaagaaaagtgtgttggatctcttaacaacgaaggggagtaacaccgagcttcgacttggattcaggaagccagccgtgatcatgattgttggcgttaatggaggtggcaagacaacatcacttggaaagctggcttatagactaaagaatgaaggggcaaaaatattgatggcagcaggggacacattcagagcagctgctagtgatcaactagagatatgggctgagagaactggttgtgagatagttgtagctgaaaaagagaatgccaaagcatcatcagtgctttcgcaggctgtgaaaagaggtaaagagcaaggttttgatgttgtcttatgtgacacatctggacgccttcacaccaattacagcttgatggaagagttgatagcatgtaagaaggctgtcgaaaaagttgttcgtggtgcacctaatgagatactactagttcttgatgggaacaccggattgaatatgcttcctcaagctagagagttcaatgaggttgttggaataactggttttattttgacaaaacttgatggttctgctagaggtggctgtgtggtcagtgtggttgatgagctcggcattcccgtgaagtttgtcggtgttggtgaaggtgttgaagaccttcaaccttttgatgcggaggcatttgttaatgccatattttcgtgagaaatattgttggattgtaatcgtttgagaccagtttggccgatgtcaggctactacaggcatattgttgtaagaactcagtcacaagagtactcgttcgccagcaaggattaaaaaggtggttctgatgtgtgaaaaagcttcagcaagataatgatgatgcaaatttttgggtctatacattattcctctgtcctaatatttgagcattatgatcttgtcttcatcaatgagcaaattcattagttgataagtacaaaaccaaaagctcacgcttctaagaaagttagattagtaaatgaaatgtgctattcaaatagtttgtctctattccattttttaggataatgttgcatctgcttttatcaacctgtaacatgcataagtatgccacaaaagtgcagttaaccagaaactaatggaaaacccatttgatttaattaaccagattcaattttagtcccctctttgttaagctctaaattaggcatattacctgcgcgg

SEQ ID NO: 5605 - DNA, 1667 bp, Vitis vinifera
tcgaaacgacgtcgttgaaaggaatattatctactgccatgtctctcgcacagtgggagcagtgagcaccgaaatggcttctccctcccccttcgttcgctcactctcagcttctccaacgccaccctccctcttcgccttcaacctcccccgaacccggttcgcccccaagcccccctccgcaccccgcttcacgtgccaagcaggccagaccgggttcttcacccggctcggccgcctcatcaaggaaaagaccaagagcgacgtcgagaaactcttctccggcttctccaaaacccgagacaacctcgccgtcatcgacgagctcctcctttactggaacctcgccgacaccgatcgagtcctcgatgagctcgaagaggctcttctggtgtctgattttgggcctcgaatcacgattaagatcgtggagagcttgcgagacgatatattagcggggaagctcaaatcaggaagcgaaatcaaggatgctttaaagaagagtgtgctggatttgttaactaagaaagggagtaaaacagcgcttcaacttggattcaggaaaccagctgtagtgattattgttggtgtcaatggtggtggcaagactacatctcttggaaagctggcctataagttgaagaaagaaggggctaaggtattaatggcagcaggagacacatttagagcagctgctagcgatcagttggagatatgggctgagaggactggttgtgagattgttgtagctgaaggagagaaggccaaagcatcatcagttctttcacaggccgtaaagagagggaaagaacaaggttttgacatcgttctgtgtgatacatctggacgtcttcacactaattacagcctgatggaagagttgattgcatgtaagaaagctgtgggcaaagtcgtttctggtgcacccaatgagatactgctagttctggatgggaccactggtttgaacatgcttccacaagcaagagagttcaacgaggttgttgggataagtggtttgattttgacaaagcttgatggttctgccagaggtggctgtgtggtcagtgtggttgatgagcttggcatccctgtaaagtttgtaggtgtaggtgaaggtgttgaagacctacagccttttgatgctgaggtctttgttaatgccatattttcatgagacctgtgaaagatgggctgtcccctttcgaaaccaccggcgatttttagcacaaaaccgcaaggcaaaatggtgaaagctagtagctggaacaaattgaaactgcagagaagcaaaggggaggaaaaaaaaaaaaaatcctagatcccggcatctgattgtttttgcttccaacttgtgaaatggcattggcctgcagagtagctacttccattcaaccgaaacatgaattttattcccacttgcacttgctagagatagtaggggtgaattcaattataatatcttccctcgttgatcaaagtgtttatccttgcctttctgtaaagaaatccaagaatcttccatctgacgaacattatatgtattaaatagatctactcattccatttaagaattttggtttagttggttctgttctgttacattcaatctctattgcaaccagcccacatggggagttcctcagtacagagattggagctctaat

SEQ ID NO: 5606 - DNA, 1138 bp, Fagus grandifolia
aatgagaatggctgcttctcctgctcacctctcgctcctctccaaaccttcaccaacaacttcctcaccacacctcctcttaaacctccctaacacccgctccaccactcctttccatcatacccgacccgccaactcccggttcaaatgctcggccgggcagaccgggttcttcactcggctcgggcgcttgatcaaagagaaggcgaagagtgacgtggagaagatcttctcgggcttctacaaaacccgcgacaatctcgccgtcatcgacgagctactcctctactggaacctcgctgataccgataaagtcctcgacgaactcgaagaggctctactggtgtctgattttggaccaaggatcaccattaagattgtggataggttgcgagaagatatattggcagggaagcttaagtcagggagtgagattaaggaagcattgaagaatagtgtgttggaattgataactacgaggggtagtaaaccgagcttcaactcggattcaggaaaccagctgtggttatgattgttggtgtcaatggaggtggcaagacaacatcacttggaaaactggcctatcgactgaaaacgaaggggctaagatattgatggcagcaggcgatacttttagagcagctgctagtgatcagctggagatatgggctgagaggactgggtgcgagattgttgtggctgaaaaagataaggccaaagcatcagcagttctttcacaggctgtgaaaagagggaaagaacaaggttttgatgtagttttatgtgacacatctggacgtctccacactaattacagcttgatggaagagttgattgcatgtaaaaaagctgtggggaaagttgttcaagtgcaccaaatgagatcctgctagttttggatgggacaactggtttgaatatgctaccacaagcaagagagttcaatgaagtcgttggaattactggtttgattttgacgaaacttgatggttctgccagaggtggctgtgtggtcagtgtggttgatgagcttggcatcccagtaaagtttgtgggtgttggagaaggtgttgaagaccttcaaccctttgatgcggaggcctttgttaatgccatattttcataaagccaaaaagtg

SEQ ID NO: 5607 - DNA, 1431 bp, Vinca minor
gccagcgccggcgaccaccactatctttagcccatcccctttattccacaggagtccaagccgccggttcaaatgctcggccggacagggaacggggttcttcacaaaactaggccggttaatcaaagaaaaagccaagagtgatgtggagaaaatcttctctggattcactaaaactcgagataatttagctgttattgatgaactcttgctttattggaatctttccgacactgaccgcgttcttgatgaacttgaggaggtattgctggtatctgattttgggccaaggattacgataaagattgtggagagtcttcgggatgacatatatggagggaagctcaaatcaggaagtgagataaaagatgctttgaagaggagtatcttgaacttattaactagcaaggcaccaaaaacagagctcaaacttggatttaggaaaccagctgtgatcatgattgttggtgtgaatggtggtggaaagacgacatcccttggcaagctggcctacagattgaagaaagaaggggccaagatattgatggcagcaggtgatacatttagggcagctgcgagtgatcaattagagatttgggctgaaaggacaggttgcgagattgtcatggcagaaaaagataaagccaaagcatcttcagttctctcacaggctgtgaagcgagggaaggaagagggttacgatattgttttgtgcgacacatccgggcgtctccacactaattatagcctaatggaagaattggtagcatgcaagaaagtagtcggtaaaattatacccggtgcacccaatgaaatcctactcgtattggacgggacaactggcttaaatatgctcccacaagcgagagaattcaatgaggttgttggtgtaactggtctgatactgacaaaactagatggttcggctagaggtggatgtgtggtcagtgttgtcgatgagctcggcatccctgtaaagtttgtcggtgtgggtgaaggggtagaagacctacaaccttttgatgccgaggcatttgtcaatgcaatatttccttgaggctttatagatgcagtgtttcagggtacttgtggctaaattagctcataagttctctatgaagaatgaactccatccttttcgtcaagacatgacgctacctttctgggggtctctgtagaacaatcatctttttcgtcaagacaggacgcaaagtgatactaaggatgaaggtcagtttggtatttcatgatcagcaaaggtgaccaaagtagccatgttgcaacaacaaagtactcgttgtacacgaatttcgtatatgcatgtgtttcatattattgattagttagggaaatgtaccactctgaatacagataaagaagagacgaggactttgtagatagcaccatgcaggatgattgtaggtattggta

SEQ ID NO: 5608 - DNA, 1730 bp, Amsonia hubrichtii
aaacccctcaaattagctatcattttggaggaacaatggcactcaatctccggcaaaagcaaaccgaatgcatagttcgaatgttgaatctgaatcaaccgctgaaccctagcggtgggggaactgacaaaatagaaggaaggtttaacaaaagaatacttagaatactaacgaatacgacttactagaccaaagacattctctctccattgatccacgccttgcctccacgcctctctccgttctcttcccagcgtctgctttacagccaccttctgcaaccacaattttcagcctgtcaaccgccaccaggtcccctttgtttcaaactgataaaagccttttcaaatgctcagccggacagaccggattcttcacaaaactaggccgcttaatcaaagaaaaagccaagagtgatgtggagaaaatcttctctggcttcactaaaacccgagacaatttggctgtcgtcgatgaactcctgctctactggaacctttctgacactgaccgcgttcttgatgaactcgaggaggcattactggtgtctgatttcgggccaaggattacgataaagattgtggagagtttgcgggatgacatatatggagggaaactcaaatccggaagtgagataaaagatgctctaaagaggacgatcttgaacttattaactagcaaggcacccaaaacagagctaaaacttggattcaggaaaccagctgtgatcatgattgttggtgtgaatggtggtgggaagacgacatctcttggcaagctggccaatagactgaagaaagaaggggccaagatattgatggcagcaggtgatacatttagagcagctgcgagtgatcaattggagatttgggctgaaaggacaggttgtgagattgttgtggctgaaaaggagaaggctaaagcatcttcagtcctttcacaggctgtgaaacgagggaaggaagagggttacgatattgttttatgtgacacatctgggcgtctccacactaattatagcttgatggaagaattggtggcatgcaagaaaacagtcagtaaaattatacctggtgcacccaatgaaatccttcttgtattggatgggacaactggtctaaacatgctcccacaagcaagagagttcaatgaggttgttggagtaacaggtttgatactgacaaaactagatggttctgctagaggtggctgtgtggtcagtgttgtcgatgagcttggcatccctgtaaagttcgttggtgtgggtgaaggggcagaagatctacagccttttgatgctgaggcatttgtcaatgcaatatttccttgaggcattacaaggtactttgtggctaagttaccttggaagttccatatgaagaatgaattccatcattttctctcaagacagagatctatctttatggagtctgtagatgggaaaactgatttcttatgggcaaggagataagaatgaaggtcaatctggtatggcaggatcagtcaaggtggcagaagtagctttgtgggactaagtttgcttcttttgtacacaaatttcatattttgatctactttatattattgattagttaggaaaatgtaccacccgaacacggttgtagatagagcgacatggcagcatagtcatattggtattggttgtattgtttccaagatattctgtaataaattttctaacaaagaaaaccaggataattccatatgga

SEQ ID NO: 5609 - DNA, 1508 bp, Cirsium arvense
atccacacacaagtttatgacttggttttcttttcacaaacctgaaaaagaaaaaatggtttcttcaatttctcatggttggtcacctgcgttacgaaattccatttctacccctggttcgaccaccgtcttcaaccacctctctccaccgctgctcctccgtgtccaatctccgaccaccggtggtggtggcggaactcagttctctaagttcagatgctccgccgcgggttccgaaaccggattcttcacgaaattgggacggttgatcaaagagaaggcgaagaaggatgtggagaagatattttctggtgggttttcgaaaacaagagataatttggctgtgattgatgagttactcctttattggaatctctctgataccgatcgggttctcgatgaactagaagaggcattgttggtgtcagattttggcccaaagatcacaataaagatcgtggagagcttgcgggatgatatatatgccggaaaactcaaatcaggaaatgaaataaaggatgctttgaagaatagtgtgttggatctcttaacgaaaaaaggttctaaaacggagcttagacttggatacaggaaaccagcagtaatcatgatcgttggtgttaatggaggtggaaaaactacatctcttgggaaactggctcatcggttgaagggtgaaggtgctacggtattaatggcggctggtgatacatttagggctgccgcaagtgaccaactggaaatttgggctgaacggaccggttgcgagattgtttcagctgaaaaagagaaggccaaagcatcatcagttctatcacaggccgttaagaaagggaaagaacaaggtgttgatatcgtgctatgcgacacttctggacgtttacatactaactatagcttaatggaagaactgattgcatgtaaaaaggcagttgctaaagttgttcctggtgcccctaatgaaattttgcttgttttggatggaacaacgggtttgaatatgcttccacaagctcgggaattcaatgaggttgtaggaataaccggtttcatcttgacaaaactcgatggctctgcaagaggcggctgtgtggttagcgtagtcgatgagcttggaattccagtaaaatttgtaggtgttggtgaaggggtggaagatctccagccgttcgacgctgaagcttttgtgaatgccattttcccatgagacatcaagaaaaggtgcaatatcatcgactaaaatccataaatggagcgatatcaatgtcttaatactcgagaaaaggggatgaatataaaaaggagttttccatctggcactgaagcacgaacaagattacgcatgataagatttgtggtggtcgtaatagtggtttggagcaatgagtcctcaatgattgaatttttgtacaagaaagtggttaatgtaaagataatttaaaaactacgattcgtagggatgaacatatgccatttaattactctcagtattcttgctcattacgatc

SEQ ID NO: 5610 - DNA, 1494 bp, Populus trichocarpa
aagaaatggcaactctagctcatctctctctcctctcaaaaccaccaccacaactcaataacctcttctccaccatccctagaacccggctcaacccacaatccaaacccacccggttcaaatgcttagccagccaaaccgggttctttactaaactaggtcgtttaataaaagagaaagccaaaagtgatgttgaaaaaatcttctcaggtttctccaaaaccagagacaaccttgctgtcattgatgagctcttactgtactggaacctctctgaaaccgaccgtgtcctcgacgaactcgaagaggctttgttggtgtctgattttgggccaagaattaccattcagattgtggagaaattgagggaggatatattagcagggaagcttaaatcagggagtgaaataaaggatgcactgaagaagagtgtgctggatttgttacagaagaaagggaataaaactgagcttcaacttggattcaggaaaccggctgttgttatgatagttggtgttaatggtggtgggaagacgacatctcttggaaagctagcatatagattgaagaatgaaggggcaaagatactgatggcagcaggggatacatttagggcagctgccagtgatcagttggagatatgggctgaaagaactgggtgtgagattgttgtggctgacagagaaaaggccaaagcatcatcagttctttctcaggctgtaaagaaagggaaagaacaagaatttgatgttgttttgtgtgacacatctggacgtctccacactaattacagcctcatggaagagttgatcgcatgtaagaaagctgtaggcaaaatagttcgtggtgcacctaatgagatcttactagtgttggatgggactactggtttgaatatgcttccacaagcaagagagttcaatgaagttgttggaataactggtttcattttgacaaaactcgatggttctgctagaggtggctgtgtggtcagtgttgttgatgagcttggcatccctgtaaagtttgtgggtgttggagaaggtgtagaagacctccaaccctttgatgccgaggcttttgttaatgccatattttcatgaggcaaggtgattaattttcaaagttgctgaaaattcttggctacttagcaagagcagagcactgggttttcttaatggggcccttgacaatggttgcattgaacaaagaggctgcagctacatgccaatttatatgtttgaaacctgcatactagttagtggagttgaactactaggactctaggagtgaaaagtatctcatgtccacataatcaaaagttagcaattcggaacactagtcagaatgatacttgtggatttcaaggcaatgagaggtttttgagatggtaactaagtttttcttgatgtcattaaaccatcatgcaagaaatgagccaattctattcaattggatatatttttgtagcgagtttcggtaattggacccata

SEQ ID NO: 5611 - DNA, 1336 bp, Cirsium arvense
atcatctcaaatacaaaaatggtttcttcacttcctcatccgttgcgaaattaccattctacccctggctcaaccaccgtcttcaaccaccactctccgccgctcttcctccgcctccaatctggtactagtggtggcggaactcaagcttctaggttgagatgctcggcggcgggctctcaaaccggattcttcacgaaattgggacggttgatcaaggagaaggcgaagaaggacgtggagaagatattctctggtggattctcgaaaaccagagataatttggctgtgattgatgagttattgctgtattggaatctatctgatactgatcgagttctcgatgaattggaagaggcattattggtatcagattttggcccaaaaatcacaataaagatcgtggagagcttgcgggacgatatatatgctggaaagctcaaatcaggaaatgaaataaaggatgctttgaagagcagtgtgctggatctcttaacgaaaaaaggtgctaaaacggagcttaaacttggattcaggaaaccagcggtaatcatgatcgttggtgttaatggaggtggaaaaactacgtctcttgggaaactggcttatcggttgaagagtgaaggtgctacggtattaatggcggctggtgatacgttcagggcagctgcgagtgaccaactggaaatttgggctgaaaggactggttgcgagattgtttcagctgaaaaagaaaaggccaaagcatcatcagttctatcacaggccgttaagaaagggaaagaaggaggttatgatatcgtgctatgcgacacttctggacgtctacacactaattatagcttgatggaagagctgattgcatgcaaaaaggcggttgctaaagttgttgctggtgcccctaatgaaattttacttgttttggatggaacaacggggttgaatatgctcccacaagctagggaattcaacgaggttgtaggaataaccggtttcattttgactaaactcgatggctctgcaagaggcggctgtgtggttagcgtagtcgacgagcttggaattccagtgaagtttgtaggtgttggtgaaggggtcgaagatctccagcctttcgatgcagaggcttttgtgaatgccattttctcgtgagacatcaagaaaaaggtgcaacatcatcgactaaaatccctgaatggagcaataacaacgttgtagtactcgagagaaggggatgaatataaaaaaaggcatgttccatttggcacttcgctctgaagtgtgggaagattgcacatgataaggggtttggagtgatgagtcctcgatgatcgag

SEQ ID NO: 5612 - DNA, 1344 bp, Tripterygium wilfordii
tgcctccctcgaaccgcctggtcggtttcatgcagaacccgacgcttcaaatgctcggccagccaggctgggttcttcacgcggctgggccggttgataaaagagaaggccaagagtgacgtcgagaaaatcttctcgggcttctccaaaacccgcgacaacctcgccgtaatcgatgagctcctcctctactggaacctctccgacactgaccgcgtccttgatgagctcgaggaggctctattggtatctgatttcgggccaagaatcacaattaagattgtggagagcttgcgtgaagatatactaggagggaagctcaaatcaggtagcgagataaaggatgctttgaagcagattgtgttggatttgttaactaagaaaggaagcaagacagagcttcagctgggcttcagaaaaccggctgtgattatgattgttggcgtcaatggaggtggaaagacaacatctctgggaaagctggcttatagattgaagaatgaaggggcaaagatactgatggctgcaggcgatactttcagggctgctgctaccgatcagttggagatatgggctgaaaggaccagctgtgagattgttgtggctgaaagggagaatgccaaagcatcatctgttctttcacaggctgttaaaagaggaaaagaacaaggttttgatgttgttctgtgtgacacatctggacgtcttcacactaattacagcctgatggaagagttaatagcatgcaaaaaagctgttgcgaaaatcgttcctggcacacctaatgagatccttctagttctggatggcaacactggtctgaatatgctcccacaagctagagagttcaatgaagttgtcggtataactgggttcattttgacgaaactcgatggatctgcaagaggtggttgtgtggtcagtgtggttgatgagcttggtatacctgttaagtttgtgggtgttggtgaaggtgtagaagacctccagcccttcgacgctgaagcctttgttaacgctatattttcgtgaggtgacatgacctgaaacatctacactatcacacaatccatgatcctcaaaaagtgccctgctggtggggctgttaactggtccggtcatgactcacgacagttttcatatctggtttagcagttattcaaagttacaggcattgtgcaacagccaactaattcgatgattgtgtaataatttgttgatcccaaccagttgagtaaaatttcacccctccttttacaggtcccggtggtcatctgtaacctcattgtaatctgaattttgtgttgaacaaatttttttttatatattatgaatgtgtcttag

SEQ ID NO: 5613 - DNA, 1103 bp, Euphorbia esula
  misc_feature (789)..(789): n is a, c, g, or t
  misc_feature (1067)..(1067): n is a, c, g, or t
ggaaatggcggctactcgagctcatgtctctctcctctccaaaccatcacctccattgaaccagctctttgaaatccctcctcgaaccgggttcaatcctcggaaaagctccaaattcaaatgccagagcagcggcttctttaccaaacttgggagattgataaaagagaaggccaagagtgatgtcgacaaaatcttctccggtttctccaaaaccagagacaatctcgccgtcattgacgaacttctcctttattggaacctttctgataccgatcgagtccttgacgaacttgaagagattctcttagtttctgattttgggccaagaattacaattaagattgtggagagcttgcgggaagatatactatctgggaagctcaagtcgggcaatgaaatcaaggaatctttgaagaagagtgtgcttgaattgttgattaagaaggggaataagactgaacttcagcttggattcagaaagcctgctgttattatgatcgttggtgtcaatggaggtggaaagacaacttctcttggaaagctggcctatagattgaagaatgagggagcaaagatattgatggcagcaggtgacacgtttagggcagctgccagtgatcagttagagatatgggctgaacggacaggatgtgaaattgtcgtggctgaaaaagaaaaggccaaagcatcatcaggctgtgaaaagagggaaagagcaaggctatgatattgttttgtgtgacacatcaggacgtcttcacactaacttcagccttatggaagaantgatagcctgcaagaaagctgtcagcaaaattgttcctggagcacctaatgagatcctcctagtgctggacgggaatactggtttaaacatgcttccacaagcgagagaattcaatgaaatagttggaataactggttttgttttgacaaaactcgacggttctgctagaggtggctgtgtggtgagtgttgtagatgagcttggcatccctgtaaagtttgtgggtgttggagaaggtgttgaagatttgcaaccttttgatgctgaggcatttgtnaatgctatattctcatgatccctccctgcaaatgtg

SEQ ID NO: 5614 - DNA, 1095 bp, Prunus persica
atggcttcgcctttgccttcgtctctccatcggctctcactcctcttcaaaccttcatcacctcaaaaccaccgcctccttgtaaccccgacccgaactttctcggttcgaatgccgggcgggccagaccgggttcttcacccggctcggaaggcttatcaaggagaaggccaagagcgacgtagggaagctcttctcgggattctccaagactcgcgataatctcgctgtcatcgacgagctcttgctctactggaatctcgctgacactgatcgagtcctcgacgaactcgaagaggctctgctggtatcggattttggtccaaaaatcacaactaagattgtggaaagtttgagggaggacacagttgctgggaagctgaaatctggaagcgaaataaaggaagcattgaagaagagtgtgctggacttgttaactacaaaagggagcaaaactgaacttcaacttggatacaggaaaccagctgtggttatgattgttggcgttaatggaggtgggaagacaacatctcttgaaagctggcttacagattgaagaaggaaggggccaagatggcagcaggggatacatttcgagcagctgcctgtgaccagctggagatatgtgctgagaggatggggtgtgagattgttgtggctgaaaaagagaaggctaaagcagcatcagttatttctcaggctgtgaaaagagggaaagaacaaggttatgatattgtcttatgtgacacctctggacgtctgcacactaattacagcttgatggaagagttgattgcatgtaagaaagctgtgagcaaagtcattcctggcgctcctaatgagatcctacaagttctggatgggacgatgggtttaaacatgcttccgcaagcaagagaattcaatgagattgttgggataactggtttgatattgacaaaacttgatggctctgctagaggtggctgcgtggtcagtgtggtaaatgaacttggcatccctgtaaagtttgtgggtgttggtgaaggtgtagaagacctccaaccctttgatgcggaggcctttgttaatgccatattttcttaaccctgaagg

SEQ ID NO: 5615 - DNA, 1526 bp, Fragaria vesca
ctctcagcttcaaagctcaaacagcaaatggcttcgcctttgccttcatctctctctcacttctcactcctctccaaacccgccccgctcccacaccaaaaccaccgcctcctcctagccccgacccgacccggatcttccgggctccaatgccgcgccggaaccgggttcttcaaccgcctcggccgcctcatcaaggagaaggccaagagcgacgtcgagaagctcttctccggcttctccaagacccgcgacaacctcgccgtcatcgacgagctcctcctctactggaacctcgccgacaccgatcgagtcctcgacgagctcgaagaggctctgctggtatcggatttcgggccgaagatcaccatcaagattgtggagagcttgagggaggacattgtagctgggaagctcaagtctggaagtgaaattaaggaggcgttgaagaagaatgttctcgatttgttgactataaaagggaaaactgagcttcagcttggatacaggaaaccggctgtgattatgattgttggggttaatggaggtgggaagacaacatctcttggaaagctggcttatagattgaagaatgaaggggcaaaggtattgatggcagcaggggatacttttcgagctgctgccggtgaccagctggagatatgggctgagaggactggctgtgagatagttgtggcggaaaaagagaaggccaaagcagcaacagttatttctcaggctgtgaagagagggaaagaacaaggttatgatattgtcttatgtgacacctccggacgtctgcacactaattacagcttgatggaagagttgattgcatgtaagaaagctgtaggaaaagtcatgcctggttcccctaatgagatcctacaagttctggatgggaccactggtttaaacatgcttccccaagcaagagaattcaatgaaattgttgggataactggtttgattttgacaaaactcgatggttctgctagaggtggctgtgtggttagtgtggtaaatgagcttggcattcctgtaaagtttgtgggagttggtgaaagtgtagaagacctacaaccctttgatgcagaggcttttgtgaatgccatattttcatagtcctaggggtggtgtgtcgtagttccattcccaatggaagaggtagtgtaaaattagcagaagaaagaaatcagtgtaggctggaggcacaataagttacttaaaaatgcaccaggaaacaaagtgtaagacttgcagcatacttaatgtcctaggtgattactgctgtgcagggttgaggtgagagtataggttctatacgtttggagctcattgagatcatgatagcaaggggtcgacaatgacactacaattgatcatagggtgaactgaaaacgttattctttttggcaccaagatatccatcttgtccctctgaatgtaatatcagtaatttactgtatctttgtttctgacgcctaaagagttaatgtactttcagtcgggaaattggttctttt

SEQ ID NO: 5616 - DNA, 1687 bp, Ricinus communis
aggaactggaggagaaatggcgactccaactcagctctcacttctctccaaaccttcaactccgcacctattcgtaaagttgcctagaaccgggttcaatccaaagaaaaccggtcggttcaaatgtcaggccagtcagagcgggttctttactaaactaggaagactgataaaagagaaagcgaagagtgacgtggagaaaatcttctcaggattctcaaaaaccagagacaacctcgccgcgtttgatgaacttctcctttactggaacctttccgacaccgacaaaatcctagacgaactcgaagagattttgttggtgtctgattttggaccaagaatcactattaatatagtggagagcttgcggaaggacatactatctggaaagcttaaatcaggcagcgaaattaaggatgctttgaagaagagtgtgcttcaattgttaattaataaagggaataagactgatcttcagcttggattcaggaagccagctgttattatgatagttggtgtgaacggaggtgggaaaacaacatctctaggaaagctggcctatagattgaagaatgagggggcaaagatattgatggccgcgggtgatacatttagggcagctgccagtgatcagttggagatatgggctgaaaggaccggatgcgagattgttgttgctgaaaaggagaaggccaaggcatcatcagttctttcacaggctataaaaagagggaaagaacaaggctttgatgttgttctgtgtgacacatctggacgtcttcatactaactacagccttatggaagagttgatagcatgtaagaaagctataggcaaagttgttcctggtgctcctaatgagatccttttggtgctagatggcaacactggtttgaatatgcttcctcaagcaagagaattcaatgaagtggttggaataactggtttgattttgacaaaacttgatggttctgctagaggtggctgtgtggtcagtgttgtagatgagcttggcattcctgtaaagtttgtgggtgttggagaaggtgttgaagacctccaaccctttgacgctgaggcttttgtcaatgccatatttccgtgagatctcttatgcgagtaattagtcttgcgagttgctgaaaggtccttggtaaatggcaaaaggtaacagtgagagacactacttctctaatgagggccggaaccagcatggagtggctccaattgcacattagttatttagatcctgcttcaatgttctgccatttttgcctgacagagattactgcagttggaaaatagatcttccttcttcacttgaatcaaagggctattcaaatgttatctcggttaaaatcatactatttgaatgtaagtcaatgttgtgtttaaaagtgctgactgataaaaccatttcgattttaaaatgcttgaatattgaattgtaggaatcgaggaacattagcgattttgcacatatttgcttgagactcctgaaattcaaatctgagtaagggttccccttttctccacgcctcggcgggcaacacattaaccaaagggcaaattcagcccaaaagattgatgtaatatcaaccttatttccttttttaatttttcaaaggatatcctcttcataatcatgaaccaagttttacaaaaacacagcgcgtaaacaactaag

SEQ ID NO: 5617 - DNA, 1500 bp, Tabernaemontana elegans
aatacggcgtcgttcccgatcattttatccgcttcggctctttggcacttccgctgcagagctaagcaaaagcaatggctactttgtctcctcgcctctctccgctctcctcccaacgtcagattttacagccaccgcctgcaagtactatttttagcctgtcaaccgccaccaggtttcccttatcccaatcaaaccaaagccgcttcaaatgctcagccggacagacgggtttcttcacaaagttaggccggttaatcaaagaaaaagccaaaagtgatgtggagaaaatcttctctggcttcactaaaacccgtgacaatttggctgtcattgacgaactcctgctttactggaatctttctgacactgatcgcgttcttgatgaacttgaggaggcattactggtgtccgattttgggccaaggattacgataaagattgtcgagagtctgcgggatgacatatatggagggaaactcaaatcaggaagtgagataaaagatgctttaaaggggagtatcttggacttattaactagcaaggcactgaaaacagagctgcaacttgggtttaggaaaccagctgtgatcatggttgttggtgtgaatggtggtgggaagacaacttctcttggcaagctggccaatagactgaagaaagaaggagccaaggtattgatggcagcaggtgatacatttagagcagctgcgagtgatcaattggagatttgggctgaaaggactggttgtgagattgttgtggctgaaaaagagggggccaaagcatcttcagttctttcacaggctgtgaaacgagggaaggaagagggttatgatattgttttgtgtgacacatctggacgtctccacactaattatagcttaatggaagaattggtggcgtgcaagaaaacagtcagtaaaattctacctggtggccctagtgaaatccttctcgtattggatgggacaactggcttaaacatgctcccgcaagcaagagagttcaatgaggttgttggagtaacaggtttgatactgacaaaattagatggttctgctagaggtggctgtgtggtcagtgtagttgatgagcttggcatccctgtaaaatttgttggtgtgggtgaagggacagaagacctacaaccttttgacgctgaggcatttgtcaatgcaatatttccttgaggcattatacggtactttggctaaatcacctcagcagtcttatatgaagaatgaactccatacgtttttcttaacagatgaagctatttttgtggagcctgtacatgataaaacaagtctcttgtcggcaaggagataagaagtgaaggcttgtatggtgttgcaaggagtattcaaagaagtagctttctgcaacgaagtattttttatgcttcttttgaatattgatgtgctttatatcattcagttagttagggaaatgtaccactccaaacactgtaaaagaaaactaagggtagatagctca

SEQ ID NO: 5618 - DNA, 1314 bp, Cleome spinosa
agggccgtggccatggcatcttcagctcacctctcgtttctcgccgggcgttcggcccttatctccggagacggcgtcaggttctccccaaaccggcccgcatggtcccgtctccgttgctccgccggtcagagcgggttcttcacgcgtctgggtcgcttgataaaggagaaggccaagagcgacgtcgagaaggttttctccggattctccaagaccagagacaatctcgctgtaatcgacgagctcttgctctactggaatctcgccgacaccgaccgagttctcgatgagctcgaagaggcgctgttggtgtctgatttcggaccgaagattacgattagaattgtcgagaagctgcgggatggtataatgtctgggaaactcaagtcaggaagcgaaataaaggatgcattgaagaacagtgttctggagatactgtccaagaaaagcaacaagacagagcttcaattgggtttcaggaaaccggctgttatcatgattgttggtgttaatggaggtgggaagacgacatctcttggaaagctggctcatagattgaagaacgaaggaaccaaggtattaatggcagcaggtgatacatttagagccgctgcaagtgatcagctagagatatgggcagagaggacagggtgcgagattgtcgtggccgaaggagagaaggccaaagcgtcttcagttctctcacaggctgtgaaaagagggaaggaggaaggttttgatgttgttctgtgtgacacttctggacgtctgcatactaatttcagcttgatggaagaactgattgcatgcaagaaagcagtgggaaaggtcgtctctggtgcaccaaatgagatcttgcttgtccttgacgggaacactggcttgaacatgcttccacaagctagagaattcaacgaggttgttggaataaccggcttgatcttgacaaaactggatggatcagccagaggaggctgtgtggtcagcgtggttgatgaattgggcattcccgtaaagtttatcggagtaggggaaggtgtagaagacctccaaccctttgatgctgaggcctttgtcaacgctatattctcctaaggcctaaaccctagttttccgactgcttctcaagggccattctcttctacaaaggcaaacatgcattcccacccgagcaaagcagctgcagtttcactagattgcttcattcggtgcaaatatctcggtatgcatacttgtgctgggagtgcagtccatgtgcatttagacacaagtcattgatcaaaaaggagatgtaactaacaagttgagcaa

SEQ ID NO: 5619 - DNA, 1503 bp, Manihot esculenta
gtgttcagagctgagacatggctgcttcagctcatctcttgctcctcgcgaaaccttctactccacatctagtccctgcgttccctcgaacaggttccaatcagcacaagaacgctcggttcaaatgcctggccagccagagcgggttcttcacgcgacttggcagattgataaaagagaaagccaaaagcgacgtggacaaactcttctcaggattctccaaaaccagagacaacctagccgtgattgacgaactcctcctctactggaacctatccgagaccgaccgagtcctcgacgaactcgaagagattctgttagtatctgattttgggccaagaatcacgattaagattgtggagagcttgagggaggatatactagctgggaagctcaaatcaggcagcgaaattaaggatgctttgaagaggagtgtacttgatttgttaaccaagaaaggaaataagactgatcttcagcttggattcaggaagcccgctgttgttttgattgttggcgtcaatggaggtgggaagacaacgtctcttggaaagctggcatataggttgaagaatgacggggcaaagatattaatggcagcgggtgatacatttagggctgctgccagtgaccagttggagatatgggctgaaagaactggatgtgatattgttgtggctaaagaggagaaggccaaagcatcatcagttctttcacaggctgtgaaaagagggaaagaagaaggctttgatgttgttttgtgtgacacatcaggacgtcttcacacgaactacggcctgatggaagagttgatagcgtgtaagaaagctgttggcaaagttgttcctggtgcacctaatgagatccttctggtgctagatgggaacactggtttaaatatgcttccacaagcgagagagttcaatgaagtggttggaataactggtttgattttgactaaacttgatggttctgcaagaggtggctgtgtggtcagtgttgtagatgagctcggcatccctgtaaagtttgtaggtgttggagaaggtgttgaagacctgcaaccctttgatgcagaggcgtttgttaacgctgtattttcatgaggtttaaattgtggcagaatacatgactatgaatcagagcaattagtcttgctagttgctgaaagttcttggctacacgatcctgcacgactatgagatgtggaagcttaaaaggcactttgtcatgaggccgacaactggcgttgcactttggtttcagttgcatgttagatgctgtttagatcccatacgccactcttatcccattttcacccgacagattacgcccttaaacttgtaaacaaatgttccttcttcactgtaatagaaagttctttcagatttgatcctgaaatgatactcctgaaatttcggattatggcatgcttatgaaactgagcttttaacttgtatttgagctattgtaagaaattcttataattagatgctattactc

SEQ ID NO: 5620 - DNA, 1853 bp, Eucalyptus grandis
gaacacggagctccgggagtgagaagaaccgagactgagaagagaaccatccatggcttcgccttctccgtcgagtcatcatctctctctcctcgccaagccttcgccgccgccgccgccgccccagccacttggcctccgcttccgattccctccgaaccggaccgccgcgccctcgatctctcggccggccggttccaggttcaagtgctcggccagccagacgggcttcttcaatcggctcggccggttgatcaaggagaaggcgaagagcgacgtggagaagatattctccggattctcgaagaccagagagaacctcgcggtcatcgatgagctcctcctttactggaacctcgccgataccgatcgcgtcctcgatgaactcgaagaggctctgctagtggccgactttggtccgagaattacggttaggattgtggatagattgcgcgaggatatattggcaggaaagcttaaatcgggagctgagataaaggacacattgaagaagagtgtgttggagttgttaaccacaaaggggagcaaaaccgaactccaacttggtttcaggaaaccggctgtggtgatgattgttggtgttaatggaggcgggaaaacaacttctcttggaaagctggctaatagactaaagagagaaggagcaaaggtactattggcagcaggtgacaccttcagagcagctgctagcgatcagcttgaaatttgggctgagaggactggttgtgagattgtattggctgaaggagagaagcctaaagcatcatcagtgctctcgcgggctgtgaaaagagggaaagaacaaggatttgatgttgtcttatgtgacacctccggacgtcttcacactaactacagcttgatggaggagctggtcgcatgtaagaaagctgttgccaaagtggttcctggcgcaccaaatgaaattttattggttctggatgggacgacagggttgaatatgcttccacaggcgagagaattcaatgatgtggttggcgtgacaggttatattttgacaaaacttgatgggtctgcaagaggtggctgtgtggtcagtgtggttgatgagctgggcatccctgtaaagtttgtgggtgttggtgaaggagttgaagatctccaaccctttgatgcggaggcttttgttgatgcaatatttgcatgaggtcttaaagttgctagccttctcgtcttttatcgttagaacctgttgaagctcaagttgtttcctttcctcgtgctcactactacagcaaactccagatggttcgagctgagcagggggacttatatcaatttctctggccaaacaaggaaatgcaactgagattttactgatataatgtgaaaagacttccttccctggggtttcatgaattgcctctggcaagtgatacgcgttgaagaccagagtctcgctgatggagctggaaaggtgaataacggtttacaaagaatgaatcattgctttccctcgcatttttgtaaatttcttaaaacatctattattggttcgtgaattcatcatcggcacatagctaatttctctgccactcccctatatctgggacaatccattttgactcgtttttgtagtttttgtattgtcatattacctcctcttaccgaagcaaagctatttctggccctctatatatagaacatggatcatagatatatgtaatcagcgatttcttacttgaggaggggtactagtgtttcatttaagatggaagatgagaatccttctgatttgtgctatttattcgatcattaacttaggaaagcagtcaagtttgattcaatgtaattatttaccgaacttgttt

SEQ ID NO: 5621 - DNA, 1998 bp, Aristolochia fimbriata
ttgatgggaaaaaaaggacacttccaagtgatatttcaacttttgggggcttttattgcaaaaacccgaaaaaggtgagaccggttattttcgtaattccacgtcttttcccttgccgggaactggaaagaagatgatgaggctactgtctactgaaaactgcgcagagctacgcggctacgccaactctcaaaatcctcaccaggtcaccaaatttccatggcttctcccgtgtcctttctgtcgccgtctcccgccgtcacttctccccccaaacactcctttgaaaccgtctcgcgagctctcatccggtcacaagtgccgactccggctcgaattggctctgcccgcttcagatgctccgccggtcagacaggtttcttcactcgtcttggccgtttgataaaggagaaagcgaaaagtgacgtggagaagctcttttcgggcttctccaaaacaagggacaatctcgccgtcatcgacgagctcttcctatactggaatttggctgagacggatcgtgtccttgacgagcttgaagaggtgttactagtgtctgattttgggccgaagatttcgatcaagatcgtggagagcttgagaagtgacattttagctggaaaactgaagtcaggatctgaaattaaggacgctttgaagaaatgtgttctggatttattaactgccaaagctaagaagacagagctccaactaggcttcaggaagccggccgtgatcatgatagttggagttaatggaggagggaagacgacatccctcggaaaacttgcatataggttgaaaaatgaagaagtaaaggtattaatggctgcaggtgatacgtttcgggctgctgcaagtgaccaactggaaatatgggctgagaggaccgattctgagatagttgtgggagaaggagagaaggtgaaagcatcatcagttctttcacaggcagtaaagagaggtaaagaagaaggctttgatgtcgtcttgtgtgacacatctggacgtcttcacaccaactacagcctaatggaagaattgattgcctgcaaaaaggcagtggctaaagttatttctggtgcacctaatgaaatccttcttgttttggatggtacaacagggctgaacatgcttccacaggctagagaatttaatgaggtggttggaataactggtttaatcctgacaaaacttgatggctcagctcgtggtggttgtgtggtgagtgtagtggatgaactaggcatccctgttaaatttgtgggcattggggaaggggtgaatgacctccagccatttgatgcagaggcctttgtcaatgctatcttctcgtgacaaccttaaatgagtcaattatggtgaaattggttattctttcttcacctggttttcctctcctgctttctgaggttcgatggtgatgaattctagtggaagattttgtggttccactaataactgttgaactggtttgagcttggggaagaatagtgaccagttctagtgcagggatgctaagagctcaaagctgaacggttcaatagaaacttgggttgggttcaattcatattaatttttgtttgccacagtgatacggttgcagacatgtatgtagaaatcagagtcacctcaaaaggatgctttggatatctgccttatcttctggagtgatgacaccaggtgccttcttgtaggcaccctagcgacaatggacaaagatgattgtttcttctttaatgatgcaaacaatctagaaattgtagaaaacacttcaatctcactaggcaacagcttctaatatcaatgaatggttaatccccatgcttattccgagctttttacggtaaaacatgagagatgggaagacaattggttcaacagagttggtgacaagtctgccaacaacttcatgatgccacaatgttttggtagaaatacctgtaaaagaaaaacgaagcattgtcagtgattttccttgtgaaaaattagtgaaag

SEQ ID NO: 5622 - DNA, 3237 bp, Cannabis sativa
attgctaaacgacatcgtttctcgatgcaaattctcgacgttatctggttactctaagctgtgaagttatcagtcagaggcgaagaaaatggctgtttcatgtccatcttctctctctcatatctcactctgctcaaattcacagtctgctcggctcctgctgacccgacccgataaatcccggttcaaatgcagtgctagccagaccgggttcttcacccggttgggtcgactgataaaggagaaagctaagaatgatgttgagaagattttctccggcttttccaagactcgggacaacctcgccgtcgtagacgagctcctcctatactggaaccttgccgacaccgacaaagtgctggacgaactcgaagaggctctgctggtatctgattttggaccaagaattacgataaaaattgtggaaagcttaagggagaacatactggccgggaagttgaaatcaggaagcgaaattaaggatgcattgaagaagtgtgtgctggacttgctgactaagaaggacagcaaaagtgaacttcagcttggattcaggaaaccggcagttgttatggttgttggtgttaatggaggtggcaagacaacatctcttgggaagttggctcatagattgaagaaagaaggggcaaaggtactgatggcagcaggggatacatttcgagcagctgctagtgatcagctggagatatgggccgagaggactggctgtgaaatagttgtggctgaaggagaaaaggccaaagcatcatcagttctttctcaggccgtgaagagagggaaactagaggattatgatattgtcttgtgtgacacctcaggacgtcttcacactaattacagtctcatggaagagttgatatcatgtaagaaagctgttggaaaagttctccctggggctcctaatgagattcttcaagttctggatggaacaactggtttaaacatgcttccacaagcaagagaattcaacgatgttgttggaattactggtttgatattaacaaaacttgatggttctgcaagaggtggctgtgtggtaagtgtagtagatgagcttggcataccagtgaagttcgttggtgttggtgaaggtgttgaagacctccaaccttttgatgcagaagcctttgttaatgctatatttccttaggccttaaaagtggttgttagtgcaacttatttgaagggtgtattctctcaacagaatagctaaagaaaacagtggaagctggaagttgaaaattgatatttcatagaagcatgattctacctgcgatattgttatgcttgcttgtaattacgaagcctgggactgttaagcaagtttttgttattgagagccttgtttcgctcattattgctgactaacttgatgttgccgagtgagttgcaagactatctccagatgatcaatgcgtttgctgttctgttataagtacatttcagttgccaagagctgtaccaagttttaaattgcaatcattttttctattgattttgtaatttattgtttgaactaattggagtaatgtcctttgatctagacttctgttttgctttgtaaaagcttgttgctggcatgttggattcacttaaaacaaattattgaaccacacttgtaccaaatgatctacatggattaatatcatcaagaaattgtaggggtataatatgtagtataaaaattgggaaaaagaattccaaattatgtgcaggcatcaatgaagataatgcattatatggttttcaacaatgagaatcatcacagggagaaatcttatacgacttacagacacatttgcttgttacataaacataagtacctaaattcctggacgaaggaatgtcataatttagaaacaggcatgttatagaaggtggcgcgagctgtatagaccagcttctgggttttcttcaatttaaaatcaattgatattacagtcaaattccttccacttctcaccacttgtgcattagcaattacctctgcctgtcaaatgtatgaaaatgcacagtatcaaaattttgagcgaggaaaaacaaaactaattgtataaaatcatcaagcatgtatatagtatatataatagatatgtcatgttgtatctgcagggcttaattaagtgcatttgaacagcaagacaatagcaccagttttgttgatgggaaaagaggaaaatgagcttatggcacacttgagaatgaaaccaagggaaagagtagataagatattccaatctccaagtgaacaatgaccaatatcacccataccctcaccatggcaaataatatgtctttataataataggtgagtaaatctaccattaatagctgcaaagtgcaaactcaattttgatcatgccctctttttttttctttctcttctttcaatctttattactaaaacatttaatacttaacaacaagaacaattgaacaagagcaactgcaggtattaagagacacttacatcgactggagcagcagagagataagacatgctctgttcaccaagaaaaaattccttatcgtcacctaaaaccgttttagcacaagctatggagatcgcctcggctacagctgcaagagctcctccatgaagcgatccatagaagttctgaaaaatcatcaataaagcaccattattgtttctccaatatccaacataacgttaaaaaaaaatcttctcgggaacaagcaagcaacaatttctctttcttcatataattcaaatcaaatcccaactaaaaagaaacatccaactcaattataaataaatgaataattacagcgacggcgggtttcacggtgaggaggcaggtgatgtgtccaggggaaacagtgaggggtttaagtacggcggtgataacgtcggaaaagaaacctttggtgttgcagtgatcgggaatgggttttgcggcgccgacgttggagagaaaaatcagaactcggtcaacgacttcgggagaaaggtccttggagatcaccgctgtgggagagagtaacgccttaatcaactcggaggagggcttcgccatttccgtccttagattgaaagaaacccaaccaaacccaacctaatctgatttaattttatctaaagggaagaagatcaaccttctcagtgctaacgtgcgcattatacttttacatatttaaccatttttttttttggagaccacataagcttctagggctgagcatcgatcggttttt

SEQ ID NO: 5623 - DNA, 1490 bp, Fagopyrum esculentum
aaagtcggtcgggatagagcgaaatcagagcagataaatggcagcttctatggcgctttatcttcatccacctccttcctccaacgcccaatccacaattactagtattactcacctccatcgctaccgccaccgccacctacctcctgcctgttccgccaggtttgcggcagacttcaaatgccgagccggtcagaccggattctttacgaagctcggccgtctcatcaaggagaaggccaagagcgatgtcgaaaagatcttttctggtttctccaagactcgcgacaacctcgctgtcgtcgacgagctcctcctttactggaatctcgctgatactgatcgcgttctcgacgaactggaagaggctctgctggtatcagactttggtccaaaaattaccatcaaaattgtggagagcttgagggcggatatattgtcagggaagctcaaatcaggacctgagataaaggaagctttaaagaaatctgtcctcgatttgttgactagcaaaggaaacaagacagaacttaaacttggattcagaaaaccagctgttatcatgattgttggtgttaatgggggtggaaaaactacgtcccttggaaaattggcatatagattgaagaatgatggagctaagatactaatggcagcaggagatacctttcgagctgctgcgggtgatcaactggagatatgggctgaacgaactggctgtgaaattgtgagggctgagaaggagaaggcaaaagcatcctcagtccttcaacaggcagtaaaaagaggaaaagaggaaggatatgacattgttctatgtgatacatctggccgtcttcatactaactacagtcttatggaagagttggttgcatgtaagaaagctttgagtaaagtagttgctggtgcacccaatgagattcttcttgttttggatggaacaactggtttgaatatgcttcctcaagcaagagagtttaatgatgttgttggaataactggttttatcttgacaaaactggatgggtctgctagaggtggttgtgtggttagtgtagtagatgagctgggaattcctgtcaagtttgtaggtgtgggtgaaggcgtggaagacctccaacccttcgaagctgaggcctttgtaaatgccatattttcttaaaagggaatcgacattgtgccttgttaaaagaaagcagatgaagtggtttccgatagctcaatgtttgcaagacactcgtgatccaaaagcacgcagatacgacattaaaaattaaggactggaaaatgtgaatattctagctggactttttgtgtagccaattgtaccgtctgtttttgttgggtagaatgtagagccaatgtaccaagtgcaggttttcttgtttaaagagaagctgagcctctctttaatcaactctcagtgttgcttctgtactataatcccatacccattgtttctgctgaagacgagttccagtgaaaatgag

SEQ ID NO: 5624 - DNA, 1781 bp, Hordeum vulgare
gcagcaagccgccgcggcgccgggcgcctgccgccgccaccagctgcgcggcgctcgctgcgcccgagaagcagagcacggccaccgccaaggtagccccttcccccgctccggcgccgtcggcacccgagggcacggactacgacgaggtggctgctacactggagacgctgtacaagctgagccccgttatcgtggaggaggacgggaagagcagcaagaagcaggcggccaccaagaagaagaggaagcaggggaggacgaaaccggcagcagcgacgacgacgacgccgacgccgaagaggacagtggtggtgaggagccagcggcggcgccggatggacctggggaagcgggtggagatgcgggatcaggccgccggcaaggaggacgaacaccgggacggggagcgcgcgttcgaggaggcgctgctgcgggagcacgccgtgtcgacggacatgggcagcctcgactggaggcggatgaagatcccaccggtgctctccgccccgcagagcgcccgtctcttcaagatcatgcagcctatgaaggccattttggaggtgcaagagaacatgcggagcgagctgcagagcgagccgacggaggcggaggtcgccgaggccatgaacatgccggtgcagcggctacggcggctccgcgacgtcggccgggcggccaggaacaagctcatcaagcacaacctacggctcgtcctgtacgcgatcaacaagtactacccggacatgaccggcgacgagaggttcgcggacctgtgccaggccggcgccaacgggctcatcacggccatcgaccgcttcgagcccaagcgcggcttccgcatctccacctacgcgctcttctggatccgccactccgtcgtccgcgccatgacgctctccagcttcacccgcttcccgttcgccatggaatcggagaggcaggagatcaacagggcgagggaggagctgtcgttcgagctggggaggacgccgacggacgaggagacgatgaagaaagtggggctgtctccggcgaggtaccgcgacgtggtgcggatgacgaggccggcctactcgctccactcgcggaaccgcgtcacgcaggaggagctcatcaacgaggtcaccgacgtcgacgccatcggggtcgacacccacaagcacaaccggctcctccgcctcgccatcgacgacctcctggattcgctgaagcccaaggagagcgtggtgatcaggcagaggttcgggctggacggcagggggaggcgcacactgagcgagatcgccggcaacctgaggatctcgagggagatggtgcgcaagtacgaactcaaggcgctcatgaagctcaagcaccccacccgggtcgactacctacgaagatacatgtgaaaatttatctttatatatatgtctcggccgcgcacatacatacatacataccagttctctaatttgattacgccgcatatacattgcaatacggcatagactcatcattgattccgtatttcggacatgtatataagtctgtatatacgagtgaggttgtatataatattggattttagacctccggctgatgtaattcatagcacccagaaaacaaaatggtaaatcatatgagaacagcatgatcatttgacaaattagtatatcaaccatgaaactttcccctccggttcatctgtccgctaaaagcatgagacctgggaaataaatattttcacacttcgtatgcaacatttagtactatgttaggtcatcccaagcacgatg

SEQ ID NO: 5625 - DNA, 1674 bp, Pennisetum glaucum
attccgccccaaccagccgaacccaaaaaccctcgtctcctcctcactcctcttcctctcctccctcccccacgatggccgccgccgccgccgccgccaccacgccgcactccctcctcatccagcgccccacgaccccggccgcgccgagggccgccgccgccgcctcctccctccgcctcccgtcgcgcgccgccaagatctcctgcgccgcggtggcggcgccgtcggcgtcctccccggtcaccggcgccggggaccgtggcgtctacaacttcgcggcggggcccgcgacgctcccgctcaacgtgctccagcgggcgcaggcggagctcgtcgactaccgcggctccgggatgagcatcatggagatgagccaccgcgggagggagttcgacgccgccatcaagaaggccgaggccgacctccgcgcgctcctcgccgtgcccgacacccacgccgtgctcttcctccagggcggcgccaccacgcagttcgccgccgtgcccctcaacctctgcgccggcccgtccgacccggccgacttcgtcgtctcgggctcctggagcgacaaggccttcaaggaggccaacaagtactccgccgcctccgtcgcctggtccggcaaggatggcaagtacaccgccctcccgcccttcgacgccatcaagcagaacccggaggccaggttcctccacatctgctccaacgagaccatccacggcgtcgagttcaaggactacccggagcccaggaacaagtccggcgtcctcgtcgccgacatgtcctccaacttctgctccaagcccgtcgacgtctcccgcttcggcgtcatctacgccggcgcgcagaagaacgtcggcccctcgggggtcaccatcgccatcgtgcgcaaggacctcatcggcagcgcgcagcccatcacgccggtcatgctcgactacaagacgcacgccgacaacgcctcgctctacaacaccccgccctgcttcgccatctacatctgcggcctcgtcttcgaggacctgctcgcgcagggtggcctcgccgaggtcgagaagaagaacgcccacaaggccggcatcctgtacgacaccatcgacgccagcggcgggtactacatctgccccttggagaagtcagtgcggtcgctgatgaacgtgcccttcaccctggccaaggggccagattttgagaagcaattcatcgccgaggcggccaaggagggcatggtgcagctcaagggacacaggtcagttggtggcgtgcgcgcatccatctacaatgccatgccgctcgccggcgtggagaagcttgtcgcgttcatgaaggatttccaagctaggaacccctgattggcttgtgcttatgcatttggtattgctgcaatctagcaagatgtttttgttcttcataacgtaagtgtgctctttgcaagagctgctttgggcatttgtgatctgtctgtagtattagtgccgtagtaactattttgcaatgtttcttttcactttttttggtgttcatgggatttcatttccatggccgccattgttgttggaatgtgttttgctgggaataatgaataaggtagacggtcagttgtctcgagagcaggtgatgctgctgtatgattcagacctctcagagcttataaaacactaataattcaaa

SEQ ID NO: 5626 - DNA, 2192 bp, Oryza sativa
ctgcgaccatcaaaatcgaacaaacggcagcacattttagccgaaacgaatcagagatctgccccagatttgcaacctacacacttgacaatctcaacttggctgcctgcaatctgccattccccttccactgcaacatggagatagccccacccaccaacgcagccaccctacggaaaagcacaccgtaacgccgcccaccaacccccctccgaatctcctccgatcccgacgcctatagatgaataaatctcctccctcttctcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcctccatctacaacgccatgccgctcgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatgctgatgcataataacaaggttgcttggtcttcttgtgtgatcatttctgcttagtttttcttgtgtaatcattttctcctttgagaaatatttgccgatgactgttcattcggatcatgtaagattgttctaccagaaaatctttagattgggggtgaaatgttaaattaccggtaactttcgtgatgctgcttctgttcctgtttgatctcattcccgtgtcgttcatgctgtctcttgattcagtgcttatgtaacaatgtacaatttttagctcggttacagttctgtcaaaacaaacaagtttgg

SEQ ID NO: 5627 - DNA, 1675 bp, Oryza sativa
cctccgaatctcctccgatcccgacgcctatagatgaataaatctcctccctcttctcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcctccatctacaacgccatgccgctcgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatg

SEQ ID NO: 5628 - DNA, 1595 bp, Oryza sativa
tcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcctccatctacaacgccatgccgctcgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagct

SEQ ID NO: 5629 - protein, 547 aa, Sorghum bicolor
MAFNLAQCATAAASVAPRTPRPARSAVAASVSVSTRKAADGRLRLQRQASCEPSVAPSRSVFCRAAVSGKSAADRAASTRRRSGVPVFVMMPLDTVKKCGSALNRRKAVQASLSALKSAGVEGIMVDVWWGIAESDGPGRYNFAGYMELMEMARKAGLKVQAVMSFHQCGGNVGDSVNIPLPRWAVEEMEKDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRHMRSSLKAAAEAAGKPEWGHGGPTDAGGYNNWPEDTLFFRADNGGWSTQYGDFFLSWYSQMLLEHGDRILSGATSVFGASSPVEVSVKVAGIHWHYGTRSHAPELTAGYYNTRHHDGYRPIADLLARHGAVLNFTCVEMRDHEQPQEAQCMPEHLVRQVGAAARAAGVGLAGENALPRYDGTAHDQVVATAAQRAAEDRMVAFTYLRMGPDLFHPDNWQRFAAFVRRMNGAGSCREAAEREAHGVAQATGSLVHEAAVALRS

SEQ ID NO: 5630 - protein, 543 aa, Setaria italica
MAFNLAQSTAAAASVAPRTPRHAAAAPASVSVRKAGGAPPSSSGLRLQRQACCEPSVAPARPVACRAAAAAAERASRRRAGVPVFVMMPLDTVKKCGTALNRRKAVQASLAALKSAGVEGVMVDVWWGIAESDGPGRYNFAGYAELMEMARKTGLKVQAVMSFHQCGGNVGDSVNIPLPRWALEEMEKDQDLCYTDQWGRRNFEYVSLGCDAMPVLKGRTPVECYTDFMRAFRDHFADYLGNTIVEIQVGMGPAGELRYPSYPESNGTWRFPGIGAFQCNDRYMLSSLKAAAEAAGKPEWGHGGPTDAGSYNNWPEDTIFFRRENGGWSTEYGDFFLSWYSQMLMEHGDRILTGASSVFSASPVEVSVKVAGIHWHYGTRSHAPELTAGYYNTRHHDGYLPVARLLARHGAVLNFTCVEMRDHEQPQDAQCMPEALVRQVGAAARAAGVGLAGENALPRYDGAAHDQVVSTAAERAAEDRMVAFTYLRMGADLFHPDNWHRFAAFVRRMDGAGSCREAAEREARSVAQATGSLVHEAAVALRS

SEQ ID NO: 5631 - protein, 544 aa, Pennisetum glaucum
MASNLAQSTAAAASFAPRTPRPAAAAPAFVSVRKAGGAPSSVGLRLQWRQACFEPSVAPTRPVAACRAATAAAERASRRRAGVPVFVMMPLDTVKKCGTALNRRKAVQASLAALKSAGVEGVMVDVWWGIAESDGPGRYNFAGYAELVEMARKTGLKVQAVMSFHQCGGNVGDSVNVPLPRWAVEEMEKDQDLCYTDQWGRRNFEYVSLGCDAMPVLKGRTPVECYTDFMRAFRDHFAEYLGNTIVEIQVGMGPAGELRYPSYPESNGTWRFPGIGAFQCYDRYMLSRLKAAAEAAGKPEWGHGGPTDAGSYNNWPEDTIFFRRENGGWSTEYGDFFLSWYSQMLLEHGDRILTGASSVFSASPVEVSVKVAGIHWHYGTRSHAPELTAGYYNTRHHDGYLPVARLLARHGAVLNFTCVEMRDHEQPQEAQCMPEALVRQVGAAARAAGVGLAGENALPRYDGAAHDQVVATAAERAAEDRMVAFTYLRMGADLFHPDNWRRFAAFVRRMDGAGSCREAAEREARGVAQATGSLVHEAAVALRS

SEQ ID NO: 5632 - protein, 457 aa, Panicum virgatum
MMPLDTVNKCGTALNRRKAVQASLAALKSAGVEGVMVDVWWGIAESDGPGRYNFAGYMELMEMARKTGLKVQAVMSFHQCGGNVGDSVTIPLPRWVLEEMEEDRDLCYTDQWGRRNCEYVSLGCDAMPVLKGRTPVECYTDFMRAFRDHFADYLGNTIVEIQVGMGPAGELRYPSYPESNGTWRFPGIGAFQCNDRYMLSSLKEAAAAAGKPEWGHGGPTDAGSYNNWPEDTIFFRRENGGWSTEYGDFFLSWYSRMLLEHGDRVLTGATSVFSASPVAISVKVAGIHWHYGTRSHAPELTAGYYNTRHRDGYLPIARLLARHGAVLNFTCVEMRDHEQPREAQCMPEALVRQVGAAARAAGAGLAGENALPRYDGAAHDQVVATAAERAAEDRMVAFTYLRMGADLFHPDNWHRFAAFVRRMSGAGSCREAAEREARGVAQATGSLVREAAVALRS

SEQ ID NO: 5633 - protein, 535 aa, Oryza sativa
MALNLAQSAAAAACFATAGDARRAASVVAMPSSSSSATTSLRMKRQAACEPVACRAVARHVAAAAASSRRNGVPVFVMMPLDTVSKCGSALNRRKAVAASLAALKSAGVEGIMVDVWWGIVESEGPGRYNFDGYVELMEMARKTGLKVQAVMSFHQCGGNVGDSVNIPLPRWVVEEMEKDNDLAYTDQWGRRNFEYISLGCDAMPVFKGRTPVECYTDFMRAFRDHFASFLGDTIVEIQVGMGPAGELRYPSYPESNGTWRFPGIGAFQCNDRYMRSSLKAAAEARGKPEWGHGGPTDAGGYNNWPEDTVFFRGDCGGWSTEYGEFFLSWYSQMLLEHGERVLSGATSVFGDGAGAKISVKVAGIHWHYGTRSHAPELTAGYYNTRHRDGYLPIARMLARHGAVLNFTCVEMRDHEQPQEAQCMPEALVRQVAAAARAAGVGLAGENALPRYDGTAHDQVVAAAADRAAEDRMVAFTYLRMGPDLFHPDNWRRFVAFVRRMSESGSPREAAESAAHGVAQATGSLVHEAAVALRS

SEQ ID NO: 5634 - protein, 135 aa, Sorghum bicolor
MPFKRFVEIGRVALVNYGKEYGRLVVIVDVVDQNRALVDAPDMVRCQMNFKRLSLTDIKIDIKRVPKKTTLIKAMEEADVKTKWENSSWGKKLIVQKRRASLNDFDRFKIMLAKIKRGGAIRQELAKLKKVAAAA

SEQ ID NO: 5635 - protein, 135 aa, Panicum virgatum
MPFKRFVEIGRVALVNYGKDYGRLVVIVDVVDQNRALVDAPDMVRCQMNFKRLSLTDIKIDIKRVPKKTTLIKAMEEADVKSKWEKSSWGKKLIVQKRRASLNDFDRFKVMLAKIKRGGAIRQELAKLKKEVAAA

SEQ ID NO: 5636 - protein, 135 aa, Pseudoroegneria spicata
MPFKRFVEIGRVALVNYGKDYGRLVVIVDVVDQNRALVDAPDMVRCQMNFKRLSLTDIKIDIKRVPKKATLIKAMEEADVKTKWENSSWGKKLIVQKRRASLNDFDRFKVMLAKIKRGGAIRQELAKLKKEVAAA

SEQ ID NO: 5637 - protein, 134 aa, Oryza sativa
MPFKRFVEIGRVALVNYGKDYGRLVVIVDVVDQNRALVDAPDMVRCQINFKRLSLTDIKIDIKRVPKKTTLIKAMEEADVKNKWENSSWGKKLIVQKRRASLNDFDRFKVMLAKIKRGGAIRQELAKLKKTAAA

SEQ ID NO: 5638 - protein, 134 aa, Oryza sativa
MPFKRFVEIGRVALVNYGKDYGRLVVIVDVVDQNRALVDAPDMVRCQINFKRLSLTDIKIDIKRVPKKTTLIKAMEEADVKNKWENSSWGKKLIVQKRRASLNDFDRFKVMLAKIKRGGAIRQELAKLKKEAAA

SEQ ID NO: 5639 - protein, 135 aa, Unknown
  Sequence found in Organisms: Pennisetum glaucum, Setaria italica, Panicum virgatum
MPFKRFVEIGRVALVNYGKDYGRLVVIVDVVDQNRALVDAPDMVRCQMNFKRLSLTDIKIDIKRVPKKTTLIKAMEEADVKNKWEKSSWGKKLIVQKRRASLNDFDRFKVMLAKIKRGGAIRQELAKLKKEVAAA

SEQ ID NO: 5640 - protein, 134 aa, Avena sativa
MPFKRFVEIGRVALVNYGKDYGRLVVIVDVVDQNRALVDAPDMVRCQINFKRLSLTDIKIDIKRVPKKATLIKAMEEADVKSKWENSSWGKKLIVQKRRASLNDFDRFKVMLAKIKRGGAIRQELAKLKKEVAA

SEQ ID NO: 5641 - protein, 135 aa, Secale cereale
MPFKRFVEIGRVALVNYGKDYGRLVVIVDVVDQNRALVDAPDMVRCQMNFKRLSLTDIKIDIKRIPKKATLVKAMEEADVKTKWENSSWGKKLIVQKRRASLNDFDRFKVMLAKIKRGGAIRQELAKLKKEVAAA

SEQ ID NO: 5642 - protein, 135 aa, Unknown
  Sequence found in Organisms: Secale cereale, Triticum aestivum
MPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAAA

SEQ ID NO: 5643 - protein, 135 aa, Brachypodium distachyon
MPFKRFVEIGRVALVNYGKDYGRLVVIVDVVDQNRALVDAPDMVRCQINFKRLSLTDIKIDIKRVPKKATLIKAMEEADVKNKWENSSWGKKLIVQKRRASLNDFDRFKVMLAKIKRGGAIRQELAKLKKEVAAS

SEQ ID NO: 5644 - protein, 134 aa, Unknown
  Sequence found in Organisms: Pennisetum glaucum, Setaria italica, Saccharum officinarum
MPFKRFVEIGRVALVNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAIRQELAKLKKASTA

SEQ ID NO: 5645 - protein, 134 aa, Lolium multiflorum
MPFKRFVEIGRVALVNYGKDYGRLVVIVDVVDQNRALVDAPDMVRCQINFKRLSLTDIKIDIKRVPKKATLIKAMEEADVKTKWENSSWGKKLIVQKRRASLNDFDRFKVMLAKIKRGGAIRQELAKLKKEVAA

SEQ ID NO: 5646 - protein, 135 aa, Avena sativa
MPFKRFVEIGRVALVNYGKDYGRLVVIVDVVDQNRALVDAPDMVRCQMNFKRLSLTDIKIDIKRIPKKATLIKALEEADVKNKWENSSWGKKLIVQKRRASLNDFDRFKVMLAKIKRGGAIRQELAKLKKEVAAA

SEQ ID NO: 5647 - protein, 134 aa, Zea mays
MPFKRFVEIGRVALVNYGKDYGRLVVIVDVVDQNRALVDAPDMVRCQVNFKRLSLTDIKIDIKRVPKKTTLIKAMEEADVKTKWENSSWGKKLIVQKRRASLNDFDRFKVMLAKIKRGGAIRQELAKLKKASTA

SEQ ID NO: 5648 - protein, 134 aa, Hordeum vulgare
MPFKRFVEIGRVALVNYGKDYGRLVVIVDVVDQNRALVDAPDMIRCQMNFKRLSLTDIKIDIKRIPKKATLIKAMEEADVKTKWENSSWGKKLIVQKRRASLNDFDRFKVMLAKIKRGGAIRQELAKLKKEVAA

SEQ ID NO: 5649 - protein, 135 aa, Hordeum vulgare
MPFKRFVEIGRVALVNYGKDYGRLVVIVDVVDQNRALIDAPDMIRCQMNFKRLSLTDIKIDIKRIPKKATLIKAMEEADVKTKWENSSWGKKLIVQKRRASLNDFDRFKVMLAKIKRGGAIRQELAKLKKEVAAA

SEQ ID NO: 5650 - protein, 134 aa, Secale cereale
PFKRFVEIGRVALVNYGKDYGRLVVIVDVVDQNRALVDAPDMVRCQMNFKRLSLTDIKIDIKRIPKKATLVKAMEEADVKTKWENSSWGKKLIVQKRRASLNDFDRFKVMLAKIKRGGAIRQELAKLKKEVAAA

SEQ ID NO: 5651 - protein, 134 aa, Triticum aestivum
MPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAA

SEQ ID NO: 5652 - protein, 135 aa, Triticum aestivum
MPFKRFVEIGRVALVNYGKDYGRLVVIVDVVDQNRALVDAPDMVRCQMNFKRLSLTDIKIDIKRIPKKATLIKAMEEADVKTKWENSSWGKKLIVQKKRAALNDFDRFKVMLAKIKRGGAIRQELAKLKKEVAAA

SEQ ID NO: 5653 - protein, 134 aa, Brachypodium distachyon
MPFKRFVEIGRVALVNYGKDYGRLVVIVDVVDQNRALIDAPDMVRCQINFKRLSLTDIKIDIKRVPKKATLIKAMEEADVKNKWENSSWGKKLIVQKRRASLNDFDRFKVMLAKIKRGGAIRQELAKLKKEVAA

SEQ ID NO: 5654 - protein, 134 aa, Panicum virgatum
MPFKRFVEIGRVALVNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAVRQELAKLKKASTA

SEQ ID NO: 5655 - protein, 135 aa, Avena sativa
MPFKRFVEIGRVALVNYGKDYGRLVVIVDVVDQNRALVDAPDMVRCQMNFKRLSLTDIKIDIKRIPKKATLIKALEEADVKNKWENSSWGKKLIVQKRRASLNDFDRFKVMLAKIKRGGAIRQELAKLKKEVASA

SEQ ID NO: 5656 - protein, 90 aa, Secale cereale
MPFKRFVEIGRVALVNYGKDYGRLVVIVDVVDQNRALVDAPDMVRCQMNFKRLSLTDIKIDIKRIPKKATLIKAMEEADVKTKMGEQLMG

SEQ ID NO: 5657 - protein, 93 aa, Triticum aestivum
MVRCQMNFKRLSLTDIKIDIKRIPKKATLIKAMEEADVKTKWENSSWGKKLVVQKRRASLNDFDRFKVMLAKIKRGGAIRQELAKLKKEVAAA

SEQ ID NO: 5658 - protein, 134 aa, Eragrostis curvula
MPFKRFVEMGRVALVNYGKDYGRLVVIVDVVDQNRALVDAPDMVRCQMNFKRLSLTDIKIDIKRVPKKSTLIKAMEEADVKGKWENSSWGKKLIVQKRRAALNDFDRFKVMLAKIKRGGAVRQELAKLKKAATA

SEQ ID NO: 5659 - protein, 134 aa, Sorghum bicolor
MPFKRFVEIGRVALVNYGKDYGRLVVIVDVVDQNRALVDAPDMIRCQINFKRLSLTDIKIDIKRVPKKTTLIKAMEEADVKTKWENSSWGKKLIVQKRRAALNDFDRFKVMLAKIKRGGAIRQELAKLKKASTA

SEQ ID NO: 5660 - protein, 134 aa, Saccharum officinarum
MPFKRFVEIGRVALVNYGKDYGRLVVIVDVVDQNRALVDAPDMVRCQLNFKRLSLTDIKIDIKRVPKKTTLIKAMEEADVKTKWENSSWGKKLIVQKRRAALNDFDRFKVMLVKIKRGGAIRQELAKLKKASTA

SEQ ID NO: 5661 - protein, 135 aa, Festuca arundinacea
MPFNRYVEIGRVALVNYGKDYGRLVVIVDVVDQNRALVDAPDMVRCQMNFKRLSLTDIKVDIKRIPKKATLIKALEEADVKNKWENSSWGKKLIVQKRRASLNDFDRFKVMLAKIKRGGAIRQELAKLKKEVAAA

SEQ ID NO: 5662 - protein, 134 aa, Zea mays
MPFKRFVEIGRVALVNYGKDYGRLVVIVDVVDQNRALVDAPDMVRCQINFKRLSLTDIKIDIKRVPKKSTLIKAMEEADVKTKWENSSWGKKLIVQKRRAALSDFDRFKVMLARIKRGGAIRQELAKLKKASTA

SEQ ID NO: 5663 - protein, 134 aa, Musa acuminata
MPFKRYVEIGRVALVNYGKEYGRLVVIVDVIDQNRALVDAPDMVRGQMNFKRLSLTDIKIDIPRVPKKKTLISAMEAADVKNKWENSSWGRKLIVQKRRASLNDFDRFKVMLAKIKRGGAIRQELAKLKKENAA

SEQ ID NO: 5664 - protein, 134 aa, Musa acuminata
MPFKRYVEIGRVALVNYGKEYGRLVVIVDVIDQNRALVDAPDMVRGQMNFKRLSLTDIKIDIPRVPKKKTLIDAMEAADVKNKWEKSSWGRKLIVQKRRASLNDFDRFKVMLAKIKRGGAIRQELAKLKKENAA

SEQ ID NO: 5665 - protein, 135 aa, Actinidia deliciosa
MPFKRYVEIGRVALVNYGKEYGRLVVIVDVIDQNRALVDAPDMVRCQMNFKRLSLTDITIDIKRVPKKKTLIAAMEAADVKNKWENSSWGRKLIVQKRRASLNDFDRFKLMLAKIKRGGLIRQELAKLKKQNAAC

SEQ ID NO: 5666 - protein, 161 aa, Musa acuminata
MNPPIPLFAVPFVRSHRLRRTFSVSCLSPFKRYVEIGRVALVNYGKEYGRLVVIVDVIDQNRALVDAPDMVRGQMNFKRLSLTDIKIDIPRVPKKKTLISAMEAADVKNKWENSSWGRKLIVQKRRASLNDFDRFKVMLAKIKRGGAIRQELAKLKKENAA

SEQ ID NO: 5667 - protein, 137 aa, Gossypium hirsutum
MPFKRFVEIGRVALVNYGKDYGRLVVIVDVVDQNRALVDAPDMIRCQMNFKRLSLTDIKIDIKRIPKKATLIKAMEEADVKTKWENSCWGKKLIVQKRRASLNDFDRFKVMLANINRGGAIKQELAKLKKEVAAYNT

SEQ ID NO: 5668 - protein, 134 aa, Musa acuminata
MPFKRYVEIGRVALVNYGKEYGRLVVIVDVIDQNRALVDAPDMVRGQMNFKRLSLTDIRIDIPRVPKKKTLIAAMEAADVKNKWENSSWGRKLIVQKRRASLNDFDRFKVMLAKIKRGGAIRQELAKLKKETAV

SEQ ID NO: 5669 - protein, 134 aa, Vitis vinifera
MPFKRYVEIGRVALVNYGKEYGRLVVIVDVIDQNRALVDAPDMVRCQMNFKRLSLTDIKIDIKRVPKKKTLIEAMNAADVKNKWENSSWGRKLIVQKRRASLNDFDRFKIMLAKIKRGGVIRQELAKLKKQTAS

SEQ ID NO: 5670 - protein, 134 aa, Vitis vinifera
MPFKRYVEIGRVALVNYGKDYGRLVVIVDVIDQNRALVDAPDMVRCQMNFKRLSLTDIKIDIKRVPKKKTLIEAMTAADVKNKWENSSWGRKLIVQKRRASLNDFDRFKIMLAKIKRGGVIRQELAKLKKQTAS

SEQ ID NO: 5671 - protein, 134 aa, Sarracenia psittacina
MPFKRYVEIGRVALVNYGKDYGRLVVIVDVIDQNRALVDAPDMVRCQMNFKRLSLTDITIDIKRVPNKKTLIAAMEAADVKNKWENSSWGRKLIVQKRRASLNDFDRFKLMLAKIKRGGLIRQELAKLKKQNAS

SEQ ID NO: 5672 - protein, 91 aa, Aquilegia formosa
MVRSQMNFKRLSLTDIKIEIGRVPKKKNLIEAMEAADVKNKWENSSWGRKLIVQKRRASLNDFDRFKLMLAKIKRGGAIRQELAKLKKQAA

SEQ ID NO: 5673 - protein, 134 aa, Musa acuminata
MPFKRYVEIGRVALVTYGKEYGRLVVIVDVIDQNRALVDSPDMVRGQINFKRLSLTDIKIDIPRVPKKKTLLDAMEAADVKNKWENSSWGRKLIVQKRRASLNDFDRFKVMLAKIKRGGAIRQELAKLKKADVA

SEQ ID NO: 5674 - protein, 134 aa, Vaccinium corymbosum
MPFKRYVEIGRVALVNYGKEYGRLVVIVDVIDQNRALVDAPDMVRCQMNFKRLSLTDITIDIKRAPKKKTLIAAMEAADVKNKWENSSWGRKLIVHKRRAALNDFDRFKLMLAKIKRGGLIRKELAKLKKQNAA

SEQ ID NO: 5675 - protein, 134 aa, Musa acuminata
MPFKRYVEIGRVALVTYGKEYGRLVVIVDVIDQNRALVDSPDMVRGQINFKRLSLTDIKIDIPRVPKKKTLVDAMEAADVKNKWENSSWGRKLIVQKRRASLNDFDRFKVMLAKIKRGGAIRQELAKLKKTDVA

SEQ ID NO: 5676 - protein, 133 aa, Ricinus communis
MPFKRYVEIGRVALVNYGKDYGKLVVIVDVIDQNRALVDAPDMVRSQMNFKRLTLTDIKIDIKRVPRKKTLIEAMENADVKNKWENSSWGRKLIVQKRRASLNDFDRFKLMLAKIKRGGFIRQELAKLKKEAA

SEQ ID NO: 5677 - protein, 134 aa, Unknown
  Sequence found in Organisms: Castanea mollissima, Quercus alba
MPFRRFVEIGRVALVNYGKEYGRLVVIVDVVDQNRALVDAPDMVRTQMNLKRLSLTDIKIDIKRVPKKKTLVEAMEAADVKNKWESSSWGRKLIVQKRRASLNDFDRFKIMLAKIKRAGIVRQELAKLKKESAA

SEQ ID NO: 5678 - protein, 134 aa, Zingiber officinale
MPFKRYVEIGRVALVNYGKEYGRLVVIVDVIDQNRALVDAPDMIRGQINFKRLSLTDIKIDIPRVPKKKTLIQAMEAADVKNKWENSSWGRKLIVQKRRAALNDFDRFKVMVAKIKRGRAIRQELAKLKKENAA

SEQ ID NO: 5679 - protein, 134 aa, Sesamum indicum
MPFKRYVEIGRVALVNYGKEYGKLVVIVDVIDQNRALVDAPDMVRSQMNFKRLSLTDIKIDIKRVPKKKTLIAAMEAADVKGKWEKSSWGRKLIVQKRRASLNDFDRFKLMLAKIKRAGVVRQELAKLKKETAA

SEQ ID NO: 5680 - protein, 134 aa, Sesamum indicum
MPFKRYVEIGRVALVNYGKEYGKLVVIVDVIDQNRALVDAPDMVRSQMNFKRLSLTDIKIDIKRVPKKKTLIAAMEAADVKGKWEKSSWGRKLIVQKRRASLNDFDRFKLMLAKIKRAGVVRQELAKLKKESAA

SEQ ID NO: 5681 - protein, 134 aa, Unknown
  Sequence found in Organisms: Solanum tuberosum, Solanum phureja
MPFKRFVEIGRVALVNYGKDYGRLVVIVDVIDQNRALVDAPDMVRSQMNFKRLSLTDIKIDIKRIPKKKTLIAAMEAADVKTKWESSSWGRKLIVQKRRASLNDFDRFKLMLAKIKRAGVVRQELAKLKKEVAA

SEQ ID NO: 5682 - protein, 133 aa, Solanum melongena
MPFKRFVEIGRVALINYGKDYGKLVVIVDVVDQNRALVDAPDMVRSQMNFKRLSLTDIKIDIKRIPKKNTLIEAMEAADVKTKWENSSWGRKLIVQKRRAGLNDFDRFKLMLAKIKRAGVVRQELAKLKKVAA

SEQ ID NO: 5683 - protein, 134 aa, Platanus occidentalis
MPFKRYVEIGRVALVNYGKDYGRLVVIVDVIDQNRALVDAPDMVRSQMNFKRLSLTDIKIDIKRIPKKKSLIAAMEAADVKNKWENSSWGRKLIVQKRRASLNDFDRFKIMLAKIKRGGVIRQELAKLKKQSAS

SEQ ID NO: 5684 - protein, 134 aa, Elaeis guineensis
MPFKRYVEIGRVALVNYGKDYGRLVVIVDVVDQNRALVDAPDVVRGQMNFKRLSLTDIKIDIPRLPKKKTLIAAMEAADVKNKWENSSWGRKLIVQKRRAALNDFDRFKVMLARIKRGGAIQQELAKLKKQNAS

SEQ ID NO: 5685 - protein, 134 aa, Elaeis guineensis
MPFKRYVEIGRVALVNYGKDYGRLVVIVDVIDQNRALVDAPDMVRGQMNFKRLSLTDIKIDIPRLPKKKSLIAAMEAADVKNKWENSSWGRKLIVQKRRASLNDFDRFKVMLARIKRGGAIQQELAKLKKQNAS

SEQ ID NO: 5686 - protein, 134 aa, Elaeis guineensis
MPFKRYVEIGRVALINYGKDYGRLVVIVDVVDQNRALVDAPDMVRGQMNFKRLSLTDIKIDIPRLPKKKSLIAAMEAADVKNKWENSSWGRKLIVQKRRASLNDFDRFKVMLARIKRGGAIQQELAKLKKQNAS

SEQ ID NO: 5687 - protein, 134 aa, Unknown
  Sequence found in Organisms: Citrus sinensis, Citrus clementina, Citrus sinensis
MPFKRYVEIGRVALVNYGKEYGRLVVIVDVLDQNRALVDAPDMVRGQMNFKRLSLTDIKIDIPRVPKKKTLIDAMEKADVKNKWESSSWGRKLIVQKKRASLNDFDRFKLMLAKIKKGGLVRQELAKLKKENAA

SEQ ID NO: 5688 - protein, 134 aa, Zingiber officinale
MPFKRYVEIGRVALVNYGKEYGRLVVIVDVIDQNRALVDAPDMIRGQINFKRLSLTDIKIDIPRVPKKKTLIKAMEAADVKNKWENSSWGRKLIVQKRRAALNDFDRYKVMVAKIKRGRAIRQELAKLKKENPA

SEQ ID NO: 5689 - protein, 134 aa, Actinidia deliciosa
MPFKRYVEIGRVALVNYGKDYGRLVVIVDVIDQNRALVDAPDMVRTQMNFKRLSLTDITIDIKRVPKKKTLIAAMEAADVKNKWENSSWGRKLIVQKRRASLNDFDRFKIMLAKIKKAGVVRQELAKLKKQSAA

SEQ ID NO: 5690 - protein, 133 aa, Unknown
  Sequence found in Organisms: Euphorbia peplus, Euphorbia esula
MPFKRYVEIGRVALVNYGKDYGKLVVIVDVVDQNRALVDAPDMVRSQMNFKRLSLTDITIDINRVPKKKTLVEAMEKADVKNKWENSSWGRKLIVQKRRASLNDFDRFKLMLAKIKRGGLVRQELAKLKKAAA

SEQ ID NO: 5691 - protein, 134 aa, Solanum lycopersicum
MPFKRFVEIGRVALVNYGEDYGRLVVIVDVIDQNRALVDAPDMVRSQMNFKRLSLTDIKIDIKRIPKKKTLIAAMEAADVKTKWESSSWGRKLIVQKRRASLNDFDRFKLMLAKIKRAGVVRQELAKLKKEVAA

SEQ ID NO: 5692 - protein, 133 aa, Chelidonium majus
MPFKRYVEIGRVALVNYGKDYGRLVVIVDVLDQNRALVDAPDMVRSQMNFKRLSLTDIKIDIPRIPKKKTLIEAMAAADVKNKWEGSSWGRKLIVQKKRASLNDFDRFKVMLAKIKRGGAIRQELAKLKKQSA

SEQ ID NO: 5693 - protein, 133 aa, Euonymus alatus
MPFKRYVEIGRVALVNYGKDYGKLVVIVDVLDQNRALVDAPDMVRSQMNFKRLSLTDITIDIKRVPKKKTLIEATEKADVKNKWENGSWGRKLIVQKRRASLNDFDRFKIMLAKIKRGGIIRQELAKLKKEAA

SEQ ID NO: 5694 - protein, 134 aa, Platanus occidentalis
MPFKRYVEIGRVALVNYGKDYGKLVVIVDVIDQNRALVDAPDMVRSQMNFKRLSLTDIKIDIKRIPKKKSLIAAMEAADVKNKWENSSWGRKLIVQKRRASLNDFDRFKIMLAKIKRGGVIRQELAKLKKQSTA

SEQ ID NO: 5695 - protein, 133 aa, Tripterygium wilfordii
MPFKRYVEIGRVALVNYGKDYGKLVVIVDVLDQNRALVDAPDMVRSQLNFKRLSLTDITIDITRVPKKKTLIEAMEKADVKNKWENSSWGRKLIVQKRRASLNDFDRFKIMLAKIKRGGIIRQELAKLKKEAA

SEQ ID NO: 5696 - protein, 92 aa, Sesamum indicum
MVRSQMNFKRLSLTDIKIDIKRVPKKKTLIAAMEAADVKGKWEKSSWGRKLIVQKRRASLNDFDRFKLMLAKIKRAGVVRQELAKLKKETAA

SEQ ID NO: 5697 - protein, 119 aa, Vaccinium corymbosum
MPFKRYVEIGRVALVNYGKEYGRLVVIVDVIDQNRALVDAPDMVRCQMNFKRLSLTDITIDIKRAPKKKTLIAAMEAADVKNKWENSSWGRKLIVHKRRAALNDFDRFKLMLAKIKRVD

SEQ ID NO: 5698 - protein, 69 aa, Sorghum bicolor
MTLTGSRSCWQRSRSGTEGWCYQARARQAEEGIHGLVSFSGWHVTVFGSELYQQFDRVLSKPELVICFL

SEQ ID NO: 5699 - protein, 134 aa, Fagus grandifolia
MPFRRFVEIGRVALVNYGKEYGRLVVIVDVLDQNRALIDAPDMVRTQMNLKRLSLTDIKIDIKRIPKKKTLVEAMEAADVKNKWENSSWGRKLIVQKRRAALSDFDRFKLMLAKIKRGGIIRQELAKLKKESAA

SEQ ID NO: 5700 - protein, 133 aa, Eschscholzia californica
MPFKRYVEIGRVALVNYGKDYGRLVVIVDVVDQNRALVDAPDMVRSQMNFKRLSLTDIKIDIGRIPKKKALIEAMEAADVKNKWENSSWGRKLIVQKRRAALTDFDRFKLMLAKIKRGGAIRQELSKLKKQSA

SEQ ID NO: 5701 - protein, 133 aa, Eschscholzia californica
MPFKRYVEIGRVALVNYGKDYGRLVVIVDVVDQNRALVDAPDMVRSQMNFKRLTLTDIKIDIGRIPKKKALIEAMEAADVKNKWENSSWGRKLIVQKRRAALNDFDRFKVMLAKIKRGGVIRQELSKLKKATA

SEQ ID NO: 5702 - protein, 134 aa, Tropaeolum majus
MPFKRYVEIGRVALVNYGKDYGRLVVIVDVLDQNRALVDAPDMVRSQINFKRLSLTDIKIEINRVPKKKTLIEAMEKADVKNKWENSSWGRKLIVQKRRTSLNDFDRFKLMLAKIKRGGLIRQELAKLKKETTA

SEQ ID NO: 5703 - protein, 133 aa, Papaver somniferum
MPFKRYVEIGRVALVNYGEDYGRLVVIVDVIDQNRALVDAPDMERSQMNFKRLSLTDIKIDIGRIPKKKVLIDAMEAADVKKKWESSSWGRKLIVQKKRASLNDFDRFKVMLAKIKRGGAIRQELAKLKKQAA

SEQ ID NO: 5704 - protein, 134 aa, Gossypium hirsutum
MPFKRYVEIGRVALVNYGKDYGKLVVIVDVVDQNRALVDAPDTVRSQMNFKRLTLTDIKIDINRVPKKKTLIDAMEKADVKSKWENSSWGRKLIVQKRRASLNDFDRFKLMLAKIKKAGIVRQELAKLKKETAA

SEQ ID NO: 5705 - protein, 134 aa, Actinidia deliciosa
  misc_feature (23)..(23): Xaa can be any naturally occurring amino acid
MPFKRYVEIGRVALVNYGKDYGXLVVIVDVIDQNRALVDAPDMVRCQMNFKRLSLTDITIDIKRVPTKKTLIAAMEAADVKNKWENSSWGRKLIVQKRRASLNDFDRFKLMLAKIKRGGLVRQELAKLKKQNSS

SEQ ID NO: 5706 - protein, 134 aa, Liriodendron tulipifera
MPFKRYVEIGRVALVNYGKDYGKLVVIVDLIDQNRALIDAPDMVRGQMNFKRLSLTDIKIDIPRIPKKKSLIAAMEAADVKNKWENSSWGRKLIVQKKRASLNDFDRFKVMLAKIKRGGAIRQELAKLKKQAAS

SEQ ID NO: 5707 - protein, 134 aa, Carica papaya
MPFKRYVEIGRVALVNYGKEYGRLVVIVDVIDQNRALVDAPDMVRSQMNFKRLSLTDIKIDINRVPKKKALIEAMQKADVQGKWEKSSWGRKLIVQKRRASLTDFDRFKVMLAKIKRGGIIRQELAKLKKESTA

SEQ ID NO: 5708 - protein, 133 aa, Petunia hybrida
MPFKRFVEIGRVALINYGKDYGRLVVIVDVIDQNRALVDAPDMVRSQMNFKRLSLTDIKIDIKRIPKKKTLIDAMEAADVKTKWESSSWGRKLIVQKKRASLNDFDRFKLMLAKIKRAGVVRQELAKLKKTAA

SEQ ID NO: 5709 - protein, 133 aa, Unknown
  Sequence found in Organisms: Solanum tuberosum, Solanum phureja
MPFKRFVEIGRVALINYGKDYGRLVVIVDVIDQNRALVDAPDMVRSQMNFKRLSLTDIKIDIKRIPKKKTLVEAMEAADVKTKWENSSWGRKLIVQKRRAALNDFDRFKLMLAKIKRAGVVRQELAKLKKAAA

SEQ ID NO: 5710 - protein, 133 aa, Solanum lycopersicum
MPFKRFVEIGRVALINYGKDYGRLVVIVDVIDQNRALVDAPDMVRSQMNFKRLSLTDIKIDIKRIPKKKTLVEAMEAADVKTKWENSSWGRKLIVQKRRAALNDFDRFKLMLAKIKRAGVVRQELAKLKKIAA

SEQ ID NO: 5711 - protein, 134 aa, Heritiera littoralis
MPFKRYVEIGRVALVNYGKDYGKLVVIVDVVDQNRALVDAPDMVRSQMNFKRLTLTDIKIDINRVPKKKTLIDAMEKADVKNKWDNSSWGRKLIVQKRRASLNDFDRFKLMLAKIKRAGIVRQELAKLKKESAA

SEQ ID NO: 5712 - protein, 133 aa, Euonymus alatus
MPFKRYVEIGRVALVNYGKDYGKLVVIVDVLDQNRALVDAPDMVRSQMNFKRLSLTDITIDIKRVPKKKTLIEALEKADVKNKWENGSWGRKLIVQKRRASLNDFDRFKIMLAKIKRGGIIRQELAKLKKEAV

SEQ ID NO: 5713 - protein, 134 aa, Fraxinus spp
MPFKRYVEIGRVALVNYGKEYGQLVVIVDVIDQNRALVDAPDMVRSQMNFKRLSLTDIKIDIKRVPKKKTLIAAMEAADVKNKWENSSWGRKLIVQKRRASLNDLDRFKLMLAKIKKAGIVRQELAKLNKETAA

SEQ ID NO: 5714 - protein, 134 aa, Olea europaea
MPFKRFVEIGRVALVNYGKDYGKLVVIVDVIDQNRALVDAPDMVRSQMNFKRLQLTDIKIDIKRVPKKKTLIAAMEAADVKNKWENSSWGRKLIVQKRRASLNDFDRFKLMLAKIKKAGVVRQELAKLKKEITA

SEQ ID NO: 5715 - protein, 134 aa, Platanus occidentalis
MPFKRYVEIGRVALVNYGKDYGKLVVIVDVIDQNRALVDAPDMVRSQMNFKRLSLTDIKIDIKRIPKKKSLIAAMEAADVKNKWENSSWGRKLIVQKRRASLNDFDRFKIMLAKIKKGGVIRQELAKLKKQSAS

SEQ ID NO: 5716 - protein, 134 aa, Sarracenia psittacina
MPFKRYVEIGRVALVNYGKDYGKLVVIVDVIDQNRALVDAPDMVRTQMNFKRLSLTDITIDIKRVPKKKTLIAAMEAADVKNKWENSSWGRKLIVQKRRASLNDFDRFKLMLAKIKRAGVVRQELAKLKKQSTA

SEQ ID NO: 5717 - protein, 134 aa, Tabernaemontana elegans
MPFKRFVEIGRVALINYGKDYGKLVVIVDVIDQNRALVDAPDMVRCQMNFKRLALTDIKIDIKRIPKKRTLIEAMEAADVKNKWENSSWGRKLIVQQRRASLNDFDRFKLMLAKIKRAGVARQELAKLKKQSAA

SEQ ID NO: 5718 - protein, 136 aa, Musa acuminata
MLQPFKRYVEIGRVALVTYGKEYGRLVVIVDVIDQNRALVDSPDMVRGQINFKRLSLTDIKIDIPRVPKKKTLLDAMEAADVKNKWENSSWGRKLIVQKRRASLNDFDRFKVMLAKIKRGGAIRQELAKLKKADVA

SEQ ID NO: 5719 - protein, 134 aa, Gossypium hirsutum
MPFKRYVEIGRVALVNYGKDYGKLVVIVDVVDQNRALVDAPDTVRSQMNFKRLTLTDIKIDINRVPKKKTLIDAMEKADVKSKWENSSWGRKLIVQKRRASLNDFDRFKLMLAKIKKAGIVRQELAKLKKETAT

SEQ ID NO: 5720 - protein, 134 aa, Unknown
  Sequence found in Organisms: Gossypium hirsutum, Gossypium raimondii
MPFKRYVEIGRVALVNYGKDYGKLVVIVDVVDQNRALVDAPDTVRSQMNFKRLTLTDIKIDINRVPKKKTLIDAMEKADVKNKWENSSWGRKLIVQKRRASLNDFDRFKLMLAKIKKAGIVRQELAKLKKETAA

SEQ ID NO: 5721 - protein, 135 aa, Tropaeolum majus
MPFKRYVEIGRVALVNYGKDYGQLVVIVDVLDQNRALVDAPDMVRSQINFKRLSLTDIKIDINRVPKKKTLIEAMEKADVKNKWENSSWGRKLIVQKRRAALNDFDRFKLMLAKIKRGGLIRQELSKLKKESASS

SEQ ID NO: 5722 - protein, 133 aa, Unknown
  Sequence found in Organisms: Catharanthus roseus, Catharanthus roseus
MPFKRYVEIGRVALVNYGKDYGKLVVIVDVIDQNRALVDAPDMVRSQMNFKRLALTDIKIDIKRVPKKKTLIAAMEAADVKNKWESSSWGRKLIVQKKRASLNDFDRFKLMLAKIKRAGVARQELAKLKKQAA

SEQ ID NO: 5723 - protein, 133 aa, Papaver somniferum
MPFKRYVEIGRVALVNYGEDYGKLVVIVDVIDQNRALVDAPDMERSQMNFKRLSLTDIKIDIGRIPKKKALIDAMEAADVKKKWESSSWGRKLIVQKKRASLNDFDRFKVMLAKIKRGGAIRQELAKLKKQAA

SEQ ID NO: 5724 - protein, 134 aa, Populus trichocarpa
MPFKRYVEIGRVALVNYGKEYGRLVVIVDVIDQNRALVDAPDMVRSQMNFKRLSLTDIKIEINRVPKKKALIEAMEKADVKNKWEKSSWGRRLIVQQRRAALNDFDRFKLMLAKIKRGGLIRQELAKLKKENAA

SEQ ID NO: 5725 - protein, 134 aa, Aquilegia formosa
MPFKRYVEIGRVALVNYGKDYGKLVVIVDVIDQNRALVDAPDMVRSQMNFKRLSLTDIKIDINRVPKKKSLIEAMEAADVKNKWENSSWGRKLIVQKRRASLNDFDRFKLMLAKIKKAGAVRQELSKLKKQSAA

SEQ ID NO: 5726 - protein, 134 aa, Persea americana
MPFKRYVEIGRVALVNYGKEYGKLVVIVDVIDQNRALIDAPDMVRGQMNMKRLSLTDIKIDIPRIPKKKSLIAAMEAADVKNKWENSSWGRKLIVQKRRASLNDFDRFKVMLAKIKRAGVIRQELAKLKNQAAS

SEQ ID NO: 5727 - protein, 134 aa, Persea americana
MPFKRYVEIGRVALVNYGKDYGKLVVIVDVIDQNRALVDAPDMVRGQMNMKRLSLTDIKIEIPRIPKKKSLIAAMEAADVKNKWENSSWGRKLIVQKKRASLNDFDRFKVMLAKIKRAGVIRQELAKLKKQAAA

SEQ ID NO: 5728 - protein, 134 aa, Theobroma cacao
MPFKRYVEIGRVALVNYGKDYGKLVVIVDVVDQNRALVDAPDMVRSQMNFKRLTLTDIKIDINRVPKKKTLIDAMEKADVKNKWEKSSWGRKLIVQKRRASLNDFDRFKLMLAKIKRAGILRQEMAKLKKETAA

SEQ ID NO: 5729 - protein, 134 aa, Manihot esculenta
MPFKRYVEIGRVALVNYGKDYGKLVVIVDVIDQNRALVDAPDMVRSQMNFKRLSLTDIKIDINRVPKKKNLIEAMEKADVKNKWENSSWGRKLIVQKRRGALNDFDRFKLMLAKIKRGGLIRQELAKLKKENPA

SEQ ID NO: 5730 - protein, 134 aa, Ricinus communis
MPFKRYVEIGRVALVNYGKDYGKLVVIVDVIDQNRALVDAPDMVRSQMNFKRLQLTDIKIDINRVPKKKNLIEAMEKADVKNKWESSSWGRKLIVQKRRAALNDFDRFKLMLAKIKRGGLIRQELAKLKKETAA

SEQ ID NO: 5731 - protein, 134 aa, Eucalyptus grandis
MPFKRYIEIGRVALINYGKDYGRLVVIVDVVDQNRALVDAPDMVRSQMNFKRLSLTDIKIDIKRVPRKSTLIKAMQEADVQGKWDKSSWGRKLIVQKKRASLNDFDRFKLMLAKIKRGGLIRQELAKLKKESAS

SEQ ID NO: 5732 - protein, 134 aa, Actinidia deliciosa
MPFKRYVEIGRVALVNYGKDYGKLVVIVDVIDQNRALVDAPDMVRTQMNFKRLSLTDITIDIKRVPKKKTLIAAMEAADVKNKWENSSWGRKLIVQKRRASLNDFDRFKLMLAKIKRAGLVKQELAKLKKQTTA

SEQ ID NO: 5733 - protein, 134 aa, Carica papaya
MPFKRYVEIGRVALVNYGKDYGRLVVIVDVIDQNRALVDAPDMVRSQMNFKRLSLTDIKIDINRVPRKKQLIEAMDKADVKNKWEKSSWGRKLIVQKKRASLNDFDRFKVMLAKIKRGGLIRQELAKLKKENAS

SEQ ID NO: 5734 - protein, 133 aa, Capsicum annuum
MPFKRFVEIGRVALINYGKDYGKLVVIVDVIDQNRALVDAPDMVRSQMNFKRLSLTDIKIDIKRIPKKKTLVEAMEAADVKTKWENSSWGRKLIVQKRRAALNDFDRFKLMLAKIKRAGVVRQELAKLKKTAA

SEQ ID NO: 5735 - protein, 134 aa, Capsicum annuum
MPFKRFVEIGRVALVNYGKDYGKLVVIVDVIDQNRALVDAPDMVRSQMNFKRLSLTDIKIDIKRIPKKKTLVAAMEASDVKTKWESSSWGRKLIVQKRRASLNDFDRFKLMLAKIKRAGVVRQELAKLKKEVAA

SEQ ID NO: 5736 - protein, 133 aa, Capsicum annuum
MPFKRFVEIGRVALVNYGKDYGKLVVIVDVIDQNRALVDAPDMVRSQMNFKRLSLTDIKIDISRIPKKKTLIAAMEAADVKNKWESSSWGRKLIVQKRRASLNDFDRFKLMLAKIKRAGVVRQELAKLKKETA

SEQ ID NO: 5737 - protein, 133 aa, Unknown
  Sequence found in Organisms: Euphorbia peplus, Euphorbia esula
MPFKRFVEIGRVALVNYGKDYGKLVVIVDVVDQNRALVDAPDMVRSQMNFKRLSLTDIKIDINRVPKKKNLIEAMEKADVKNKWESSSWGRKLIVQKKRASLNDFDRFKLMIAKIKRAGLVRQELAKLKKSAA

SEQ ID NO: 5738 - protein, 133 aa, Euphorbia esula
  misc_feature (86)..(86): Xaa can be any naturally occurring amino acid
MPFKRFVEIGRVALVNYGKDYGKLVVIVDVVDQNRALVDAPDMVRSQMNFKRLSLTDIKIDINRVPKKKNLIEAMEKADVKNKWEXSSWGRKLIVQKKRASLNDFDRFKLMIAKIKRAGLVRQELAKLKKSAA

SEQ ID NO: 5739 - protein, 133 aa, Nicotiana tabacum
MPFKRFVEIGRVALINYGKEYGKLVVIVDVIDQNRALVDAPDMVRSQINFKRLSLTDIKIDIKRIPKKKTLVEAMEAADVKTKWENSSWGRKLIVQKRRAALNDFDRFKLMLAKIKRAGVVRQELAKLKKTAA

SEQ ID NO: 5740 - protein, 133 aa, Solanum lycopersicum
MPFKRFVEIGRVALVNYGKDYGKLVVIVDVIDQNRALVDAPDMVRSQMNFKRLSLTDIKIDISRIPKKKTLIAAMEAADVKNKWESSSWGRKLIVQKRRASLNDFDRFKLMLAKIKRAGVVRQELAKLKKEVA

SEQ ID NO: 5741 - protein, 134 aa, Solanum melongena
MPFKRFVEIGRVALVNYGKDYGKLVVIVDVIDQNRALVDAPDMVRSQMNFKRLSLTDIKIDIKRIPKKKTLIAAMEAADVKNKWESSSWGRKLIVQKKRASVNDFDRFKLMLAKIKRAGVVRQELAKLKKEVAA

SEQ ID NO: 5742 - protein, 133 aa, Solanum melongena
MPFKRFVEIGRVALVNYGKDYGKLVVIVDVIDQNRALVDAPDMVRSQMNFKRLSLTDIKIDISRIPKKKTLIAAMEAADVKNKWENSSWGRKLMVQKRRASLNDFDRFKLMLAKIKRAGVVRQELAKLKKATA

SEQ ID NO: 5743 - protein, 134 aa, Olea europaea
MPFKRFVEIGRVALVNYGKDYGKLVVIVDVIDQNRALVDAPDMVRSQMNFKRLQLTDIKIDIKRVPKKKTLIAAMEAADVKNKWENSSWGRKLIVQRRRASLNDFDRFKLMLAKIKKAGVVRQELAKLKKEITA

SEQ ID NO: 5744 - protein, 134 aa, Sarracenia psittacina
MPFKRYVEIGRVALVNYGKDYGKLVVIVDVIDQNRALVDAPDMVRCQMNFKRLSLTDITIDIKRVPNKKTLVAAMEAGDVKNKWENSSWGRKLIVQKRRASLNDFDRFKLMLAKIKRGGLIRQELAKLKKQNSS

SEQ ID NO: 5745 - protein, 133 aa, Tabernaemontana elegans
MPFKRYVEIGRVALVNYGKDYGKLVVIVDVIDQNRALVDAPDMVRSQMNFKRLALTDIKIDIKRIPKKKTLIAAMEAADVKNKWENSSWGRKLIVQKKRASLNDFDRFKLMLAKIKRAGVVRQELAKLKKQAA

SEQ ID NO: 5746 - protein, 134 aa, Tripterygium wilfordii
MPFKRYVEIGRVALVNYGKDYGRLVVIVDVLDQNRALVDAPDMVRTQMNFKRLSLTDIKIEINRVPKKKNLIDAMEKADVKSKWENSSWGRKLIVQKRRASLNDFDRFKIMLAKIKRSGLVKQELAKLKKENAS

SEQ ID NO: 5747 - protein, 92 aa, Fraxinus spp
MPFKRYVEIGRVALVNYGKEYGQLVVIVDVIDQNRALVDSPEMVRSQMNFKRLSLTDIKIDIKRVPKKKTLIAAMEAADVKNKWENSSWGRS

SEQ ID NO: 5748 - protein, 127 aa, Papaver somniferum
MPFKRYVEIGRVALLNYGKDYGRLVVIVDVLDQNRALVDAPDMVRSQMNFKRLSLTDIKIDIPRIPKKKTLIEAMAAADVKNKWESSSWGRKLIVLKKRASLNDFDRFKVMLARSRGVELSDRSLQS

SEQ ID NO: 5749 - protein, 91 aa, Euphorbia peplus
MVRSQMNFKRLSLTDIKIDINRVPKKKNLIEAMEKADVKNKWESSSWGRKLIVQKKRASLNDFDRFKLMIAKIKRAGLVRQELAKLKKSAA

SEQ ID NO: 5750 - protein, 91 aa, Thalictrum flavum
MVRSQMNFKRLSLTDIKINIGRVPKKKSLIEAMEAADVKNKWESSSWGRKLIVQKRRASLNDFDRFKLMLAKIKRGGAIRQELAKLKKQAA

SEQ ID NO: 5751 - protein, 147 aa, Utricularia gibba
VGSRWLKFLLVSNFQPFKRYVEIGRVALVNYGKEYGRLVVIVDVIDQNRALVDAPDMVRSQMNFKRLSLTDIKIDIKRVPKKKALVDAMEAADVKGKWENSSWGRKLIVQKRRASLNDFDRFKLMLAKIKKAGAVRLQLAKLKKASA

SEQ ID NO: 5752 - protein, 134 aa, Vaccinium corymbosum
MPFKRYVEIGRVALVNYGKDYGQLVVIVDVIDQNRALVDAPDMVRTQMNFKRLSLTDIKIDIKRVPKKKTLIAAMEAADVKNKWENSSWGRKLIVQKRRAALNDFDRFKLMLAKIKKAGVVRRELAKLKKQSTA

SEQ ID NO: 5753 - protein, 134 aa, Gossypium hirsutum
MPFKRYVEIGRVALVNYGKDYGKLVVIVDVVDQNRALVDAPDMVRGQMNFKRLTLTDITIDIPRVPKKKTLIEAMEKADVKNKWENSSWGRKLIVQKRRASLNDFDRFKLMLAKIKRAGVVRQELAKLKKENSS

SEQ ID NO: 5754 - protein, 134 aa, Unknown
  Sequence found in Organisms: Gossypium hirsutum, Gossypium raimondii
MPFKRYVEIGRVALVNYGKDYGKLVVIVDVVDQNRALVDAPDMVRGQMNFKRLQLTDFKIDIPRVPKKKTLIEAMEKADVKNKWENSSWGKKLIVQKKRASLNDFDRFKIMLAKIKKAGVVRQELAKLKKENAS

SEQ ID NO: 5755 - protein, 134 aa, Gossypium raimondii
MPFKRYVEIGRVALVNYGKDYGKLVVIVDVVDQNRALVDAPDMVRGQMNFKRLTLTDITIDIPRVPKKKTLIEAMEKADVKNKWESSSWGRKLIVQKRRASLNDFDRFKLMLAKIKRSGVIKQELAKLKKENAS

SEQ ID NO: 5756 - protein, 134 aa, Unknown
  Sequence found in Organisms: Gossypium hirsutum, Gossypium raimondii
MPFKRYVEIGRVALVNYGKDYGKLVVIVDVVDQNRALVDAPDMVRGQMNFKRLTLTDITIDIPRVPKKKTLIEAMEKADVKNKWENSSWGRKLIVQKRRASLNDFDRFKLMLAKIKRAGVVRQELAKLKKEKSS

SEQ ID NO: 5757 - protein, 134 aa, Tropaeolum majus
MPFKRYVEIGRVALVNYGKDYGRLVVIVDVLDQNRALVDAPDMVRSQINFKRLSLTDIKIEINRVPKKKTLVEAMEKADVKNKWENSSWGRKLIVQKRRAALNDFDRFKLMLAKIKRGGLIRQELSKLKKETSA

SEQ ID NO: 5758 - protein, 134 aa, Tropaeolum majus
MPFKRYVEIGRVALVNYGKDYGQLVVIVDVLDQNRALVDAPDMVRSQINFKRLSLTDIKIDINRVPKKKTLVEAMEKADVKNKWENSSWGRKLIVQKRRAALTDFDRFKLMLAKIKRGGLIRQELAKLKKESTA

SEQ ID NO: 5759 - protein, 133 aa, Helianthus annuus
MPFKRYVEIGRIALVNYGKDYGKLVVIVDVIDQNRALVDAPDMVRGQMNFKRLTLTDIKIDIKRVPNKKTLIAAMEAADVKSKWENSSWGRKLIVQKKRASLNDFDRFKVMLAKIKKAGVVRQELAKLKKETA

SEQ ID NO: 5760 - protein, 134 aa, Ocimum basilicum
MPFKRYVEIGRVALVNYGKDYGKLVVIVDVIDQNRALVDSPDMVRSQMNFKRLSLTDIKIDIKRVPKKKALIAAMEAADVKGKWESSSWGRKLIVQKRRAALNDFDRFKLMLAKIKKAGVVRQELAKLKKEAAA

SEQ ID NO: 5761 - protein, 134 aa, Bruguiera gymnorhiza
MPFKRYVEIGRVALINYGKEYGKLVVIVDVVDQNRALVDAPDMVRSQMNLKRLTLTDIKIDINRVPKKKNLVEAMEKADVKSKWENSSWGRKLIVQKRRAALNDFDRFKLMLAKIKRAGLVRQELAKLKKENAA

SEQ ID NO: 5762 - protein, 132 aa, Theobroma cacao
MPFKRYVEIGRVALVNYGKDYGKLVVIVDVVDQNRALVDAPDMVRGQMNFKRLTLTDITIDIPRVPKKKTLIEAMEKADVKNKWENSSWGRKLIVQKRRASLNDFDRFKLMLAKIKRAGVIRQEFAKLKKEN

SEQ ID NO: 5763 - protein, 134 aa, Manihot esculenta
MPFKRYVEIGRVALVNYGKDYGKLVVIVDVIDQNRALVDAPDMVRSQMNFKRLSLTDIKIDINRVPKKKNLIEAMEKADVKNKWENSSWGRKLIVQKKRAALNDFDRFKLMLAKIKRGGLIRQELAKLKKENPV

SEQ ID NO: 5764 - protein, 134 aa, Citrus sinensis
MPFKRYVEIGRVALVNYGKDYGKLVVIVDVLDQNRALVDAPDMVRSQMNFKRLSLTDIKIDINRVPRKKSLIEAMEKADVKNKWENSSWGRKLIVQKRRAALNDFDRFKLMLAKIKKGGLVRQELAKLKKENAA

SEQ ID NO: 5765 - protein, 133 aa, Lotus japonicus
MPFKRFVEIGRVALVNYGKEYGRLVVIVDIIDQNRALVDAPDMVRSQMNLKRLSLTDIKVDIKRVPKKKDLIQAMEAADVKNKWENSSWGRKLIVKKRRAALNDFDRFKIMLTKIKRATAVRQELAKLKKSAA

SEQ ID NO: 5766 - protein, 133 aa, Capsicum annuum
MPFKRFVEIGRVPLINYGKDYGKLVVIVDVIDQNRALVDAPDMVRSQMNFKRLSLTDIKIDIKRIPKKKTLVEAMEAADVKTKWENSSWGRKLIVQKRRAALNDFDRFKLMLAKIKRAGVVRQELAKLKKTAA

SEQ ID NO: 5767 - protein, 134 aa, Populus trichocarpa
MPFKRYVEIGRVGLVNYGKEYGRIVVIVDVIDQNRALVDAPDMVRSQMNFKRISLTDIKIDINRVPKKKALIEAMEKADVKNKWENSSWGRRLIVQKRRAALNDFDRFKLMLAKIKRGGLIRQELAKLKKESVA

SEQ ID NO: 5768 - protein, 134 aa, Prunus persica
MPFKRYVEIGRVALVNYGKDYGRLVVIVDVLDQNRALVDAPDMVRTQLNFKRLTLTDITIDIKRVPKKKTLLAAMEAADVKNKWENSSWGRKLIVQKRRAALNDFDRFKLMLAKIKRAGIIRQELTKLKKESAA

SEQ ID NO: 5769 - protein, 134 aa, Tamarix hispida
  misc_feature (25)..(25): Xaa can be any naturally occurring amino acid
  misc_feature (132)..(132): Xaa can be any naturally occurring amino acid
MPFKRYVEIGRVALVNYGKDYGRLXVIVDVIDQNRALVDAPDMVRCQMNFKRLTLTDLKVDIKRVPKKKTLIEAMEAADVKNKWEKSSWGRKLIVQKKRASLNDFDRFKIMLAKIKRAGLVRQELAKLKKEXAA

SEQ ID NO: 5770 - protein, 134 aa, Nicotiana tabacum
MPFKRFVEIGRVALVNYGKDYGKLVVIVDVIDQNRALVDAPDMVRSQINFKRLSLTDIKIDIKRIPKKKTLVAAMEAADVKNKWESSSWGRKLIVQKRRASLNDFDRFKLMLAKIKRAGVVRQELAKLKKETVA

SEQ ID NO: 5771 - protein, 134 aa, Cleome gynandra
MAFKRYVEIGRVALVNYGKDYGRLVVIVDVVDQNRALVDAPDMVRTQMNLKRLSLTDIKIDINRVPKKKSLVEAMEKADVKNKWENSSWGRKLIVQKRRASLNDFDRFKIMLAKIKRAGVVRQELAKLKKETSA

SEQ ID NO: 5772 - protein, 134 aa, Orobanche aegyptiaca
MPFKRYVEIGRVALVNYGKDYGKLVVIVDVIDQNRALVDSPDMVRGQMNFKRLSLTDIKIDIKRVPKKKTLIAAMEAADVKGKWEKSSWGRKLIVQKRRAALNDFDRFKVMLAKIKKAGVVRQELAKLKKESAV

SEQ ID NO: 5773 - protein, 133 aa, Unknown
  Sequence found in Organisms: Solanum tuberosum, Solanum phureja
MPFKRFVEIGRVALVNYGKDYGKLVVIVDVIDQNRALVDSPDMVRSQMNFKRLSLTDIKIDISRIPKKKTLIAAMEAADVKNKWESSSWGRKLIVQKRRASLNDFDRFKLMLAKIKRAGVVRQELAKLKKEVA

SEQ ID NO: 5774 - protein, 134 aa, Ipomoea nil
MPFKRYVEIGRVALVNYGKDYGKLVVIVDVIDQNRALVDAPDMVRSQMNFKRLTLTDITIDIKRVPKKKTLIAAMEAADVKSKWENSSWGRKLIVQKRRAGLNDFDRFKIMLAKIKKAGVVRQELAKLKKESTA

SEQ ID NO: 5775 - protein, 133 aa, Glycyrrhiza uralensis
MPFKRFVEIGRVALVNYGKEYGRLVVIVDIIDQNRALVDAPDMVRSPMNFKRLSLTDIKVDIKRVPKKKDLIKAMEAADVKNKWENSSWGRKLIVRKRRASLNDFDRFKIMLAKIKRAAIVRQELAQLKKTAS

SEQ ID NO: 5776 - protein, 133 aa, Amsonia hubrichtii
MPFKRFVEIGRVALVNYGKDYGKLVVIVDVIDQNRALVDAPDMVRSQMNFKRLQLTDIKIDIKRTPKKKTLVAAMEAADVKNKWENSSWGRKLIVQKKRASLNDFDRFKLMLAKIKKAGVVRQELAKLKKQAA

SEQ ID NO: 5777 - protein, 134 aa, Amsonia hubrichtii
MPFKRFVEIGRVALINYGKDYGKLVVIVDVIDQNRALVDAPDMVRCQINFKRLQLTDIKIDIKRIPKKRTLIEAMEAADVKNKWENSSWGRKLIVQERRASLNDFDRFKLMLAKIKKAGVVRQELAKLKKQSAA

SEQ ID NO: 5778 - protein, 131 aa, Cyamopsis tetragonoloba
FKRFVEIGRVALINYGKEYGRLVVIVDVIDQNRALVDAPDMVRSSVNFKRLSLTDIKVDIKRVPKKKDLIKAMEAADVKNKWENSSWGRKLIVQKRRASLNDFDRFKIMLAKIKRAAVVRQELAKLKKSAA

SEQ ID NO: 5779 - protein, 134 aa, Euonymus alatus
MPFKRFVEIGRVALVNYGKDYGRIVVIVDVLDQNRALVDAPDMVRTQMNFKRLSLTDIKIEINRVPKKKNLIEAMEKADVKNKWENSSWGRKLIVQKRRASLNDFDRFKIMLAKIKRSGLVKQELAKLKKENAS

SEQ ID NO: 5780 - protein, 133 aa, Lippia dulcis
MPFKRYVEIGRVALVNYGKDYGRLVVIVDVIDQNRALVDAPDMVRSQMNFKRLSLTDIKIDIKRCPKKKALIEAMEAADVKGKWEKSSWGRKLIVQKRRAALNDFDRFKLMLAKIKRAGVVRQELAKLKKETA

SEQ ID NO: 5781 - protein, 134 aa, Lippia dulcis
MPFKRFVEIGRVALVNYGEDYGKLVVIVDVIDQNRALVDSPDMVRSQMNFKRLSLTDIKIDIKRVPKKKTLVAAMEAADVKGKWENSSWGRKLIVQKRRASLNDFDRFKLMLAKIKKAGVVRQELAKLKKETAS

SEQ ID NO: 5782 - protein, 136 aa, Gossypium hirsutum
MPFKRYVEIGRVALVNYGKDYGKLVVIVDVVDQNRALVDAPDMVRGQMNFKRLTLTDITIDIPRVPKKKTLIEAMEKADVKNKWESSSWGRKLIVQKRRASLNDFDRFKLMLAKIKRSGVIKQELAKLKKENASSI

SEQ ID NO: 5783 - protein, 134 aa, Vaccinium corymbosum
MPFKRYVEIGRVALVNYGKDYGKLVVIVDVLDQNRALVDSPDMVRTQMNFKRLSLTDITIDIKRVPKKKTLIAAMEAADVKNKWENSSWGRKLIVQKRRASLNDFDRFKLMLAKIKRAAVVRKELAKLKKQSTA

SEQ ID NO: 5784 - protein, 92 aa, Eschscholzia californica
MPFKRYVEIGRVALVNYGKDYGRLVVIVDVLDQNRALVDAPDMVRSQMNFKRLSLTDIKIEIPRVPNKKTLISAMEAGDVKNKWENSSWGRN

SEQ ID NO: 5785 - protein, 135 aa, Allium cepa
MPFKRYVEIGRVALVNYGKDYGKLVVIVDVVDQNRALVDAPDMIRGQMNFKRLSLTDFKIDIPRTPKKKVLIEAMEKADVKNRWENSSWGRKLIVQKRRASLTDFDRFKVMLAKIKRGTAVRQELNKLKKQSVAA

SEQ ID NO: 5786 - protein, 134 aa, Malus domestica
MPFKRYVEIGRVALVNYGKDYGKLVVIVDVIDQNRALVDAPDMVRTQLNFKRLSLTDIKIDIKRVPNKKTLIAAMEAADVKNKWEKSSWGRKLIVQKRRAALNDFDRFKLMLAKIKRAGIIRQELTKLKKESAV

SEQ ID NO: 5787 - protein, 140 aa, Centaurea maculosa
GDPQNQHAFQRYVEIGRVGLVNYGKEYGRIVVIVDVIDQNRALVDAPDMVRSQMNFKRISLTDIKIDINRVPKKKALIEAMEKADVKNKWENSSWGRRLIVQKRRAALNDFDRFKLMLAKIKRGGLIRQELAKLKKESVA

SEQ ID NO: 5788 - protein, 134 aa, Gossypium hirsutum
MPFKRYVEIGRVALVNYSKDYGKLVVIVDVVDQNRALVDAPDMVRGQMNFKRLQLTDFKIDIPRVPKKKTLIEAMEKADVKNKWENSSWGKKLIVQKKRASLNDFDRFKIMLAKIKKAGVVRQELAKLKKENAS

SEQ ID NO: 5789 - protein, 132 aa, Vigna unguiculata
MPFKRYVEIGRVAQINYGKEYGRLVVIVDVIDQNRALVDAPDMVRSQVNFKRLSLTDIKIDIKRVPKKKDLIQAMEAADVKNRWEKSSWGRKLIVQKRRASLNDFDRFKIMLAKIKRAGVVRQELAKLKKTA

SEQ ID NO: 5790 - protein, 134 aa, Ananas comosus
MVFKRYVEIGRVALVNYGKDYGRLVVIVDVIDQNRALVDAPDMVRCQMNFKRLSLTDIKIDIPRIPKKKSLIAAMEAADVKNTWEKSSWGRKLIVQKKRALLNDFDRFKVMLAKIKRAGTINQELAKLKKQNAA

SEQ ID NO: 5791 - protein, 133 aa, Nicotiana tabacum
MPFKRFVEIGRVALVNYGEDYGNLVVIVDVIDQNRALVDAPGMVRSQINFKRLSLTDIKIDIKRIPKKKTLVAAMEAADVKSKWESSSWGRKLIVQKRRASLNDFDRFKLMLAKIKKAGVVRQELAKLKKEAA

SEQ ID NO: 5792 - protein, 134 aa, Triphysaria pusilla
MPFKRYVEIGRVALVNYGEDYGKLVVIVDVIDQNRALVDSPDMVRSQMNFKRLSLTDIKIDIKRVPKKKTLIAAMEAADVKGKWEKSSWGRKLIVQKRRAALNDFDRFKLMLAKIKKAGVVRQELAKLKKDTAA

SEQ ID NO: 5793 - protein, 134 aa, Triphysaria pusilla
MPFKRYVEIGRVALVNYGEDYGKLVVIVDVIDQNRALVDSPDMVRSQMNFKRLSLTDIKIDIKRVPKKKTLIAAMEAADVKGKWEKSSWGRKLIVQKRRAALNDFDRFKLMLAKIKKAGVVRQELAKLKKETAA

SEQ ID NO: 5794 - protein, 126 aa, Jatropha curcas
MPFKRYVEIGRVALVNYGKDYGRLVVIVDVIDQNRALVDAPDMVRSQMNFKRLSLTDIKIDINRVPKKKNLIEAMEKADVKNKWENSSWGRKLIVQKRRASLNDFDRFKLMLAKIKRGGLIRQELA

SEQ ID NO: 5795 - protein, 134 aa, Malus domestica
MPFKRYVEIGRVALVNYGKDYGRLVVIVDVIDQNRALVDAPDMVRTQLNFKRLSLTDIKIDIKRVPNKKTLIAAMEAADVKNKWEKSSWGRKLVVQKRRAALNDFDRFKLMLAKIKRAGIIRQELTKLKKESAF

SEQ ID NO: 5796 - protein, 133 aa, Glycyrrhiza uralensis
MPFKRYVEIGRVALVNYGKEYGRLVVIVDVIDQNRALVDAPDMVRSQMNFKRLSLTDIKVDIKRIPKKKDLINAMEAADVKNKWEKSSWGRKLIVQKRRAALNDFDRFKIMLAKIKRAAVVRQELAKLKKTAS

SEQ ID NO: 5797 - protein, 134 aa, Mimulus guttatus
MPFKRYVEIGRVALVNYGKDYGRLVVIVDVIDQNRALVDSPDMVRGQMNFKRLSLTDIKIDIKRVPNKKTLIAAMEAADVKGKWEKSSWGRKLIVQKRRAALNDFDRFKLMLAKIKKAGVVRQELAKLKKEIAV

SEQ ID NO: 5798 - protein, 134 aa, Salvia sclarea
MPFKRYVEIGRVALVNYGKDYGKLVVIVDVIDQNRALVDSPDMVRSQMNFKRLSLTDIKIDIKRVPKKKTLVAAMEAADVKGKWESSSWGRKLIVQKRRAALNDFDRFKLMLAKIKKAGVVRQELAKLKKETAA

SEQ ID NO: 5799 - protein, 134 aa, Ipomoea batatas
MPFKRYVEIGRVALVNYGKDYGKLVVIVDVIDQNRALVDAPDMVRSQMNFKRLTLTDITIDIKRVPKKKTLVAAMEAADVKNKWENSSWGRKLIVQKRRACLNDFDRFKIMLAKIKRAGVVRQELAKLKKESTA

SEQ ID NO: 5800 - protein, 134 aa, Ipomoea nil
MPFKRYVEIGRVALVNYGKDYGKLVVIVDVIDQNRALVDAPDMVRSQMNFKRLTLTDITIDIKRVPKKKTLIAAMEAADVKNKWENSSWGRKLIVQKRRASLNDFDRFKIMLAKIKKAGIVRQELSKLKKESTA

SEQ ID NO: 5801 - protein, 134 aa, Ambrosia trifida
MPFKRYVEIGRIALVNYGKDYGKLVVIVDVIDQNRALVDAPDMVRGQMNFKRLTLTDIKIDIKRVPNKKTLIAAMEAADVKNKWENSSWGRKLIVQKKRASLNDFDRFKIMLAKIKKAGVVRQELAKLKKEATA

SEQ ID NO: 5802 - protein, 134 aa, Citrus clementina
MPFKRYVEIGRVALVNYGKDYGKLVVIVDVLDQNRALVDAPDMVRSQMNFKRLSLTDIKIDINRVPRKKSLIEAMEKADVNNKWENSSWGRKLIVQKRRAALNDFDRFKLMLAKIKKGGLVRQELAKLKKENAA

SEQ ID NO: 5803 - protein, 133 aa, Cyamopsis tetragonoloba
MPFKRYVEIGRVAQINYGKEYGRLVVIVDVIDQNRALVDAPDMVRSQVNFKRLSLTDLKVDIKRVPKKKDLIKAMEAADVKNKWENSSWGRKLIVQKRRASLNDFDRFKIMLAKIKRAAVVRQELAKLKKSAS

SEQ ID NO: 5804 - protein, 134 aa, Euonymus alatus
MPFKRFVEIGRLALVNYGKDYGRLVVIVDVLDQNRALVDAPDMVRTQMNFKRLSLTDITIEINRVPKKKNLIEAMEKADVKNKWENSSWGRKLIVQKRRASLNDFDRFKIMLAKIKRSGLVKQELAKLKKENAS

SEQ ID NO: 5805 - protein, 133 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVKNKWENSSWGRKLIVQKKRASLNDFDRFKIMLAKIKKAGVVRQELAKLKKETA

SEQ ID NO: 5806 - protein, 133 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVKNKWENSSWGRKLIVQKKRASLNDFDRFKIMLAKIKKAGVVRQELAKLKKDTA

SEQ ID NO: 5807 - protein, 139 aa, Elaeis guineensis
MPFKRYVEIGRVALVNYGKDYGTLVVIVDVVDQNRALVDAPDMVRGQMNFKRLSLTDIKIDIPRLPKKKSLIAAMEAADVKNKWENSSWGRKLIVQKRRAALNDFDRFKVMLARIKRGGAIQQELAKLKKQDASRGLMS

SEQ ID NO: 5808 - protein, 133 aa, Beta vulgaris
MPFKRYVEIGRVGLVNYGKEYGRLVVIVDVLDQNRVLVDAPDMIRGQMNLKRLSLTDIKIDIEKVPKKKTLIDAMEAADVKNKWEKSSWGRKLIVQKRRAALNDFDRFKIMLAKIKKAGAVRQELAKLKKQAA

SEQ ID NO: 5809 - protein, 134 aa, Unknown
  Sequence found in Organisms: Gossypium hirsutum, Gossypium raimondii
MPFKRYVEIGRVALVNYGKDYGKLVVIVDVVDQNRALVDAPDMVRGQMNFKRLTLTDITIDIPRVPKKKTLIEAMEKADVKNKWENSSWGRKLIVQKRRAALTDFDRFKLMLAKIKKAGVVRQELAKLKKENAS

SEQ ID NO: 5810 - protein, 133 aa, Eschscholzia californica
MPFKRYVEIGRVALVNYGKDYGKLVVIVDVVDQNRALVDAPDMVRSQMNFKRLTLTDIKIDIGRVPKKKALVEALEAGDVKNKWENSSWGRKLIVQKRRAALSDFDRFKLMLAKIKRGGAIRQELSKLKKQNA

SEQ ID NO: 5811 - protein, 133 aa, Papaver somniferum
MPFKRYVEIGRVALVNYGEDYGKLVVIVDVIDQNRALVDAPDMVRSQMNFKRLSLTDIKIDIGRVPNKKALLAAMEAADVKKKWESSSWGRKLIVQKKRASLNDFERFKVMLAKIKRGGLIRQELSKLKKSAA

SEQ ID NO: 5812 - protein, 134 aa, Antirrhinum majus
MPFKRYVEIGRVGLVNYGKDYGKLVVIVDVIDQNRALVDSPDMVRSQMNFKRLSLTDIKIDIKRVPKKKTLVAAMEAADVKGKWEKSSWGRKLIVQKRRAALNDFDRFKLMLAKIKKAGVVRQELAKLKKQTAA

SEQ ID NO: 5813 - protein, 133 aa, Malus domestica
MPFKRYVEIGRVALVNYGEDYGKLVVIVDVLDQNRALVDAPDMVRSQMNFKRLSLTDIKIDIKRVPKKKELLAAMEAADVKKKWENSSWGRKLIVQKRRAALNDFDRFKLMLAKIKRAGLVRSELAKLKKSTA

SEQ ID NO: 5814 - protein, 134 aa, Eucalyptus grandis
MPFKRHVEIGRVALINYGKEYGKLVVIVDVVDQNRALVDAPDMVRMQMNFKRLSLTDIKIDIKRIPQKKTLVAAMQEADVQGKWDKSSWGRKLVVQKRRASLNDFDRFKLMLAKIKRSGLIRQELAKLKKESAS

SEQ ID NO: 5815 - protein, 134 aa, Unknown
  Sequence found in Organisms: Curcuma longa, Zingiber officinale
MPFKRYVEIGRVALVNYGKEYGRLVVIVDVIDQNRALVDAPDMIRGQINFKRLSLTDIKIDIPRVPKKKTLIEAMEAADVKNKWEKSSWGRKLIVQKRRAALNDFDRYKVMVAKIKRGRAIREKLAKLKRENPA

SEQ ID NO: 5816 - protein, 134 aa, Zingiber officinale
  misc_feature (12)..(12): Xaa can be any naturally occurring amino acid
MPFKRYVEIGRXALVNYGKEYGRLVVIVDVIDQNRALVDAPDMVRGQINFKRLSLTDIKIDIPRVPKKKTLIQAMEVADVKNKWENCSWGRKLIVQKRRAALNDFDRFKVMVAKIKRGRAIRQKLGRLKRENAV

SEQ ID NO: 5817 - protein, 133 aa, Lotus japonicus
MPFKRFVEVGRVALVNYGKDYGRLVVIVDIIDQNRALIDAPDMERSQMNLKRLSLTDIKIDIKRVPKKKDLIAAMEAADVKNKWEKSSWGRKLIVRKRRASLNDFDRFKIMLAKIKRAGAVRTELAKLKKTAA

SEQ ID NO: 5818 - protein, 134 aa, Prunus persica
MPFKRYVEIGRVALVNYGEDYGKLVVIVDVLDQNRALVDAPDMVRSQMNFKRLSLTDIKIDIKRVPKKKELLAAMEAADVKKKWENSSWGRKLIVQKRRAALNDFDRFKLMLAKIKRAGLVRTELAKLKKESAS

SEQ ID NO: 5819 - protein, 132 aa, Glycine max
MPFKRYVEIGRVAQINYGKEYGRLVVIVDVIDQNRALVDAPDMVRSQVNFKRLSLTDIKIDIKRVPKKKDLVKAMEDADVKNKWEKSSWGRKLIVRKRRASLNDFDRFKIMLAKIKRAAVVRQELAKLKKSA

SEQ ID NO: 5820 - protein, 134 aa, Fragaria vesca
MPFKRYVEIGRVALVNYGPDYGRLVVIVDVIDQNRALVDAPDMVRTQMNFKRLSLTDIKIEIPRVPKKKTLIAAMEAGDVKNKWEQSSWGRKLIVQKRRASLNDFDRFKLMLAKIKKAGIVRQELTKLKKSSAA

SEQ ID NO: 5821 - protein, 132 aa, Nicotiana tabacum
MPFKRFVEIGRVALVNYGEDYGKLVVIVDVIDQNRALVDAPDMVRSQINFKRLSLTDIKIDIKRIPKKKTLVAAMEAADVKSKWESSSWGRKLIVQKRRSSLNDFDRFKLMLAKIKKAGVVRQELAKLKKDA

SEQ ID NO: 5822 - protein, 134 aa, Cleome gynandra
MVFKRYVEIGRVALINYGKEYGRLVVIVDVVDQNRALVDAPDMVRTQMNLKRLSLTDIKIDINRVPKKKNLIEAMEKADVKNKWEKSSWGRKLIVKERRASLNDFDRFKIMLAKIKRAGLVRQELAKLKKESSA

SEQ ID NO: 5823 - protein, 134 aa, Cleome spinosa
MVFKRYVEIGRVALINYGKEYGKLVVIVDVVDQNRALVDAPDMVRTQMNLKRLSLTDIKIDINRVPRKKSLIEAMEKADVKNKWENSSWGRKLVVQKRRASLNDFDRFKVMLAKIKRAGLVRQELAKLKKESSS

SEQ ID NO: 5824 - protein, 134 aa, Cleome spinosa
MAFKRYVEIGRVALVNYGKDYGKLVVIVDVVDQNRALVDAPDMVRTQMNLKRLSLTDIKIDTNRVPRKKSLIEAMEKADVKNKWENSSWGRKLIVQKRRASLNDFDRFKVMLAKIKRAGLVRQELAKLKKESSS

SEQ ID NO: 5825 - protein, 134 aa, Ipomoea nil
MPFKRYVEIGRVALVNYGKDYGKLVVIVDVIDQNRALVDAPDMVRSQMNFKRLTLTDITIDIKRVPKKKTLIAAMEAADVKNKWENSSWGRKLIVQKRRAALNDFDRFKIMLAKIKKAGIVRQELSKLKKESTA

SEQ ID NO: 5826 - protein, 133 aa, Ambrosia trifida
MPFKRYVEIGRIALVNYGKDYGKLVVIVDVIDQNRALVDAPDMVRGQMNFKRLTLTDIKIDIKRVPNKKTLIAAMEAADVKNKWESSSWGRKLIVQKKRASLNDFDRFKVMLAKIKKAGVVRQELAKLKKETA

SEQ ID NO: 5827 - protein, 134 aa, Euonymus alatus
MPFKRYVEIGRVALVNYGKDYGRLVVIVDVLDQNRALVDAPDMVRTQINFKRLSLTDIKIEINRVPKKKNLIEAMEKADVKNKWENSSWGRKLIVQKRRASLNDFDRFKIMLAKIKKSGLVKQELAKLKKENAS

SEQ ID NO: 5828 - protein, 134 aa, Euonymus alatus
MPFKRYVEIGRVALVNYGKDYGRLVVIVDVLDQNRALVDAPDMVRTQLNFKRLSLTDIKIEINRVPKKKNLIEAMEKADVKNKWENSSWGRKLIVQKRRASLNDFDRFKIMLAKIKKSGLVKQELAKLKKENAS

SEQ ID NO: 5829 - protein, 134 aa, Euphorbia peplus
MPYKRYVEIGRVALVNYGKDYGKLVVIVDVIDQNRALVDAPDMVRSQMNFKRLSLTDIKIDINRVPKKKNLIEAMEKADVKNKWESSSWGRKLIVQKKRAALNDFDRFKLMLAKIKRAGLVRQELAKLKKESAA

SEQ ID NO: 5830 - protein, 133 aa, Fagopyrum esculentum
MPFKRYVEIGRVALLNYGKEYGRLVVIVDVIDQNRALIDAPDMVRGQINFKRLTLTDIKIDIPRVPKKKTLIEAMEAADVKNKWESSSWGRKLIVQKKRASLNDFDRFKIMLAKIKKAGAVRQELAKLKKASA

SEQ ID NO: 5831 - protein, 132 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVKNKWENSSWGRKLIVQKKRASLNDFDRFKIMLAKIKKAGVVRQELAKLKKET

SEQ ID NO: 5832 - protein, 133 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVKNKWEKSSWGRKLIVQKKRASLNDFDRFKIMLAKIKKAGVVRQELAKLKKETA

SEQ ID NO: 5833 - protein, 133 aa, Flaveria ramosissima
MPFKRYVEIGRVALVNYGKDYGKLVVVVDVIDQNRALVDAPDMVRGQMNFKRLTLTDIKIDIKRVPNKKTLIAAMEAADVKNKWENSSWGRKLIVQKKRASLNDFDRFKIMLAKIKKAGVVRQELAKLKKETA

SEQ ID NO: 5834 - protein, 133 aa, Linum usitatissimum
MGFKRYVEIGRVALINYGKEYGKLVVIVDVVDQNRALVDAPDMVRSQINFKRLTLTDIKIEINRVPKKKTLVEAMEKADVKGKWENSSWGRKLIVQKRRAELTDFDRFKVMLAKIKRGGLIKQELAKLKKESA

SEQ ID NO: 5835 - protein, 133 aa, Parthenium argentatum
MPFKRYVEIGRVALVNYGKDYGRLVVIVDVIDQNRALVDSPDMVRGQMNFKRLTLTDIKIDIKRVPNKKTLIAALEAADVKNKWENSSWGRKLIVQKKRASLNDFDRFKIMLAKIKKAGVVRQELAKLKKETA

SEQ ID NO: 5836 - protein, 134 aa, Phalaenopsis aphrodite
MPFQRYVEIGRVALVNYGKEYGRLVVIVDVIDQNRALVDAPDMVRGQMNFKRLSLTDIKIDIPRIPKKSKLIEAMEAADVKNRWEKSSWGRKLIVQKRRAELNDFDRFKVMLAKIKRGDSIRRELSKLKKSASK

SEQ ID NO: 5837 - protein, 133 aa, Helianthus annuus
MPFKRYVEIGRIALVNYGKDYGKLVVIVDVIDQNRALVDSPDMVRGQMNFKRLTLTDIKIDIKRVPNKKTLIAAMEAADVKSKWENSSWGRKLIVQKKRASLNDFDRFKIMLAKIKKAGVVRQELAKLKKETA

SEQ ID NO: 5838 - protein, 134 aa, Tripterygium wilfordii
MPFKRYVEIGRVALVNYGKDYGRLVVIVDVLDQNRALVDAPDMVRTQMNFKRLSLTDIKIEINRVPKKKNLIEAMEKADVKNKWENGSWGRKLIVQKRRASLNDFDRFKIMLAKIKRSGLVKQELSKLKKENAS

SEQ ID NO: 5839 - protein, 134 aa, Utricularia gibba
MPFKRYVEIGRVALVNYGKEYGRLVVIVDVIDQNRALVDAPDMVRSQMNFKRLSLTDIKIDIKRVPKKKALVDAMEAADVKGKWEKSSWGRKLIVQKRRASLNDFDRFKLMLAKIKKAGVVRRELASLKKKQLE

SEQ ID NO: 5840 - protein, 133 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVQKQMGKQLMGRKLIVQKKRASLNDFDRFKIMLAKIKKAGVVRQELAKLKKETA

SEQ ID NO: 5841 - protein, 125 aa, Triticum aestivum
MPFKRFVEIGRVALVNYGKEYGRLVVIVDVVDQNRALVDAPDMVRCQMNFKRLSLTDIKIDIKRVPKKTTLIKAMEEADVKRKWENTHGARTDVQEEETHSMTLTSQRHVGEDQKGRAIKKDLLT

SEQ ID NO: 5842 - protein, 137 aa, Liriodendron tulipifera
MPFKRYVEIGRVALVNYGKDYGKLVVIVDVIDQNRALVDAPDMVRGQMNFKRLSLTDIKIDIPRIPKKKSLVAAMEAADVKDKWENSSWGRKLIVQKRRASLNDFDRFKGMLARIKRGGAIRQEFAQLRRQAQAAAA

SEQ ID NO: 5843 - protein, 136 aa, Petunia hybrida
MPFKRFVEIGRVALVNYGKDYGRLVVIVDVIDQNRALVDAPDMVRSQMNFKRLSLTDIKIDIKRIPQKKTLIAAMEAADVKNKWESSSWGRKLIVQKRRASLNDFDRFKLMLAKIKRAGVVRQELASLRDCCLRTF

SEQ ID NO: 5844 - protein, 91 aa, Euphorbia peplus
MVRSQMNFKRLSLTDITIDIKRVPKKKTLIEAMEKADVKNKWENSSWGRKLIVQKRRAALNDFDRFKLMLAKIKRGGIVRQELAKLKKQAA

SEQ ID NO: 5845 - protein, 92 aa, Allium cepa
MPFKRYVEIGRVALVNYGKDYGKLVVIVDVVDQNRALVDAPDMIRGQMNFKRLSLTDFKIDIPRTPKKKVLIEAMEKADVKNRWENSSWEGS

SEQ ID NO: 5846 - protein, 144 aa, Antirrhinum majus
THTQSSQIVEKPFKRYVEIGRVGLVNYGKDYGQLVVIVDVIDQNRALVDSPDMVRSQMNFKRLSLTDIKIDIKRVPNKKTLVAAMEAADVKGKWEKSSWGRKLIVQKRRAALNDFDRFKLMLAKIKRAGVVRQELAKLKKQTAA

SEQ ID NO: 5847 - protein, 64 aa, Vaccinium corymbosum
  misc_feature (14)..(14): Xaa can be any naturally occurring amino acid
  misc_feature (42)..(42): Xaa can be any naturally occurring amino acid
  misc_feature (61)..(61): Xaa can be any naturally occurring amino acid
  misc_feature (64)..(64): Xaa can be any naturally occurring amino acid
FPLSPQFASPSSSXTKMPFKRYVEIGRVALVNYGKEYGRLVXYRRRYRPKQGSCRMPLTWXDAX

SEQ ID NO: 5848 - protein, 121 aa, Flaveria ramosissima
MPFKRYVEIGRVALVNYGKDYGKLVVIVDVIDQNRALVDAPDMVRGQMNFKRLTLTDIKIDIKRVPNKKTLIAAMEAADVKNKWEKSSWGRKLIVQKKRASLNDFDRFKIMLVKDKEGGSC

SEQ ID NO: 5849 - protein, 312 aa, Primula obconica
MSLHILKLVCFLAIALAASAQPQCGRDVGGKLCAGGLCCSQYGYCGDTSEYCGTNCQSQCGGSPTPGGGVGSLISKAQFEQLLLHRNDNACPARNFYTYEAFVSAANSFGGFATTGDTNTREKEIAAFLGQTSHETTGGWPSAPDGPYSWGYCFKEEQGNPPNYCQPSSQWPCAAGKSYYGRGPIQISYNYNYGPAGRAINSDLLNNPDLVENNAVISFKTAFWFWMTPQSPKPSSHDVITGRWTPSAADNAAGRVPGYGVITNIINGGLECGRGTDPRVQDRIGFYRRYCQILGVDPGANLDCANQRPFGS

SEQ ID NO: 5850 - protein, 154 aa, Primula obconica
KILFRLQSLSLSLSKTQHPKCRSRDTWRSEEWHSSTTAKITVSSSSLLTSSIKNRALVDSPDMVRTQMNFKRLSLTDIKIEIRRVPNKKTLIAAMEAADVKNKWEKSSWGRKLIVQKTRASLNDFDRFKIMLAKIKKAGVVRQELAKLKKQTAA

SEQ ID NO: 5851 - protein, 133 aa, Cannabis sativa
MPFKRYVEIGRVALVNYGKDYGQLVVIVDVIDQNRALVDSPDMVRSQMNFKRLSLTDIKIDIKRVPKKKELLAAMEAADVKKKWENSSWGRKLIVQKRRAALNDFDRFKLMLAKIKKSGLVKQELAKLKKANA

SEQ ID NO: 5852 - protein, 133 aa, Allium cepa
MPFKRYVEIGRVALVNYGKDYGKLVVIVDVVDQNRALVDAPDMVRGQMNFKRLSLTDFKIEIPRTPKKKVLIEAMEKADVKNRWEKSSWGRKLIVQKRRAELTDFDRFKVMLAKIKRGTAVRQELNKLKKAAA

SEQ ID NO: 5853 - protein, 133 aa, Plantago ovata
MPFKRYVEIGRVALVNYGKDYGQLVVIVDVIDQNRALVDAPDMERTQMNFKRLQLTDIKIDIRRVPKKKALVAAMEAADVKGKWEKSSWGRKLIVQKRRAALNDFDRFKLMLAKIKRAGVVRQELAKLKKAAA

SEQ ID NO: 5854 - protein, 132 aa, Phaseolus coccineus
MPFKRYVEIGRVAQVNYGKEYGRLVVIVDVIDQNRALVDAPDMVRSQVNFKRLSLTDIKIDIKRIPKKKDLIQAMDAADVKNRWEKSSWGRKLIVQKRRASLNDFDRFKIMLAKIKRASVVRQELAKLKKSA

SEQ ID NO: 5855 - protein, 134 aa, Centaurea maculosa
MPFKRYVEIGRVGLVNYGKDYGKLVVIVDVIDQNRALVDAPDMVRSQLNFKRLTLTDIKIDIKRVPNKKTLIAALEAADVKNKWENSSWGRKLIVQKKRASLNDFDRFKIMLAKIKKAGVVRQELAKLKKETAA

SEQ ID NO: 5856 - protein, 132 aa, Vigna unguiculata
MPFKRYVEIGRVALVNYGKEYGKLVVIVDVIDQNRALVDAPDMVRSQVNFKRLSLTDIKIDIKRVPKKKDLVKAMEAADVKNKWENSSWGRKLIVKKRRAALTDFDRFKLMLAKIKRAAVVRQELSKLKKSA

SEQ ID NO: 5857 - protein, 133 aa, Mesembryanthemum crystallinum
MPFKRYVELGRVALVNYGKEYGRLVVIVGVLDQNRVLVDAPDMVRGQMNLKRLSLTDIKIDIEKAPSKKTLIEAMEAADVKNKWENSSWGRKLIVQKRRANLNDFDRFKIMLAKIKKAGAVRQELAKLKKQAA

SEQ ID NO: 5858 - protein, 134 aa, Lactuca sativa
MPFKRYVEIGRIALVNYGKDYGRLVVIVDVIDQNRALVDAPDMVRGQMNFKRLTLTDIKIDINRVPKKKTLVAALEAADVKNKWENSSWGRKLIVQKKRASLNDFDRFKIMLAKIKKAGVVRQELAKLKKETTA

SEQ ID NO: 5859 - protein, 134 aa, Nuphar advena
MPFKRYVEIGRVAMINYGKEYGRLVVIVDVIDQNRALVDAPDMVRSQMNFKRLALTDIKVDIPRIPKKKSLIAAMETADVKNKWENSSWGRKLIVQKRRASLNDFDRFKVMLAKIKRASFIRQELSKLQKDSGA

SEQ ID NO: 5860 - protein, 133 aa, Arachis hypogaea
MPFKRFIEIGRVAQINYGKEHGRLVVIVDVIDQNRALVDAPDMVRSQVNFKRLSLTDLKVDIKRVPRKKELIKAMEEADVKNKWEKSSWGRKLIVQKRRASLNDFDRFKIMLAKIKRAATVRQELAKLKKSAS

SEQ ID NO: 5861 - protein, 133 aa, Populus trichocarpa
MPFKRYVEIGRVALVNYGKDYGKLVVIVDVIDQNRALVDAPDMVRSQMNFKRLSLTDIKIEINRVPKKKALIEAMEKADVKNKWENSSWGRRLTVQKRRASLNDFDRFKLMLAKIKKAGIVRQELARLKKEAA

SEQ ID NO: 5862 - protein, 133 aa, Populus trichocarpa
MPFKRYVEIGRVALVNYGKDYGKLVVIVDVIDQNRALVDAPDMVRSQMNFKRLSLTDIKIEINRVPKKKALIEAMEKADVKNKWENSSWGRRLTVQKRRASLNDFDRFKLMLAKIKKAGIVRQELAKLKKETA

SEQ ID NO: 5863 - protein, 134 aa, Rosa hybrid cultivar
MPFKRYVEIGRVALVNYGPDYGRLVVIVDVIDQNRALVDAPDMVRTQMNFKRLSLTDIKIEIPRVPKKKTLIAAMEAGDVKNKWEQSSWGRKLIVQKRRASLNDFDRFKLMLAKIKKAGIVRQELTKLKKSSAV

SEQ ID NO: 5864 - protein, 134 aa, Carthamus tinctorius
MPFKRYVEIGRIALVNYGKDYGKLVVIVDVIDQNRALVDSPDMVRSQMNFKRLTLTDIKIDIKRVPNKKTLIAALEAADVKNKWESSSWGRKLIVQKKRASLNDFDRFKVMLAKIKKAGVVRQELAKLKKETAA

SEQ ID NO: 5865 - protein, 133 aa, Glycine max
MPFKRYVEIGRVAQINYGKEYGRLVVIVDVIDQNRALVDAPDMVRSQVNFKRLSLTDIKIDIKRIPKKKDLIQAMEAADVKNRWEKSSWGRKLIVQKRRASLNDFDRFKIMLAKIKRAAVVRQELAKLKKSAS

SEQ ID NO: 5866 - protein, 134 aa, Helianthus annuus
MPFKRYVEIGRIALVNYGKDYGKLVVIVDVIDQNRALVDAPDMVRGQMNFKRLTLTDIKIDIKRVPNKKTLIAALEAADVKNKWENSSWGRKLIVQKKRASLNDFDRFKIMLAKIKKAGVVRQELAKLKKETTA

SEQ ID NO: 5867 - protein, 132 aa, Rhizophora mangle
MPFKRYVEIGRVALINYGKEHGKLVVIVDVVDQNRALVDAPDMVRSQMNLKRLTLTDFKIDINRVPKKKNLIEAMEKADVKSKWENSSWGRKLIVKKRRAALNDFDRFKLMLAKIKRAGLVRQELAKLKKAA

SEQ ID NO: 5868 - protein, 134 aa, Cleome gynandra
MVFKRYVEIGRVALINYGKDYGKLVVIVDVVDQNRALVDAPDMVRTQMNLKRLSLTDIKIEINRVPRKKSLIEAMEKADVKNKWENSSWGRKLIVQKRRASLNDFDRFKVMLAKIKRAGLVRQELAKLKKESSS

SEQ ID NO: 5869 - protein, 134 aa, Mimulus guttatus
MPFKRYVEIGRVALVNYGKDYGKLVVIVDVIDQNRALVDSPDMVRSQMNFKRLSLTDIKIDIKRSPKKKTLVAAMEAADVKGKWEKSSWGRKLIVQKRRAALNDFDRFKLMLAKIKRAGVVRQELAKLKKETPV

SEQ ID NO: 5870 - protein, 134 aa, Cleome spinosa
MVFKRYVEIGRVALINYGKDYGKLVVIVDVVDQNRALVDAPDMVRTQMNLKRLSLTDIKIEINRVPRKKSLIDAMEKADVKNKWENSSWGRKLIVQKRRASLNDFDRFKVMLAKIKRAGLVRQELAKLKKESSS

SEQ ID NO: 5871 - protein, 134 aa, Salvia sclarea
MPFKRYVEIGRVALVNYGEDYGKLVVIVDVIDQNRALVDSPDMVRSQMNFKRLSLTDIKIDIKRVPKKKVLVAAMEAADVKGKWEKSSWGRKLIVQKRRASLNDFDRFKLMLAKIKKAGVVRQELAKLKKETAS

SEQ ID NO: 5872 - protein, 134 aa, Rosa hybrid cultivar
MPFKRYVEIGRVALVNYGEDYGKLVVIVDVIDQNRALVDAPDMVRSQMNFKRLSLTDIKIDIKRVPKKKELLAAMEAADVKKKWESSSWGRKLIVQKRRASLNDFDRFKLMLAKIKRAGLVKNELSKLKKEVAA

SEQ ID NO: 5873 - protein, 133 aa, Aristolochia fimbriata
MPFKRYVEIGRVALVNYGKDYGKLVVIVDVIDQNRALVDAPDMVRGQMNFKRLSLTDIKIDIPRIPKKKSLIAAMEAADVKNKWESSSWGRKLIVRKKRASLNDFDRFKIMLAKIKRSSAINQELAKLKKQSA

SEQ ID NO: 5874 - protein, 129 aa, Cynodon dactylon
RGDRAGGSGHYGKDYGRLVVIVDVVDQNRALVDAPDMVRSQINFKRLSLTDIKIDIKRVPKKSTLIKAMEEADVKTKWENSSWGKKLIVQKRRASLNDFDRFKVMLAKIKRGGAVRQELSKLKNEVAAA

SEQ ID NO: 5875 - protein, 133 aa, Fagopyrum esculentum
MPFKRYVEIGRVALLNYGKDYGRLVVIVDVIDQNRALIDAPDMVRGQINFKRLTLTDIKIDIPRVPKKKTLIEAMEAADVKNKWESSSWGRKLIVQKKRASLNDFDRFKIMLAKIKKAGAVRQELAKLKKASA

SEQ ID NO: 5876 - protein, 133 aa, Linum usitatissimum
MGFKRYVEIGRVALINYGKEYGKLVVIVDVVDQNRALVDSPDMVRSQINFKRLTLTDIKIEINRVPKKKTLVEAMEKADVKGKWENSSWGRKLIVQKRRAALTDFDRFKVMLAKIKRGGLIKQELAKLKKESA

SEQ ID NO: 5877 - protein, 133 aa, Linum usitatissimum
MGFKRYVEIGRVALINYGKDYGKLVVIVDVVDQNRALVDAPDMVRSQLNFKRLTLTDIKIEINRVPKKKTLIEAMEKADVKGKWESSSWGRKLIVQKRRAALTDFDRFKVMLAKIKRGGLVRQELAKLKKTSA

SEQ ID NO: 5878 - protein, 133 aa, Guizotia abyssinica
MPFKRYVEIGRIALVNYGKDYGKLVVIVDVIDQNRALVDAPDMVRGQMNFKRLTLTDITIDIKRVPNKKTLIAAMEAADVKNKWENSSWGRKFIVQKKRASLNDFDRFKVMLAKIKKAGVVRQELAKLKKETA

SEQ ID NO: 5879 - protein, 133 aa, Pisum sativum
MPFKRFVEIGRVALVNYGKDYGKLVVIVDVIDQTRALVDAPDMERIPINFKRLSLTDIKIDIKRVPKKKDLIKAMEAADVKNKWEKSSWGRKLIVRKRRAALNDFDRFKIMLAKIKRAASVRQELAKLKKTAA

SEQ ID NO: 5880 - protein, 134 aa, Phalaenopsis aphrodite
MPFQRYVEIGRVALVNYGKEYGRLVVIVDVIDQNRALVDAPDMVRGQMNFKRLSLTDIKIDIPRIPKKSKLIEAMEAADVKNRWEKSSWGRKLIVQKRRAELNDFDRFKVMLAKVKRGDSIRRELSKLKKSASK

SEQ ID NO: 5881 - protein, 134 aa, Phalaenopsis aphrodite
MPFQRYVEIGRVALVNYGKEYGRLVVIVDVIDQNRALVDAPDMVRGQMNFKRLSLTDIKIDIPRIPKKSKLIEAMQAADVKNRWEKSSWGRKLIVQKRRAELNDFDRFKVMLAKIKRGDSIRRELSKLKKSASK

SEQ ID NO: 5882 - protein, 132 aa, Cajanus cajan
MPFKRFVEIGRVALINYGKDYGRLVVIVDVIDQTRALVDAPDMVRSQINFKRLSLTDIKVDIKRVPKKKDLVKAMEDADVKNKWEKSSWGRKLIVKKRRASLNDFDRFKLMLAKIKRAAVVRQELAKLKKTA

SEQ ID NO: 5883 - protein, 133 aa, Plantago ovata
MPFKRYVEIGRVALVNYGKDYGTLVVIVDVIDQNRALVDSPDIERTQMNFKRLQLTDIKIDIKRVPKKKALVAAMEAADVKGKWEKSSWGKKLIVQKRRAALNDFDRFKLMLAKIKRAGIVRQELAKLKKTAA

SEQ ID NO: 5884 - protein, 134 aa, Primula obconica
MPFKRYVEIGRVALVNYGKDYGQLVVIVDVIDQNRALVDSPDMVRTQMNFKRLSLTDITIEIKRVPNKKTLIAAMEAADVKGKWEKSSWGRKLIVQKKRASLNDFDRFKVMIAKIKKAGVVRQELAKLKKQATA

SEQ ID NO: 5885 - protein, 133 aa, Trigonella foenum-graecum
MPFKRFVEIGRVALINYGKDYGRLVVIVDVIDQTRALVDAPDMERIPINFKRLSLTDIKIDIKRVPKKKDLIKAMEAADVKNKWEKSSWGRKLIVKKRRAALNDFDRFKIMLAKIKRAAVVRQELAKLKKTAA

SEQ ID NO: 5886 - protein, 134 aa, Utricularia gibba
MPFKRYVEIGRVALVNYGKEYGRLVVIVDVIDQNRALVDAPDMVRSQMNFKRLSLTDIKIDIKRVPKKKALVDAMEAADVKGKWEKSSWGRKLIVQKRRAALNDFDRFKLMLAKIKKAGVVRRELAGLKKSSST

SEQ ID NO: 5887 - protein, 133 aa, Helianthus annuus
MPFKRYVEIGRIALVNYGKDYGKLVVIVDVIDQNRALVDSPDMVRGQMNFKRLTLTDIKIDIKRVPNKKTLIAAMEAADVKNKWENSSWGRKLIVQKKRASLNDFDRFKIMLAKIKKAGVVRQELAKLKKETA

SEQ ID NO: 5888 - protein, 134 aa, Unknown
  Sequence found in Organisms: Centaurea maculosa, Cirsium arvense
MPFKRYVEIGRIALVNYGKDYGKLVVIVDVIDQNRALVDSPDMVRSQMNFKRLTLTDIKIDIKRVPNKKTLIAALEAADVKNKWESSSWGRKLIVQKKRASLNDFDRFKVMLAKIKKAGVVRQELAKLKKETTA

SEQ ID NO: 5889 - protein, 133 aa, Unknown
  Sequence found in Organisms: Rosa hybrid cultivar, Fragaria vesca
MPFKRYVEIGRVALVNYGEDYGKLVVIVDVIDQNRALVDAPDMVRSQMNFKRLSLTDIKIDIKRVPKKKELLAAMEAADVKKKWESSSWGRKLIVQKRRANLNDFDRFKLMLAKIKRAGLVKSELAKLKKQSA

SEQ ID NO: 5890 - protein, 134 aa, Helianthus annuus
MPFKRYVEIGRIALVNYGKDYGKLVVIVDVIDQNRALVDAPDMVRGQMNFKRLTLTDIKIDIKRVPNKKTLIAALEAADVKNKWESSSWGRKLIVQKKRASLNDFDRFKIMLAKIKKAGVVRQELAKLKKETTA

SEQ ID NO: 5891 - protein, 134 aa, Malus domestica
MPFKRYVEIGRVALVNYGEDYGKLVVIVDVLDQNRALVDAPDMVRSQMNFKRLSLTDIKIEIKRVPKKKELLAAMETADVKKKWENSSWGRKLVVQKRRAALNDFDRFKLMLAKIKKAGLVRNELAKLKKQSAA

SEQ ID NO: 5892 - protein, 134 aa, Arabidopsis thaliana
MGFKRFVEIGRVALVNYGEDYGKLVVIVDVVDQNRALVDAPDMERIQMNLKRLSLTDIVIDINRVPKKKVLIEAMEKADVKNKWEKSSWGRKLIVQKRRAALNDFDRFKIMLAKIKRAGIVRQELAKLKREIAA

SEQ ID NO: 5893 - protein, 134 aa, Artemisia annua
MPFKRYVEIGRVGLVNYGKDYGKLVVIVDVIDQNRALVDAPDMVRSQLNFKRLTLTDIKIDIKRVPNKKTLIAALEAADVKNKWENSSWGRKLIVQKKRASLNDFDRFKIMLAKIKKAGVVRQELAKLKKETTA

SEQ ID NO: 5894 - protein, 132 aa, Phaseolus coccineus
MPFKRYVEIGRVAQVNYGKEYGRLVVIVDVIDQNRALVDAPDMVRSQVNFKRLSLTDLKIDIKRIPKKKDLIQAMDAADVKNRWEKSSWGRKLIVQKRRASLNDFDRFKIMLAKIKRASVVRQELAKLKKSA

SEQ ID NO: 5895 - protein, 132 aa, Phaseolus coccineus
MPFKRYVEIGRVALVNYGKEYGKLVVIVDVIDQNRALVDAPDMVRSQVNFKRLSLTDIKIDIKRVPKKKDLVKAMEAADVKNKWEKSSWGRKLIVRKRRAALTDFDRFKLMLAKIKRAAVVRQELSKLKKSA

SEQ ID NO: 5896 - protein, 134 aa, Coffea canephora
MVFKRYVEIGRVALINYGKEYGKLVVIVDVIDQNRALVDAPDMVRSQMNFKRLTLTDIKIDIKRIPKKKALVAALEAADVKTKWENSSWGRKLIVQKRRASLNDFDRFKLMLAKIKKAGVVRQELAKLKRQSAA

SEQ ID NO: 5897 - protein, 134 aa, Cynara scolymus
MPFKRYVEIGRIALVNYGKDYGKLVVIVDVIDQNRALVDSPDMVRGQMNFKRLTLTDIKIDIKRVPNKKTLIAALEAADVKNKWENSSWGRKLIVQKKRASLNDFDRFKIMLAKIKKAGVVRQELAKLKKETTA

SEQ ID NO: 5898 - protein, 133 aa, Lactuca sativa
MPFKRYVEIGRVALVNYGKDYGRLVVIVDVIDQNRALVDSPDMVRGQMNFKRLTLTDIKIDINRVPNKKTLIAALEAADVKNKWESSSWGRKLIVQKKRASLNDFDRFKIMLAKIKKAGVVRQELAKLKKETA

SEQ ID NO: 5899 - protein, 133 aa, Medicago truncatula
MPFKRFVEIGRVALINYGPEYGRIVVIVDVIDQTRALVDAPDMERSPINFKRLSLTDIKIDIKRVPKKKDLIKAMEAADVKNKWEKSSWGRKLIVKKRRAALNDFDRFKIMLAKIKRAGVVRQELAKLRKTAA

SEQ ID NO: 5900 - protein, 134 aa, Prunus persica
MPFKRYVEIGRVALVNYGEDYGKLVVIVDVLDQNRALVDSPDMVRSQMNFKRLSLTDIKIDIKRVPKKKELLAAMEAADVKKKWENSSWGRKLIVQKRRASLNDFDRFKLMLAKIKRAGLVKSELAKLKKETSS

SEQ ID NO: 5901 - protein, 134 aa, Rosa hybrid cultivar
MPFKRYVEIGRVALVNYGPDYGRLVVIVDVIDQNRALVDAPDMVRTQMNFKRLSLTDIKIEIPRVPKKKTLIGAMEAGDVKNKWEQSSWGRKLIRQKRRASLNDFDRFKLMLAKIKKAGIVRQELTKLKKSSAV

SEQ ID NO: 5902 - protein, 132 aa, Glycine max
MPFKRYVEIGRVAQINYGKEYGRLVIIVDVIDQNRALVDAPDMVRSQVNFKRLSLTDIKIDIKRIPKKKDLIQAMEAADVKNRWEKSSWGRKLIVQKRRASLNDFDRFKIMLAKIKRAAVVRQELAKLKKSA

SEQ ID NO: 5903 - protein, 132 aa, Glycine max
MPFKRYVEIGRVAQINYGKEYGRLVVIVDVIDQNRALVDAPDMVRSQVNFKRLSLTDIKIDIKRVPKKKDLVKAMEDADVKTKWEKSSWGRKLIVRKRRASLNDFDRFKIMLAKIKKAAVVRQELAKLRKSA

SEQ ID NO: 5904 - protein, 134 aa, Orobanche aegyptiaca
MPFKRYVEIGRVALVNYGKDYGKLVVIVDVIDQNRALVDSPDMVRGQMNFKRLSLTDIKIDIQRVPKKKALIAAMEAADVKGKWEKSSWGRKLIVQKRRAALNDFDRFKLMIAKIKKAGVVRQELAKLKKETVA

SEQ ID NO: 5905 - protein, 134 aa, Amorphophallus konjac
MVFKRYVEIGRVALVNYGKEYGRLVVIVDVVDQNRVLVDYPDIVRGQMNLKRLQLTDFKIDIPRVPKKKTLVTALEEADIKNKWESSSWGRKLIVQKRRAALNDFERFKVMLAKIKRGAAIRQELAKLKKQNAS

SEQ ID NO: 5906 - protein, 134 aa, Amorphophallus konjac
MVFKRYVEIGRVALVNYGKEYGRLVVIVDVVDQNRVLVDYTDIVRGQMNLKRLQLTDFKIDIPRVPKKKTLIAALEEADIKNKWESSSWGRKLIVQKRRAALTDFERFKVMLAKIKRGAAIRQELAKLKKQTAA

SEQ ID NO: 5907 - protein, 133 aa, Arnica chamissonis
MPFKRYVEIGRIALVNYGKDYGKLVVIVDVIDQNRALVDAPDMVRGQMNFKRLTLTDIKIDIKRVPNKKTLIAALEAADVKNKWESSSWGRKLIVQKKRASLNDFDRFKIMLAKIKKAGVVRQELAKLKKETA

SEQ ID NO: 5908 - protein, 134 aa, Cirsium arvense
MPFKRYVEIGRVGLVNYGKDYGKLVVIVDVIDQNRALVDAPDMVRSQLNFKRLTLTDIKIDIKRVPNKKTLVAALEAADVKNKWENSSWGRKLIVQKKRASLNDFDRFKIMLAKIKKAGVVRQELAKLKKETAA

SEQ ID NO: 5909 - protein, 134 aa, Taraxacum officinale
MPFKRYVEIGRIALVNYGKDYGRLVVIVDVIDQNRALVDAPDMVRGQMNFKRLTLTDIKIDINRVPNKKTLVAALEAADVKNKWENSSWGRKLIVQKKRASLNDFDRFKIMLAKIKKAGVVRQELAKLKKETTA

SEQ ID NO: 5910 - protein, 133 aa, Taraxacum officinale
MPFKRYVEIGRVALVNYGKDYGRLVVIVDVIDQNRALVDAPDMVRGQMNFKRLTLTDIKIDINRVPNKKTLVAALEAADVKNKWENSSWGRKLIVQKKRASLNDFDRFKIMLAKIKKAGVVRQELSKLKKQTA

SEQ ID NO: 5911 - protein, 133 aa, Fagopyrum esculentum
MPFKRFVEIGRIALINYGKDYGQLVTIVDVIDQNRALVDAPNMVRCQMNFKRLTLTDIKIDIPRIPKKKTLIEAMEAADVKNKWESSSWGRKLIVQKKRAALNDFDRFKIMLAKIKKAGAVRQELAKLKKAAA

SEQ ID NO: 5912 - protein, 134 aa, Flaveria ramosissima
MPFKRYVEIGRVALVNYGKDYGKLVVIVDVIDQNRALVDAPDMVRGQMNFKRLTLTDIKIDIKRVPNKKTLVAALEAADVKNKWESSSWGRKLIVQKKRASLNDFDRFKIMLAKIKKAGVVRQELAKLKKETTA

SEQ ID NO: 5913 - protein, 134 aa, Flaveria ramosissima
MPFKRYVEIGRVALVNYGKDYGKLVVIVDVIDQNRALVDAPDMVRGQMNFKRLTLTDINIDINRVPKKKTLVAAMEAADVKNKWESSSWGRKLIVQKKRASLNDFDRFKIMLAKIKKAGVVRQELAKLKKETSA

SEQ ID NO: 5914 - protein, 133 aa, Linum usitatissimum
MGFKRYVEIGRVALINYGKDYGKLVVIVDVVDQNRALVDAPDMVRSQLNFKRLTLTDIKIEINRVPKKKTLIEAMEKADVKGKWESSSWGRKLIVQKRRAALTDFDRFKVMLAKIKRGGLVRQELSKLKKASA

SEQ ID NO: 5915 - protein, 134 aa, Guizotia abyssinica
MPVKRYVEIGRIALVNYGKDYGKLVVIVDVIDQNRALVDAPDMVRGQMNFKRLTLTDIKIDIKRVPNKKTLIAAMEAADVKNKWESSSWGRKLIVQKKRASLNDFDRFKIMLAKIKKAGVVRQELAKLKKETTA

SEQ ID NO: 5916 - protein, 133 aa, Guizotia abyssinica
MPFKRYVEIGRIALVNYGKDYGKLVVIVDVIDQNRALVDSPDMVRGQMNFKRLTLTDITIDIKRVPNKKTLIAAMEAADVKNKWENSSWGRKLIVQKKRASLNDFDRFKIMLAKIKKAGVVRQELAKLKKETA

SEQ ID NO: 5917 - protein, 133 aa, Humulus lupulus
MPFKRYVEIGRVALVNYGNDYGKLVVIVDVIDQNRALVDSPDMVRSQMNFKRLSLTDIKIDIKRVPKKKELLAAMEAADVKKKWENSSWGRKLIVQKRRAALNDFDRFKLMLAKIKKSGLVKQELAKLKKANA

SEQ ID NO: 5918 - protein, 134 aa, Lippia dulcis
MTFKRYVEIGRVALVNYGKDYGQLVVIVDVIDQNRALVDSPDMVRSQMNFKRLSLTDIKIDIKRVPKKKALVAAMEAADVKGKWESSSWGRKLIVQKRRAGLNDFDRFKLMLAKIKKAGVVRQELAKLKKEIPA

SEQ ID NO: 5919 - protein, 134 aa, Lippia dulcis
MTFKRYAEIGRVALVNYGEDYGKLVVIVDVVDQNRALVDSPDMVRSQMNFKRLSLTDIKIDIKRVPKKKALVAAMEAADVKGKWEKSSWGRKLIVQKRRASLNDFDRFKLMLAKIKKAGIVRQELAKLKKETAS

SEQ ID NO: 5920 - protein, 133 aa, Cajanus cajan
MPFKRFVEIGRVAQINYGKEYGRLVVIVDVIDQTRALVDAPDMVRSQVNLKRLSLTDIKIDIKRVPKKKDLIQAMEAADVKNRWEKSSWGRKLIVQKRRAALNDFDRFKIMLAKIKRASVVRQELAKLKKTAS

SEQ ID NO: 5921 - protein, 134 aa, Fragaria vesca
MPFKRYVEIGRVALVNYGEDYGKLVVIVDVIDQNRALVDAPDMVRSQMNFKRLSLTDIKIDIKRVPKKKELLAAMEAADVKKKWESSSWGRKLIVQKRRASLNDFDRFKLMLAKIKRAGLVKNELSKLKKGVTA

SEQ ID NO: 5922 - protein, 134 aa, Tripterygium wilfordii
MPFKRYVEIGRVALVNYGKDYGRLVVIVDVLDQNRALVDAPDMIRTQMNFKRLSLTDIKIEINRVPRKKNLIEAMEKADVKNKWENSSWGRKLIVQKRRASLNDFDRFKIMLAKIKKSGLVKQELSKLKKENAC

SEQ ID NO: 5923 - protein, 134 aa, Zostera marina
MPFKRFVEIGRVALVNYGKDYGSLVVIVDVVDQNRALVDGPGMVRHQVNFKRLSLTDIKIDIKRSPKKKFLIAAMEAGDVKNKWEKSSWGKKLIVQKRRAAMNDFDRFKVMLARIKRSTVVNQELAKLKKEAKA

SEQ ID NO: 5924 - protein, 134 aa, Lactuca sativa
MPFKRYVEIGRIALVNYGKDYGRLVVIVDVIDQNRALVDAPDMVRGQMNFKRLTLTDIKIDINRVPKKKTLVAALEAADVKNKWESSSWGRKLIVQKKRASLNDFDRFKIMLAKIKKAGVVRQELAKLKKETTA

SEQ ID NO: 5925 - protein, 133 aa, Lactuca sativa
MPFKRYVEIGRIALVNYGKDYGRLVVIVDVIDQNRALVDAPDMVRGQMNFKRLTLTDIKIDINRVPKKKTLVAALEAADVKNKWESSSWGRKLIVQKKRASLNDFDRFKIMLAKIKKAGVVRQELAKLKKETA

SEQ ID NO: 5926 - protein, 126 aa, Elaeis guineensis
MGFKRFVEIGRVALVNYGEDYGKLVVIVDVVDQNRALVDAPDMERIQMNLKRLSLTDIVIDINRVPKKKVLIEAMEKADVKNKWEKSSWGRKLIVQKRRAALNDFDRFKIMLAKIKRAGIVRQELG

SEQ ID NO: 5927 - protein, 145 aa, Euphorbia peplus
DLRITRLDSLKTCLYKRFVEIGRVALSNYGKDYGKLVVIVDVVDQNRALVDAPDMVRSQINFKRLSLTDIKIDINRVPKKRNLIEAMEKADVKNKWESSSWGRKLIVQKKRASLNDFDRFKLMIAKIKRAGLVRQELAKLKKSAA

SEQ ID NO: 5928 - protein, 64 aa, Flaveria ramosissima
MVRGQMNFKRLTLTDIKIDIKRVPNKKTLIAAMEAADVKNKWEKSSWGRKLIVQKKRASLNDFD

SEQ ID NO: 5929 - protein, 140 aa, Vaccinium corymbosum
MPFKRYVEIGRVALVNYGKEYGRLVVIVDVIDQNRALVDAPDMVRCQMNFKRLSLTDITIDIKRAPKKKTLIAAMEAADVKNKWENSSWGRKLIVHKRRVALNDFDRFRLMLAKIKRGGLIRKELAKLKKAECSLGITFL

SEQ ID NO: 5930 - protein, 153 aa, Secale cereale
  misc_feature (24)..(24): Xaa can be any naturally occurring amino acid
PPVSSPRRLAPRRLRRRCEEPFKXFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAA

SEQ ID NO: 5931 - protein, 91 aa, Citrullus lanatus
MVRSQMNFKRLSLTDIKIDIKRVPRKKELIEAMKAADVQKKWEDSSWGRKLLVKKRRASLNDFDRFKLMLAKIKRAGLVRQELAKLKKSAS

SEQ ID NO: 5932 - protein, 96 aa, Brassica napus
MATVADQSADMLQKLSLDSQAKASEIPEPNKKTAVYQYGGVDSHGQVPTYDRSLTPLLPSDAVDPSVCYVPNAYPLVLLWRIWEWRLERIHWLPES

SEQ ID NO: 5933 - protein, 464 aa, Brassica napus
MDRVVGGKFKLGRKLGSGSFGEIFLGVNVQSGDEVAVKLEPLRSRHPQLHYESKIYMFLQGGSGIPHLKWFGVEGEYNCMVIDLLGPSLEEFFNYCSRSFSLKTVLMLADQMLNRVEYMHIRGFLHRDIKPDNFLMGVGRRANQVYIIDYGLAKKYRDLQTHKHIPYRENKNLTGTARYASVNTHLGIEQSRRDDLESLGYMLMYFLRGSLPWQGLRAGTKKEKYDRISEKKRLTPVEVLCKSFPPEFTSYFLYVRSLRFEDKPDYSYLKRLFRDLFIREGYQFDYVFDWTILKYPQFGSSSSSSSSSKPRPGLRPALNIPAPSAEKVEKPSTGKETRDRYSSVFEAYTRRTGLGTGLQADRSSRPRTSENVLASRDALNQERSMTSSRNQSSSRKAVAGSSVRATSSADFAENRTSSRLVPSNGRSSTTQRTQFAPSSSKAAPSRIPPDVTLEFLSIGNGKRK

SEQ ID NO: 5934 - protein, 134 aa, Unknown
  Sequence found in Organisms: Brassica napus, Brassica juncea, Brassica oleracea, Brassica rapa, Raphanus sativus
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRASLNDFDRFKIMLAKIKKAGVVRQELAKLKKEITA

SEQ ID NO: 5935 - protein, 133 aa, Cicer arietinum
MPFKRYVEIGRVALVNYGKDYGKLVVIVDVIDQTRALVDAPDMERSPLNFKRLSLTDIKIDIKRVPKKKDLIKAMEAADVKNKWEKSSWGRKLIVRKTRASLNDFDRFKIMLAKIKRAAVVRQELAKLKKTAS

SEQ ID NO: 5936 - protein, 133 aa, Cicer arietinum
MPFKRYVEIGRVGLVNYGKDYGKLVVIVDVIDQTRALVDAPDMERSPLNFKRLSLTDIKIDIKRVPKKKDLIKAMEAADVKGKWEKSSWGRKLIVRKRRAALNDFDRFKIMLAKIKRAAVVRQELAKLKKTAA

SEQ ID NO: 5937 - protein, 134 aa, Helianthus annuus
MPFKRYVEIGRIALVNYGKDYGKLVVIVDVIDQNRALVDAPDMVRAQMNFKRLTLTDIKIDIKRVPNKKTLVAALEAADVKNKWESSSWGRKLIVQKKRASLNDFDRFKIMLAKIKKAGVVRQELAKLKKETTA

SEQ ID NO: 5938 - protein, 134 aa, Unknown
  Sequence found in Organisms: Thellungiella halophila, Eutrema halophilum
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRASLNDFDRFKIMLAKIKKAGLVRQELAKLKKEITA

SEQ ID NO: 5939 - protein, 134 aa, Artemisia annua
MPFKRYVEIGRIALVNYGPDYGKLVVIVDVIDQNRALVDAPDMVRGQMNFKRLTLTDIKIDIKRVPNKKTLLAALEAADVKNKWENSSWGRKLIVQKKRASLNDFDRFKIMLAKIKKAGVVRQELAKLKKETTA

SEQ ID NO: 5940 - protein, 134 aa, Brassica oleracea
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRASLNDFDRFKIMLAQIKKAGVVRQELAKLKKVITA

SEQ ID NO: 5941 - protein, 132 aa, Phaseolus coccineus
MPFKRYVEIGRVALVNYGKEYGKLVVIVDVIDQNRALVDAPDTVRSQVNFKRLSLTDIKIDIKRVPKKKDLVKAMEAADVKNKWEKSSWGRKLIVKKRRAALSDFDRFKLMLAKIKRAAVVRQELSKLKKSA

SEQ ID NO: 5942 - protein, 134 aa, Centaurea maculosa
MPFKRYVEIGRVGLVNYGKDYGKLVVIVDVIDQNRALVDAPDMVRSQLNFKRLTLTDIKIDIKRVPNKKTLVAALEAADVKNKWENSSWGRKLIVQKKRASLNDFDRFKIMLAKIKKAGVVRQELAKLKKETTA

SEQ ID NO: 5943 - protein, 134 aa, Unknown
  Sequence found in Organisms: Castanea mollissima, Quercus alba
MPFKRYVEIGRVALVNYGEDYGKLVVIVDVIDQNRALVDAPDMERSQMNFKRLSLTDIKIDIKRVPKKKELLDAMEKADVKKKWESSSWGRKLIVQKRRQNLTDFDRFKLMLAKIKRAGLVKQELAKLKKENAA

SEQ ID NO: 5944 - protein, 134 aa, Cichorium intybus
MPFKRYVEIGRIALVNYGKDYGKLVVIVDVIDQNRALVDAPDMVRGQMNFKRLTLTDIKIDINRVPKKKTLVAALEAADVKNKWESSSWGRKLIVQKKRASLNDFDRFKIMLAKIKKAGVVRQELAKLKKETTA

SEQ ID NO: 5945 - protein, 133 aa, Trifolium pratense
MPFKRFVEIGRVAQINYGKDYGRLVVIVDVIDQTRALVDAPDMERSPINFKRLSLTDIKIEIKRVPKKKDLIKAMEAADVKNKWEKSSWGRKLIVRKRRAALNDFDRFKIMLAKIKRAAVVRQELAKLKKTAA

SEQ ID NO: 5946 - protein, 133 aa, Medicago truncatula
MPFKRFVEIGRVALVNYGPDYGKLVVIVDVIDQTRALVDAPDMERVPINFKRLSLTDIKIDIKRVPKKKDLVKAMEAADVKNKWEKSSWGRKLIVKKRRAALNDFDRFKIMLAKIKRAGVVRQELAKLRKTAA

SEQ ID NO: 5947 - protein, 134 aa, Nuphar advena
MPFKRYVEIGRVAMINYGKEYGRLVVIVDVIDQNRALVDAPDMVRSQMNFKRLALTDIKIDIPRIPKKKSLIAAMEAADVKNKWESSSWGRKLIVQKKRAALNDFDRFKVMLAKIKRASLIRQELSKLQKESGA

SEQ ID NO: 5948 - protein, 134 aa, Helianthus annuus
MPFKRYVEIGRIALVNYGKDYGKLVVIVDVIDQNRALVDAPDMVRGQMNFKRLTLTDIKIDIKRVPNKKTLIAALEAADVKNKWESSSWGRKLIVQRKRASLNDFDRFKIMLAKIKKAGVVRQELAKLKKETTA

SEQ ID NO: 5949 - protein, 134 aa, Rhizophora mangle
MPFQRYVEIGRVALINYGKDYGKLVVIVDVVDQNRALVDAPDMVRSQMNLKRLSLTDIKIDINRVPKKKNLIEAMEKADVKNRWENSAWGRKLIVKKRRAVLNDFDRFKLMLVKIKRAGLVRQELAKLKKGNAA

SEQ ID NO: 5950 - protein, 134 aa, Panax ginseng
MPFKRYVEIGRVALVNYGKDYGKLVVIVDVIDQNRALVDAPDMVRGQMNFKRLTLTDITIDIKRTPKKKALVEAMEAADVKNKWENSSWGRKLIVQKRRATLTDFDRFKLMLAKIKKAGLVRQELAKLKKETTA

SEQ ID NO: 5951 - protein, 133 aa, Linum usitatissimum
MGFKRYVEIGRVALINYGKDYGKLVVIVDVVDQNRALVDSPDMVRSQINFKRLTLTDIKIEINRVPRKKTLIEAMEKADVKGKWENSSWGCKLIVKQRRAALTDFDRFKVMLAKIKRGGLIKQELAKLKKTAA

SEQ ID NO: 5952 - protein, 135 aa, Arnica chamissonis
MPFKRYVEIGRIALVNYGKDYGKLVVIVDVIDQNRALVDSPDMVRGQMNFKRLTLTDIKIDIKRVPNKKTLIAAMEAADVKNKWENSSWGRKLIVQKKRASLNDFDRFKIMLAKIKKAGVVRQELAKLKRRPLDY

SEQ ID NO: 5953 - protein, 133 aa, Artemisia annua
MPFKRYVEIGRIALVNYGPDYGKLVVIVDVIDQNRALVDAPDMVRGQMNFKRLTLTDIKIDIKRVPNKKTLVAALEAADVKNKWESSSWGRKLIVQKKRASLNDFDRFKIMLAKIKKAGVVRQELAKLKKEAA

SEQ ID NO: 5954 - protein, 128 aa, Citrus clementina
VEIGRVALVNYGKDYGKLVVIVDVLDQNRALVDAPDMVRSQMNFKRLSLTDIKIDINRVPGKKSLIEAMEKADVKNKWENSSWGKKLIVQKRRVALNDFDKFKLMLAKIKKGGLIRQELAKLKKENAA

SEQ ID NO: 5955 - protein, 133 aa, Fagopyrum esculentum
MPFKRFVEIGRIALINYGKDYGQLVTIVDVIDQNRALVDAPNMVRCQMNFKRLTLTDIKIDIPRIPKKKTLIEAMEAADVKNKWESSSWGRKLIVQKKRAALNDFDRFKIMLAKIKKAGAVRQELAKLKKATA

SEQ ID NO: 5956 - protein, 133 aa, Linum usitatissimum
MGFKRYVEIGRVALINYGKDYGKLVVIVDVVDQNRALVDSPDMVRSQINFKRLTLTDIKIEINRVPRKKTLIEAMEKADVKGKWENSSWGRKLIVKQRRAALTDFDRFKVMLAKIKRGGLIKQELAKLKKTAA

SEQ ID NO: 5957 - protein, 134 aa, Lippia dulcis
MVFKRYVEIGRVALVNYGKDYGKLVVIVDVIDQNRALVDSPDMVRRQMNFKRLSLTDIKIDIKRVPKKKTLVAAMEAADVKGKWESSSWGRKLIVQNRRAALNDFDRFKLMLAKIKKAGVVRQELAKVKKEIPA

SEQ ID NO: 5958 - protein, 133 aa, Trigonella foenum-graecum
MPFKRFVEIGRVALVNYGKDYGKLVVIVDVIDQTRALVDAPDMERVPINFKRLSLTDIKIDIKRVPKKKDLVKAMEAADVKNKWEKSSWGRKLIVKKRRAALNDFDRFKIMLAKIKRAAVVRQELAKLRKTAA

SEQ ID NO: 5959 - protein, 133 aa, Vinca minor
MPFKRYVEIGRVALVNYGEDYGKLVVIVDVIDQNRALVDSPDMVRSQMNFKRLALTDIKIDIKRIPNKKSLVAAMEAADVKNKWENSSWGRKLIVQKKRASLNDFDRFKLMLAKIKKAGVVRQELAKLKKQAA

SEQ ID NO: 5960 - protein, 134 aa, Amborella trichopoda
MPFKRYVEIGRVALVNYGKDYGMLVVIVDVIDQNRALVDAPKMIRTQMNFKRLSLTDIKIDIPRVPKKKSLIAAIEAADVYKKWENSSWGRKLIVQKQRASLTDFDRFKVMLARIKRAGLIRQELSKLKKQSAS

SEQ ID NO: 5961 - protein, 133 aa, Lactuca sativa
MPFKRYVEIGRVALVNYGKDYGKLVVIVDVIDQNRALVDSPDMVRGQMNFKRLTLTDIKIDINRVPNKKTLIAALEAADVKNKWESSSWGRKLIVQKKRASLNDFDRFKIMLAKIKKAGVVRQELAKLKKETA

SEQ ID NO: 5962 - protein, 77 aa, Vaccinium corymbosum
MVRCQMNFKRLSLTDITIDIKRAPKKKTLIAAMEAADVKNKWENSSWGRKLIVHKRRAALNDFDRFKLMLAKIKRVD

SEQ ID NO: 5963 - protein, 135 aa, Citrus clementina
LIIESLYVEIGRVALINYGKDYGKLVVIVDVLDQNKALVDAPDMVRSQMNFKRLSLTDIKIDINRVPKKKSLIEAMEKADVKNKWENSSWGKKLIVQKRRAALNDFDKFKLMLAKIKKGGLIRQELAKLKKENAA

SEQ ID NO: 5964 - protein, 168 aa, Brassica juncea
MVFKRYVEIGRVALVNYGKDHGKLVVIVDVVDQNRALVDAPDMERIQMNFKRLSLTDIVIEINRVPKKKALIEAMEKADVKNKWEKSSWGRKLMFRSVGLASMILTGSRSCWPKSRKLELLGKSLQNSRRRSLLDRIQYYLRILFLYFGLTISVFENFNINVYTVVEY

SEQ ID NO: 5965 - protein, 134 aa, Brassica juncea
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRANLNDFDRFKIMLAKIKKAGVVRQELAKLKKEITA

SEQ ID NO: 5966 - protein, 134 aa, Bupleurum chinense
MPFKRYVEIGRVALVNYGKDYGKLVVIVDVVDQNRALVDSPDMVRCQMNFKRLTLTDITIDIKRTPKKKVLIEAMEAADVKNKWENSSWGRKLIVQKRRAALTDFDRFKLMLAKIKKASLVREELAKLKREVKA

SEQ ID NO: 5967 - protein, 134 aa, Centaurea maculosa
MPFKRYVEIGRIALVNYGKDYGKLVVIVDVIDQNRALVDSPDMVRGQMNFKRLTLTDITIDIKRVPNKKTLIAALEAADVKNKWESSSWGRKLIVQKKRASLNDFDRFKIMLAKIKKAGVVRQELAKLKKETTA

SEQ ID NO: 5968 - protein, 134 aa, Helianthus annuus
MPFKRYVEIGRVALVNYGKDYGKLVVIVDVIDQNRALVDAPDMVRGQMNFKRLTLTDIKIDIKRVPNKKTLVAALEAADVKNKWESSSWGRKLIVQKKRASLNDFDRFKIMLAKIKKAGVVRQELSKLKKETTC

SEQ ID NO: 5969 - protein, 134 aa, Eutrema halophilum
MVFKRYVEIGRVALVNFGKDYGKLVVIVDVVDQNRALVDAPDMERIQMNLKRLSLTDIVIDINRVPKKKNLIEAMEKADVKNKWEKSSWGRKLIVQKRRAALNDFDRFKIMLAKIKRAGVVRQELAKLKRESTA

SEQ ID NO: 5970 - protein, 150 aa, Eutrema parvulum
TSIFLHLCSYILPVRVQVFKRYVEIGRVALVNFGKDHGKLVVIVDVVDQNRALVDAPDMERIQMNFKRLSLTDIVIDINRVPKKKNLIEAMEKADVKNKWEKSSWGRKLIVQKRRAALNDFDRFKIMLAKIKRAGVVRQELAKLKKEITA

SEQ ID NO: 5971 - protein, 91 aa, Citrullus lanatus
MVRSQMNFKRLSLTDIKIDIKRVPRKKELIEAMKAADVQKKWEDSSWGRKLLVKKRRASLNDFDRFKLMLAKIKRAGLVRQELAKLKKSES

SEQ ID NO: 5972 - protein, 134 aa, Arabidopsis thaliana [sequence omitted]

SEQ ID NO: 5973 - protein, 134 aa, Brassica oleracea
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRASLNDFDRFKIILAKIKKAGLVRQELAKLKKEITA

SEQ ID NO: 5974 - protein, 134 aa, Taraxacum officinale
MPFKRYVEIGRIALVNYGKDYGKLVVIVDVIDQNRALVDSPDMVRGQMNFKRLTLTDIKIDINRVPNKKTLVAALEAADVKNKWENSSWGRKLIVQKKRASLNDFDRFKIMLAKIKKAGVVRQELAKLKKETTA

SEQ ID NO: 5975 - protein, 133 aa, Unknown
  Sequence found in Organisms: Cucumis sativus, Cucumis melo
MPFKRYVEIGRIALINYGEDYGKLVVIVDVIDQNRALVDAPDMERSQMNFKRLSLTDIKIDIKRVPKKKELIEAMKAGDVQKKWENSSWGRKLIVKKRRASLNDFDRFKLMLAKIKRAGLVRQELAKLKKAEA

SEQ ID NO: 5976 - protein, 133 aa, Arachis hypogaea
MPFKRFIEIGRVALINYGKEHGRLVVIVDVIDQNRALVDAPDMVRSQVNFKRLSLTDLKVDIKRVPKKKELIKAMEDADVKNKWEKSSWGRKLIVRKTRANLNDFDRFKLMLVKIKKAAVVRQELAKLKKTSA

SEQ ID NO: 5977 - protein, 134 aa, Raphanus sativus
  misc_feature (122)..(122): Xaa can be any naturally occurring amino acid
MVFKRYVEIGRVALVNYGKDHGKLVVIVDVVDQNRALVDAPDMERIQMNFKRLSLTDIVIEINRVPKKKALIEAMEKADVKNKWEKSSWGRKLIVQKRRASLNDFDRFKIMLAKIKKAGVVXQELAKLKKEITA

SEQ ID NO: 5978 - protein, 134 aa, Juglans hindsii x Juglans regia
MPFKRYVEIGRVALVNYGEDYGKLVVIVDVIDQNRALTDSPDMERSQMNFKRLSLTDLKIDIKRVPKKKELLEAMEKADVKKKWESSSWGRKLIVQKRRASLTDFDRFKLMLAKIKRAGLVRQELAKLKKANAS

SEQ ID NO: 5979 - protein, 134 aa, Panax ginseng
MPLKRYVEIGRVALVNYGKDYGKVVVIVDVIDQNRALVDAPDMVRSQLNLKRVTLTDITIDIKRVPKKKTLVAAMEAADVKGKWENSSWGRKLIVQKRRASLNDFDRFKLMLAKIKKAGVVRQELAKLKKETTA

SEQ ID NO: 5980 - protein, 134 aa, Amborella trichopoda
MPFKRYVEIGRVALVNYGKDYGMLVVIVDVIDQNRALVDAPKMIRTQMNFKRLSLTDIKIDIPRVPKKKSLIAAIEAADVYKKWENSSWGRKLIVQKQRASLTDFDRFKVILARIKRAGLIRQELSKLKKQSAS

SEQ ID NO: 5981 - protein, 134 aa, Amorphophallus konjac
MVFKRYVEIGRVALVNYGKEYGRLVVIVDVVDQNRVLVDYLDIVRGQMNLKRLQLTDFKIDIPRVPKKKTLIAALEEADIKNKWESSSWGRKLIVQKRRAALTDFERFKVMLAKIKRGAAIRQELAKLKKQSVD

SEQ ID NO: 5982 - protein, 118 aa, Arnica chamissonis
MERIMVKLVVIVDVIDQNRALVDAPDTVRGQMNFKRLTLTDIKIDIKRVPNKKTLVAALEAADVKNKWESSSWGRKLIVQKKRASLNDFDRFKIMLAKIKKAGVVRQELAKLKKETPA

SEQ ID NO: 5983 - protein, 134 aa, Cirsium arvense
MPFKRYVEIGRVGLVNYGKDYGKLVVIVDVIDQNRALVDAPDMVRSQLNFKRLTLTDIKIDIKRVPNKKTLVAALEAADVKNKWESSSWGRKLIVQKKRASLNDFDRFKIMLAKIKKAGVVRQELAKLKKETTA

SEQ ID NO: 5984 - protein, 92 aa, Citrus clementina
MARSQMNFKRLSLTDIKIDINRVPRKKSLIEAMEKADVKNKWENSSWGKKLIVQKRRAALNDFDRFKLMLAKIKKGGLIRQELAKLKKENAA

SEQ ID NO: 5985 - protein, 133 aa, Cucurbita pepo
MPFKRYVEIGRVALVNYGEDYGKLVVIVDVIDQNRALVDAPDMERSQMNFKRLSLTDIKIDIKRVPKKKELIEAMKAGDVQKKWEDSSWGRKLIVKKRRASLNDFDRFKLMLAKIKRAGLVRQELSKLKKAEA

SEQ ID NO: 5986 - protein, 65 aa, Cucurbita pepo
MKVQASEADIKQTNKQIENRRHMQLYSLHLDVQNSMHFRSNPNSQVLEKQKGEQSTTFKLISNKI

SEQ ID NO: 5987 - protein, 133 aa, Cucurbita pepo
MPFKRYVEIGRVALVNYGEDYGKLVVIVDVIDQNRALVDAPDMVRSQMNFKRLSLTDIKIDIKRVPRKKELIEAMKAADVQKKWEDSSWGRKLLVKKRRASLNDFDRFKLMLAKIKRAGLVRQELAKLKKSES

SEQ ID NO: 5988 - protein, 109 aa, Cucurbita pepo
MPFKRYVEIGRVALVNYGEDYGKLVVIVDVIDQNRALVDAPDMVRSQMNFKRLSLTDIKIDIKRVPRKKELIEAMKGADVQKSGRIALGGENCLSRKGGQLLMILIGSS

SEQ ID NO: 5989 - protein, 133 aa, Scabiosa columbaria
MPFKRYVEIGRVALVNYGKDYGKLVVIVDVIDQNRALVDSPDMVRCQMNFKRLTLTDITIDIKRTPKKKVLIEAMEAADVKNKWENSSWGRKFIVQKRRAALTDFDRFKLMLAKIKKASLVRQELAKLKKETA

SEQ ID NO: 5990 - protein, 134 aa, Scabiosa columbaria
MPFKRFVEIGRVALVNYGEDYGKLVVIVDVIDQNRALVDSPDMVRCQMNFKRLTLTDIVIDIKRTPKKKALLEAMEAADVKNKWENSSWGRKFIVQKRRAALTDFDRFKLMLAKIKKASLVRQELAKLKKETAA

SEQ ID NO: 5991 - protein, 133 aa, Scabiosa columbaria
MPFKRYVEIGRVALVNYGKDYGKLVVIVDVIDQNRALVDSPDMVRCQMNFKRLTLTDITIDIKRTPKKKVLIEAMEAADVKNKWENSSWGRKFIVQKRRAALTDFDRFKLMLAKIKKASLVRQELAKLKKESA

SEQ ID NO: 5992 - protein, 133 aa, Vinca minor
MPFKRYVEIGRVALVNYGEDYGKLVVIVDVIDQNRALVDSPDMVRSQMNFKRLALTDIKIDIKRIPNKKSLVAAMEAADVKNKWENSSWGRKLIVQKKRASLNDFDRFKLMLAKIKKAGVVRQELSKLKKQAA

SEQ ID NO: 5993 - protein, 136 aa, Triticum aestivum
MPFKRFVEIGRVALVNYGEDYGRLVVIVDVVDQNRALVDAPDMVRCQVNFKRLSLTDIKIDIKRVPKKTALIKAMEEADVKTKWENSSWGKKLIVQKRRASLNDFDRSKHAGEDKKGGAIKQDSPTEEAPRLKDPF

SEQ ID NO: 5994 - protein, 89 aa, Sorghum bicolor
MRRREQDRLARMDADYQKRKEMAEFELRREERIKAAEERTAKKRLKRQKKKQRKKEKRAKTGNNGGEDPNRVDSSDDDEGSDDDDKSKQ

SEQ ID NO: 5995 - protein, 177 aa, Zea mays
MSAPNSDSNMQQLVPIAPPGKASGGDSGKELVVADPAGKRSGGVKLREDEEDLEVKLRRIMENVPVRVSNTSGSSAGSGSGDFHQYRQMRRREQDRLARMDADYQKRKEIAEFELRREERMKAAEERTAKKRLKRQKKKQRKKEKRAKTGDNGGEEPNRVESSDDDEGSDDDDKSKQ

SEQ ID NO: 5996 - protein, 177 aa, Zea mays
MSAPNSDSNMQQLVPIAPPGKASGGDSEKGLVVVDLAGKRSGGVKLREDEEDLEVKLRRIMENVPVRVSNTSGSSAGSGSGDFHQYRQMRRREQDRLARMDADYQKRKKMAEFELRREERMKAAEERTAKKRLKRQKKKQRKKEKRAKTGNNGGDEPNRVESSDDDHGSDDDDESKQ

SEQ ID NO: 5997 - protein, 177 aa, Panicum virgatum
MATPNRDSNMQQLVPIAPPGKASGSDTGKELVVVDPAGKGSGGVKLREDEEDLEVKLRRIMENVPVRVSNTSGSSAGSGSGDFHQYRQMRRREQDRLARMDADYQKRKEMAEFELRREERLKAAEERTAKKRLKRQKKKQRKKEKRTKTGNGGEEPNRVESSDDDEGSDDDDGKSKQ

SEQ ID NO: 5998 - protein, 176 aa, Panicum virgatum
MATPNRDSNMQQLVPIAPPGKASGSDTGKELVVVDPAGKGSGGVKLREDEEDLEVKLRRIMENVPVRVSNTSGSSAGSGSGDFHQYRQMRRREQDRLARMDADYQKRKELAEFELRREERLKAAEERTAKKRLKRQKKKQRKKEKRTKTGNGGEEPNRVESSDDDEGSDDDGESKQ

SEQ ID NO: 5999 - protein, 176 aa, Setaria italica
MTTPSRDSNMQQLVPIAPPGKASGSDTGKELVVVDPAGKGSGGVKLREDEEDLEVKLRRIMENVPVRVSNTSGSSAGSGSGDFHQYRQMRRREQDRLSRMDADYQKRKEMAEFELRREERLKAAEERTAKKRLKRQKKKQRKKEKRTKTSNGGEEPNRVESSDDEEGSDDDDKSKQ

SEQ ID NO: 6000 - protein, 90 aa, Setaria italica
MTTPSRDSNMQQLVPIAPPGKASGSDTGKELVVVDPAGKGSGGVKLREDEEDLEVKLRRIMENVPVRVSNTSGSSAGSGSGDFHQVSIGK

SEQ ID NO: 6001 - protein, 179 aa, Sorghum bicolor
MSALNSDSNMQQLVPIAPPGEASCGGDSGKELVVVDPAGKSSGGVKLREDEEELEVKLRRIMENAPVRVSNTSGSSAGSGSGDFHQYRQMRRREQDRIARMDADYQKRKEMAEYELRRVERLKAAEERTAKKRLKRQKQKQRKKEKRAKTDNNGGEKPNRVESSDEDEGSDDDDGKSTR

SEQ ID NO: 6002 - protein, 175 aa, Setaria italica
MTTHSRDSNMQQLVPIAPPGKASGSDTGKELVLVDPAGKGSGGVKLREDEEDLEVKLRRIMENVPVRVSNTSGSSAGSGSGDFHQYRQMRRREQDRLARMDADYQKRKEMALFEMRKEERLKAAEERTAKKRLKRQKKQRKKEKRTKTSNGGEESNRMESSDDDEGSDDDEKLKQ

SEQ ID NO: 6003 - protein, 187 aa, Pennisetum glaucum
MTTPDRDSNMQQLVPIAPPGKVSGGDSGKEIVVVDPAGKGSGGVKLREDEEDLEVKLRRIMENVPVRVSNTSGSSAGSGSGDFHQYRQMRRREQDRIARMDADYQKRKEMAEFELRREERLKAAEERTAKKRLKRQKKKQRKKEKRTKTSNGGEEPNRVEPGGEEPKGVESSDDDEGSDVDDKSKQR

SEQ ID NO: 6004 - protein, 175 aa, Oryza sativa
MSDPGRDSNMQQLIPIAPPPKASSGTTGKELVVVDGTGKASGGVKLREDEEDLEVKLRRIMENVPVRVSNTSGSSAGSGSGDFHQYRQMRRREQDRLARMDADYQKRKQMAEFELRREERLKEAEERTAKKRLKRQKKKQRKKEKKRSKTNNGGEQPNGGESSGGDEDSDDEDKP

SEQ ID NO: 6005 - protein, 170 aa, Pseudoroegneria spicata
MLASPALAGATHSFPAFASGSRSIHLPSASAPSHSPARRAALVVLAKAKVSTPNADRIARHDRLRKKVSGTTERPRLSVFRSNKHLYAQVIDDTKSCTLASASTMHKSLSKELEYSAGPTTEVAQKIGEVIAKSCLEKGITKVVFDRGGFLYHGRIKALADAARENGLEF

SEQ ID NO: 6006 - protein, 170 aa, Triticum aestivum
MLASPALAGATHSFPAFVSGSRGIHLPSVSAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6007 - protein, 170 aa, Triticum aestivum
MLASPALAGATHSFPAFVSGSRGVHLPSASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6008 - protein, 170 aa, Secale cereale
MLASPALAGATHSFPAFVSGSRGVHLASASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6009 - protein, 170 aa, Triticum aestivum
MLASPALAGATHSFPAFVSGSRGVHLPCASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6010 - protein, 170 aa, Secale cereale
  misc_feature (4)..(5): Xaa can be any naturally occurring amino acid
MLAXXALAGATHSFPAFVSGSRGVHLASASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6011 - protein, 167 aa, Avena sativa
MLASPALAGATHSFPAFVSGNHLPSAYAPSHSPARRAALVVLAKAKVSTPQADRIARHVRLRKKVSGTTERPRLSVFRSNKHLYAQVIDDTKSCTLASASTMHKSLSKELEYSAGPTTEVAQKIGEVIAKSCLEKGITKVVFDRGGFLYHGRIKALADAARENGLEF

SEQ ID NO: 6012 - protein, 183 aa, Secale cereale
VRRRTPATSRAAQVSHASLAGARRRHPLLPGLRIGQPRRSPRVRLRALALAGAAGRPGRPRQGQVRSRCDASPHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 6013 - protein, 169 aa, Setaria italica
MLASPALAGAHSFAASVSGNLRIPLPSVPAPSPTPARRAALSVVAKVKVSTPQDDRIARHVRLRKKVSGTTERPRLSVFRSNKHLYAQVIDDTKQCTLASASTMHKSLSKELEYSAGPTIEVAQKIGEVIAKSCLEKGITKVVFDRGGFLYHGRIKALADAAREHGLEF

SEQ ID NO: 6014 - protein, 169 aa, Brachypodium distachyon
MLASPALAGAHSIPAFMSGNLGVRMPAISALPHSPARRSTLVVVAKAKVSTPQADRIARHVRLRKKVSGTTERPRLSVFRSNKHLYAQVIDDTKSCTVASASTMHKSLSKDLEYSAGPTTEVAQKIGEVIAKSCLEKGITKVVFDRGGFLYHGRIKALADAARENGLEF

SEQ ID NO: 6015 - protein, 169 aa, Panicum virgatum
MLASPALAGAHSFAASVSGSLRVPLPSVPAPSPTPARRAALSVVAKVKVPTPQDDRIARHVRLRKKVSGTTERPRLSVFRSNKHLYAQVIDDTKQCTLASASTMHKSLSKELEYSAGPTIEVAQKIGEVIAKSCLEKGITKVVFDRGGFLYHGRIKALADAAREHGLEF

SEQ ID NO: 6016 - protein, 169 aa, Panicum virgatum
MLASPALTGAHSFAASVPGSLSIPLPSVPAPSPTPARRAVLSVVAKVKVPTPQDDRIARHVRLRKKVSGTTERPRLSVFRSNKHLYAQVIDDTKQCTLASASTMHKSLSKELEYSAGPTIEVAQKIGEVIAKSCLEKGITKVVFDRGGFLYHGRIKALADAAREHGLEF

SEQ ID NO: 6017 - protein, 170 aa, Oryza sativa
MLASPALAGARAFAATVSGSLGIPIPAISAPSPSQARRRASLVVVAKVKVSTPQADRIARHVRLRKKVSGTTERPRLSVFRSNKHLYAQVIDDTKSCTLVSASTMHKSLSKDLEYSAGPTVEVAQKIGEVIAKSCLEKGITKVVFDRGGFLYHGRIKALADAARENGLDF

SEQ ID NO: 6018 - protein, 169 aa, Cynodon dactylon
MLASPALAGAHSFSASVSGSLSVPLPCISAPSPVPARRASLSVVAKVKVSTPQADRIARHTRLRKKVNGTTERPRLSVFRSNKHLYAQVIDDTKQCTLASASTMHKSLSQEFEYSAGPTIEIAQKIGEVIAKSCLEKGITKVVFDRGGFLYHGRIKALADAAREHGLEF

SEQ ID NO: 6019 - protein, 163 aa, Secale cereale
MLASPALAGATHSFPAFVSGSRGVHLPSASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRRGFPLPWPHQSSSRCC

SEQ ID NO: 6020 - protein, 151 aa, Secale cereale
MLASPALAGATHSFPAFVSGSRGVHLASASAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRRGFL

SEQ ID NO: 6021 - protein, 169 aa, Eragrostis curvula
  misc_feature (16)..(16): Xaa can be any naturally occurring amino acid
  misc_feature (23)..(23): Xaa can be any naturally occurring amino acid
  misc_feature (57)..(57): Xaa can be any naturally occurring amino acid
  misc_feature (86)..(86): Xaa can be any naturally occurring amino acid
MLASPALAGAHSFAAXVSGSLRXPLPSIPAPSPAPARRAALSVVAKVKVSTPQADRXARHTRLRKKVNGTTERPRLSVFRSNKHLXAQVIDDTKQCTLASASTMHKSLSKEFDYSAGPTIEIAQKIGEVIAKSCLEKGITKVVFDRGGFLYHGRIKALADAAREHGLEF

SEQ ID NO: 6022 - protein, 165 aa, Saccharum officinarum
MLASPALAGAHSFAASVSGNLLIPLPSIPAPARRPALSVVAKVKVSTPQDDRIARHVRLRKKVSGTTERPRLSVFRSNKHLYAQVIDDTKQCTLASASTMHKTLSKELEYSAGPTIEIAQKIGEVIAKSCLEKGITKVVFDRGGFLYHGRIKALADSAREHGLEF

SEQ ID NO: 6023 - protein, 165 aa, Sorghum bicolor
MLASPALTGAHSFAASVSGNLLVTLPSVPAPARRAALSVVAKVKVSTPQDDRIARHARLRKKVSGTTERPRLSVFRSNKHLYAQVIDDTKQCTLASASTMHKTLSKELEYSAGPTIEIAQKIGEVIAKSCLEKGITKVVFDRGGFLYHGRIKALADSAREHGLEF

SEQ ID NO: 6024 - protein, 165 aa, Zea mays
MLASPALAGAHSFAASVYGNILVPSPPVPAPARRAALSVVAKVKVATPQDDRIARHVRLRKKVSGTTERPRLSVFRSNKHLYAQVIDDTKQCTLASASTMHKSLSKEFEYSAGPTIEIAQKIGEVIAKSCLEKGITKVVFDRGGFLYHGRIKALADSAREHGLEF

SEQ ID NO: 6025 - protein, 142 aa, Festuca arundinacea
AYAPSHSPARRASLVVLAKAKVSTPQADRIARHVRLRKKVSGTTERPRLSVFRSNKHLYAQVIDDTKSCTLASASTMHKSLSKDLEYSAGPTTEVAQKIGEVIAKSCLEKGITKVVFDRGGFLYHGRIKALADAARENGLEF

SEQ ID NO: 6026 - protein, 103 aa, Triticum aestivum
MSTVTRAYLDQRLAAAKRCSREAAMAGAKAAAVATVAAAVPTLASVRMLPWAKAHLNPTGQALIISTVAGMAYFIVADKTILSMARKHSFDDAPDHLKNTSFH

SEQ ID NO: 6027 - protein, 103 aa, Hordeum vulgare
MSTVTRAYLDQRLAAAKRCSREAAMAGAKAAAVATVAAAVPTLASVRMLPWAKAHLNPTGQALIISTVAGMAYFIVADKTILSMARKHSFQDAPEHLKNTSFH

SEQ ID NO: 6028 - protein, 103 aa, Secale cereale
MSTVTRAYLDQRLAAAKRCSREAAMAGAKAAAVATVAAAVPTLASVRMLPWAKAHLNPTGQALIISTVAGMAYFIVADKTILSMARKHSFDDAPDHLKDTSFH

SEQ ID NO: 6029 - protein, 103 aa, Triticum aestivum
MSTVTRAYLDQRLAAAKRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 6030 - protein, 103 aa, Triticum aestivum
MSTVTRAYLDQRLAAAKRCSKEAAMAGAKAAAVATVAAAVPTLASVRMLPWAKAHLNPTGQALIISTVAGMAYFIVADKTILSMARKHSFDDAPEHLKNTSFH

SEQ ID NO: 6031 - protein, 103 aa, Secale cereale
MSTVTRAYLDQRLAAAKRCSREAAMAGAKAAAVATVAAAVPTLASVRMLPWAKAHLNPTGQALIISTVAGMAYFIVADKTILSMARKHSFEDAPDHLKDTSFH

SEQ ID NO: 6032 - protein, 103 aa, Secale cereale
MSTVTLAYLDQRLAAAKRCSREAAMAGAKAAAVATVAAAVPTLASVRMLPWARAHLNPTGQALIISTVAGMAYFIVADKTILSMARKHSFDDAPDHLKNTSFH

SEQ ID NO: 6033 - protein, 103 aa, Hordeum vulgare
MSTVTRAYLDQRLAAAKRCSREAAMAGAKAAAVATVAAAVPTLASVRMLPWAKAHLNPTGQALIISTVAGMAYFIVADKTILSLARKHSFQDAPEHLKNTSFH

SEQ ID NO: 6034 - protein, 103 aa, Triticum aestivum
MWTVTRAYLDQRLAAAKRCSREAAMAGAKAAAVATVAAAVPTLASVRMLPWARAHLNPTGQALIISTVAGMAYFIVADKTILSMARKHSFDDAPDHLKNTSFH

SEQ ID NO: 6035 - protein, 103 aa, Triticum aestivum
MSTVTRAYLDQRLAAAKRCSREAAMAGAKAAAVATVAAAVPTLASVRMLPWAKANLNPTGQALIISTVAGMAYFIVADKTILSMARKHSFDDAPDHLKNTSFQ

SEQ ID NO: 6036 - protein, 103 aa, Triticum aestivum
MSTVTRAYLDQRLAAAKRCSREAAVAGAKAAAVATVAAAVPTLASVRMLPWAKAHINPTGQALIISTVAGMAYFIVADKTILSMARKHSFDEAPDHLKNTSFH

SEQ ID NO: 6037 - protein, 103 aa, Triticum aestivum
MSTVTRAYLDQRLAAAKRCSKEAAMAGAKAAAVATVAAAVPTLASVRMLPWAKAHLNPTGQALIISTVAGMAYFIVADKTILSMARKHSFEDAPEHLKNTSFH

SEQ ID NO: 6038 - protein, 91 aa, Secale cereale
MSTVTGAYLDQRLAAAKRCSREAAMAGAKAAAVATVAAAVPTLASVRMLPWAKAHLEPNRAGPHHLHRRRDGLLHRRRQDHPFHGQKALIR

SEQ ID NO: 6039 - protein, 103 aa, Secale cereale
MSTVTRAYLDQRLAAAKRCSREAAMAGAKAAAVATIAAAVPTLASVRMLPWAKAHLNPTGQALIISTVAGMAYFIVADKTILSMARKHSFEDAPDHLKDTSFH

SEQ ID NO: 6040 - protein, 103 aa, Secale cereale
MSTVTRAYLDQRLAAAKRCSREAAMAGAKAAAVATVAAAVPTLASVRMLPWARAHLNPTGQALIISTVAGMAYFIVADKTILAMARKHSFEDAPDHLKNTSFH

SEQ ID NO: 6041 - protein, 79 aa, Secale cereale
MAGAKAAAVATVAAAVPTLASVRMLPWAKAHLNPTGQALIISTVAGMAYFIVADKTILSMARKHSFEDAPDHLKDTSFH

SEQ ID NO: 6042 - protein, 79 aa, Hordeum vulgare
MAGAKAAAVATVAAAVPTLASVRMLPWAKAHLNPAGQALIISTVAGMAYFIVADKTILSMARKHSFQDAPEHLKNTSFH

SEQ ID NO: 6043 - protein, 103 aa, Hordeum vulgare
MSTVTRAYLDQRLAAANRCSREAAMAGAKAAAVATVAAAVPTLASVRMLPWARAHLNPTGQALIISTVAGMAYFIVADKTILSMARKHSFQDAPDHLKNTSFH

SEQ ID NO: 6044 - protein, 103 aa, Triticum aestivum
MSTVTRAYLDQRLAAAKRCSKEAAMAGAKAAAVATVAAAVPTLASVRMLPWAKAHLNPTGQALIISTVAGMAYFIVADKTILSMARKHSFEDAPEHLRNTSFH

SEQ ID NO: 6045 - protein, 103 aa, Triticum aestivum
MSTVTGAHLDQRLAAAKRCSREAAMAGAKAAAVATVAAAVPTLASVRMLPWAKTHLNPAGQALIISTVAGMAYFIVADKTILSMARKHSFEDAPDHLKNTSFH

SEQ ID NO: 6046 - protein, 103 aa, Triticum aestivum
MPTVTRAYLDQRLAAANRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 6047 - protein, 107 aa, Secale cereale
MSTVTGAYLDQRLAAAKRCSREAAMAGAKAAAVATVAAAVPTLASVRMLPWAKAHSQPHRAGAHHLHRRRDGLLHRCRQDHPLHGKEALLRGRAGPPQGHLLPLIRL

SEQ ID NO: 6048 - protein, 103 aa, Secale cereale
MSTVTRAYLDQRLAAAKRCSKEAAMAGAKAAAVATVAAAVPTLASVRMLPWAKAHINPTGQALIISTVAGMAYFIVADKTILSMARKHSFEDAPDHLKDTSFH

SEQ ID NO: 6049 - protein, 103 aa, Triticum aestivum
MSTVTPAYLDQRLAAAKRSSREAAMAGAKAAAVATVAAAIPTLASVRMLPWARAHLNPTGQALIISTVAGMAYFIVADKTILSMARKHSFDDAPEHLKNTSFH

SEQ ID NO: 6050 - protein, 103 aa, Triticum aestivum
MSTVTRAYLDQRLAAAKRCSKEAAMAGAKAAAVATVAAAVPTLASVRMLPWAKAHLNPTGQALIISTVAGMAYFIVADKTILSMARKHSYETAPEHLKNTSFN

SEQ ID NO: 6051 - protein, 103 aa, Triticum aestivum
MSTVTPAYLDQRLTAAKRCSREAAIAGAKAAAVATVAAAVPTLASVRMLPWAKAHLNPTGQALIISTVAGMAYFIVADKTILSMARKHSFLDAPDHLKNTSFH

SEQ ID NO: 6052 - protein, 103 aa, Triticum aestivum
MSTVTRANLDQRLAAANRCSREAAMAGAKAAAVATVAAAVPTLASVRMLPWARAHLNPTGQALIISTVAGMAYFIVADKTILSMARRHSFDDAPEHLKNTSFH

SEQ ID NO: 6053 - protein, 103 aa, Triticum aestivum
MSTVTRAYLDQRLAAAKRCSREAAMAGAKAAAVATVAAAVPTLASVRMLPWARAHLNPTGQALIISTVAGMAYFIVADKTILSMARKHSYEDAPEHLKNTSFN

SEQ ID NO: 6054 - protein, 106 aa, Festuca arundinacea
MSTVTRAYLDQRLAMAKRCSREAAMAGAKAAAVATVAAAVPTLASVRMLPWAKAHLNPAGQALIISTVAGMAYFIVADKTILSMARKHSFEGAPEHLKNTSFQYRL

SEQ ID NO: 6055 - protein, 103 aa, Secale cereale
MSTVTGAYLDQRLAAAKRCSREAAMAGAKAAAVATVAAAVPTLASVRMLPWARAHLNPTGQALIISTVAGMAYFIVADKTILSMARKHSFEDAPDHLKDTSLH

SEQ ID NO: 6056 - protein, 103 aa, Secale cereale
MSTVTRAYLDQRLAAAKRCSKEAAMAGAKAAAVATVAAAVPTLASVRMLPWAKAHINPTGQALIISTVAGMAYFIVADKTILSMARKNSFEDAPDHLKDTSFH

SEQ ID NO: 6057 - protein, 103 aa, Triticum aestivum
MSTVTRAYLDQRLALANRCSREAAMAGAKAAAVATVAAAVPTLASVRMLPWARAHLNPTGQALIISTIAGMAYFIVADKTILSMARKHSFDDAPDHLKNTSFN

SEQ ID NO: 6058 - protein, 103 aa, Triticum aestivum
MSTVTRAYLDQRLAAANRCSREAAMAGAKAAAVAAVAAAVPTLASVRMLPWARAHLNPTGQALIISTVAGMAYFIVADKTILSMARKHSFEDAPDHLKNTSFN

SEQ ID NO: 6059 - protein, 106 aa, Lolium multiflorum
MSTVTRAYLDQRLAMAKRCSREAAMAGAKAAAVATVAAAVPTLASVRMLPWAKAHLNPAGQALIISTVAGMAYFIVADKAILSMARKHSFEGAPEHLKNTSFQYRL

SEQ ID NO: 6060 - protein, 105 aa, Triticum aestivum
MSTVTRAYLDQRLAAAKRCSKEATMAGAKAAAVATVAAAVPTLASVRMLPWAKAHLNPTGQALIISTVAGMAYFIVADKTILSMAMARRHSFEDAPEHLKNTSFH

SEQ ID NO: 6061 - protein, 102 aa, Hordeum vulgare
MSTVTRAYLDQRLAAADRCSREAAMAGAKAAAVATVAAAVPTLASVRMLPWARAHLNPTGQALIISTVAGMAYFIVADKAILSMARKHSFEDAPDHLKNTSL

SEQ ID NO: 6062 - protein, 103 aa, Secale cereale
MCTVTRAYLDQRLAAAKRCSKEAAMAGAKAAAVATVATAVPTLASVRMLPWAKAHINPTGQALIISTVAGMAYFIVADKTILSMARKHSFEDAPDHLKDTSFH

SEQ ID NO: 6063 - protein, 103 aa, Secale cereale
MSTVTRAYLDQRLAAAKRCSKEAAMAGAKAAAVATVTAAVPTLASVRMLPWAKAHSQPTGQALIISTVAGMAYFIVADKTILSMARKHSFEDAPDHLKDTSFH

SEQ ID NO: 6064 - protein, 103 aa, Secale cereale
MSTVTGAYLDQRLAATKRCSREAAMAGAKAAAVATVAAAVPTLTSVRMLPWARAHLNPTGQALIISTVAGMAYFIVADKTILSMARKHSFEDAPDHLKDTSFH

SEQ ID NO: 6065 - protein, 103 aa, Triticum aestivum
MPTVTRAYLDQRLAVANRCSKEAAMAGAKAAAVATVAAAVPTLASARMLPWARAHLNPTGQALIISTVAGMAYFIVADKTILSMARKHSFQNAPDHLKNTSFH

SEQ ID NO: 6066 - protein, 103 aa, Triticum aestivum
MCTVTRAHLDQRLAAAKRCSREAAIAGAKAAAVATVATAVPTLASVRMLPWARAHLNPTGQALIISTVAGMAYFIVADKTIVSMARKHSYEDAPEHLKNTSFH

SEQ ID NO: 6067 - protein, 103 aa, Triticum aestivum
MSTVTRAYLDQRLAAAKRCSKEAAMAGVKAAAVATVAAAVPTLASVRMLPWVRAHLNPTGQALIISTVAGMAYFIVADKTILSMARKHSHEMAPEHLKNTSFH

SEQ ID NO: 6068 - protein, 103 aa, Triticum aestivum
MSTVTRAYLDQRLAAANRCSREAAMAGAKAAAVASVAAAVPTLASVRMLPWARAHLNPTGQALIISTVAGMAYFIVADKTILSMARKHSFEDALDHLKNTSFN

SEQ ID NO: 6069 - protein, 103 aa, Triticum aestivum
MSTVTRSYLDQRLAAAQRCSKEAAMAGAKAAAVATVAAAVPTLASVRMLPWARAHLNPTGQALIISTVAGMAYFIVADKTILSMARKHSYETAPEHLKNTSFH

SEQ ID NO: 6070 - protein, 103 aa, Triticum aestivum
MSTVTRAYLDQRLAAANRCSKEAAMAGAKAAAVASVAAAVPTLASVRMLPWARAHLNPTGQALIISTVAGMAYFIVADKTILSMARKHSFEDAPDHLKNTSFN

SEQ ID NO: 6071 - protein, 103 aa, Secale cereale
MSTVTLAYLDQRLAVAKRCSREAAMAGAKAAAVATVAAVVPTLASVRMLPWARAHLNPTGQALIISTVAGMAYFIVADKTIVSMTRSTPLRTRRTTSRTPPST

SEQ ID NO: 6072 - protein, 108 aa, Secale cereale
MSTVTRAYLDQRLAVAKRCSREAAMAGAKAAAVATVAAAVPTLAIVRMLPWARAHLNPTGQALIISTVAGMAYFIVADKTILSMARKHSFDDAPDHLKNTSFHYWTLD

SEQ ID NO: 6073 - protein, 78 aa, Triticum aestivum
MSTVSCAYLDQRLAAANRCSEEAAMAGAKAAAVATIAAAVPTATGEREDAAVGEGAPEPDRAGPDHLHRRRDGLLHRR

SEQ ID NO: 6074 - protein, 121 aa, Brachypodium distachyon
MSTTVSRAYLDQRLAAAKRCSKEAAMAGAKAAAVATVAAAVPTLASVRMLPWARAHLNPTGQALIISTVAGMAYFIVADKTILSMARKHSFEEAPEHLKDTSFKSAGAPPASTRPWAFFRH

SEQ ID NO: 6075 - protein, 82 aa, Leymus cinereus x Leymus triticoides
MAGAKAAVVATVAAAVPTLASVRMLPWAKAHLNPTGQALIISTVAGMAYFIVADKTILSMARKHSFQDAPEHLKNTVADKTV

SEQ ID NO: 6076 - protein, 141 aa, Triticum aestivum
MSTVSCAYLDQRLAAANRCSEEAAMAGAKAAAVATIAAAVPTATGEREDAAMGEGAPEPDRAGAHHLHRRRDGLLHHRRQDHPLNGQEALLRGRARPPQEHLLPLVRSIISNPSKPCAPKCIAYSDQQGRSGMLLDSLVLR

SEQ ID NO: 6077 - protein, 75 aa, Secale cereale
MSTVPPAYHDQKLAAAKRCAREAALAGAKAAAIAAVAAAVPTLLSVRMLPWAKAHINQLARRSSSRPSPGWPTSS

SEQ ID NO: 6078 - protein, 115 aa, Pennisetum glaucum
MSTVTRAYLDQRLAVAKRCSREATLAGAKAAAVATVASAVPTLASVRMLPWAKANLNPTGQALIICTVAGMAYFVAADKKILSLARRHSFEEAPEHLKNTSYQGAARPHPAFFSP

SEQ ID NO: 6079 - protein, 115 aa, Oryza sativa
MSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPHPAFFRP

SEQ ID NO: 6080 - protein, 94 aa, Secale cereale
DQRLAAAERCSREAAMAGAKAAAVATVAAAVPTLASVRMLPWARAHLNPAGQALIISTVAGMAYFIVADKTILAMARSIRRRRAGPPQEHLLTN

SEQ ID NO: 6081 - protein, 115 aa, Oryza sativa
MSTVTRAYLDQKLALAKRCSREATLAGAKAAAVATVASAVPTLASVRMLPWAKANINPTGQALIICTAAGMAYFVAADKKILSLARRHSFENAPEHLKNTSFQGTGHPHPAFFRP

SEQ ID NO: 6082 - protein, 115 aa, Sorghum bicolor
MSTVSRASLDQKLALAKRCSREATMAGFKAAAVATVASAVPTLASVRMLPWAKANINPTGQALIISTVAGMAYFIAADKKILSLARRHSFENAPEHLKNTSYQGTGRPHPAFFRP

SEQ ID NO: 6083 - protein, 115 aa, Saccharum officinarum
MSTVSRASLDQKLALAKRCSREATLAGFKAAAVATVASAVPTLASVRMLPWAKANINPTGQALIISTVAGMAYFIAADKKILSMARKHSFEGAPEHLKNTSYQGTGRPHPAFFRP

SEQ ID NO: 6084 - protein, 115 aa, Setaria italica
MSTVTRAYLDQRLAMAKRCSREATLAGAKAAAVATVASAVPTLASVRMLPWAKANLNPTGQALIICTVAGMAYFVATDKKILSLARRHSFEEAPEHLRNTSYQGAARPHPAFFRP

SEQ ID NO: 6085 - protein, 115 aa, Sorghum bicolor
MSTVSRASLDQKLALAKRCSREATLAGAKAAAVATVASAIPTLASVRMLPWAKANINPTGQALIISTVAGMAYFIAADKKILSLARQHSFENAPERLKNTSFQATGRPHPAFFRP

SEQ ID NO: 6086 - protein, 417 aa, Triticum aestivum
MQMAAATTDAPVAAAPHPHPHAHGPQVPHGHGHPHPHHHMPQPRWVVLPYPPPPPMVAAPPPPTPQYVKHFAPQASVTPPPPSAGSGGNGGDENRTIWVGDLQYWMDENYLHSCFGPSGEVVTIKVIRNRHSGVSEGYGFVEFCSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHAMTEMNGVYCSTRPIRIGPATPRRTSGDSGTSPPTQSDGDSTNRTVYVGGLDPNVSEDELRKAFAKYGDVASVKIPVGKQCGFVQFVNRADAEEALQGLSGSTIGKQAVRLSWGRSPASKQSRGDSGHRRNGMYYGTPFYGGYGYGSPVPHPNVYAAAYGAYPFYGNQQLVS

SEQ ID NO: 6087 - protein, 417 aa, Triticum aestivum
MQMAAATIDAPVAAAPHPHPHAHGPQVPHGHGHPHPHHHMPQPRWVVLPYPPPPPMVAAPPPPTPQYVKHFAPQASVTPPPPSAGSGGNGGDENRTIWVGDLQYWMDENYLHSCFGPSGEVVTIKVIRNRHSGVSEGYGFVEFCSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHAMTEMNGVYCSTRPIRIGPATPRRTSGDSGTSPPTQSDGDSTNRTVYVGGLDPNVSEDELRKAFAKYGDVASVKIPVGKQCGFVQFVNRADAEEALQGLSGLTIGKQAVRLSWGRSPASKQSRGDSGHRRNGMYYGTPFYGGYGYGSPVPHPNVYAAAYGAYPFYGNQQLVS

SEQ ID NO: 6088 - protein, 419 aa, Triticum aestivum
MQMAAATIDAPVAAAPHPHPHAHGPQVPHGHGHPHPHHHMPQPRWVVLPYPPPPPMVAAPPPPTPQYVKHFAPQASVTPPPPSTGSGGNGGDENRTIWVGDLQYWMDENYLHSCFGPSGEVVTIKVIRNRHSGVSEGYGFVEFCSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHAMTEMNGVYCSTRPIRIGPATPRRTSVSGDFGTSPPTQSDGDSTNRTVYVGGLDPNVSEDELRKAFAKYGDVASVKIPVGKQCGFVQFVNRADAEEALQGLSGLTIGKQAVRLSWGRSPASKQSRGDSGHRRNGMYYGTPFYGGYGYTSPVPHPNVYAAAYGAYPFYGNQQLVS

SEQ ID NO: 6089 - protein, 412 aa, Secale cereale
MQMAAATTDAPHAHPHAHGPQVPHGHEHPHPHHHMPQPRWVVLPYPPPPPMVVAPPPPTPQYVKHFAPQASVTPPPPSSGSGGNGGDGNRTIWVGDLQYWMDENYLHSCFGPSGEVVTIKVIRNRHSGVSEGYGFVEFCSHASAEKALQNFAGHVMPNTERAFKLNWASYSVGEKRSELASDHSIFVGDLAVDVTDDMLMELFANKYRSVKGAKVIIDANTGRSRGYGFVRFGDDIDRTHAMTEMNGVYCSTRPIRIGPATPRRTSGDSGTSPPTQSDGDSTNRTVYVGGLDPNVSEDELRKAFAKYGDVASVKIPVGKQCGFVQFVNRADAEEALQGLSGSTIGKQAVRLSWGRSPASKQFRGDSGHRRNGMYYGTPFYGGYGYASPVPHPNVYAAAYGAYPFYGNQQLVS

SEQ ID NO: 6090 - protein, 421 aa, Brachypodium distachyon
MQMAAATPDAPAAAAAPHPHPHVHGPPQPHGHGHAHPHPHHHMPQPRWVVIPYPPPPPMVAAPPPPPPQYVKHFAPPASVTPPPPSGGGSGGNGGDDNRTIWVGDLQYWMDENYLHSCFGPSGEVVTIKVIRNRHSGVSEGYGFVEFYSHASAEKALQNFAGHVMPNTDRAFKLNWASYSVGEKRSELASDHSIFVGDLAVDVTDDMLMELFANKYRSVKGAKVIIDANTGRSRGYGFVRFGDDNDRTHAMTEMNGVYCSTRPIRIGPATPRRTSGDSGSSPPRQSDGDLTNRTVYVGGLDPNVSEDELRKTFAKYGDVASVKIPVGKQCGFVQFVNRADAEEALQALSGSTIGKQAVRLSWGRSPASKQPRGDSGHRRNGMYYGTPFYGGYGYASPVPHPNMYAAAYGAYPFYGNQQLVS

SEQ ID NO: 6091 - protein, 428 aa, Setaria italica
MQMAAAAAPTDAPAAAAAAAPHHHPHAHAAAAPPHPHAHAPHPHHHMPQPRWVVIPYPPPHHPMVAAPPPPPPQFVKHFAPPASVTPPPPPSAGSGGNGGEDNRTIWVGDLQYWMDENYLHSCFGPSGEVVTIKVIRNRHSGVSEGYGFVEFYSHASAEKALQNFSGHVMPNTDRAFKLNWASYSMGEKRSELASDHSIFVGDLAVDVTDDMLLDLFSSKYRSVKGAKVIIDANTGRSRGYGFVRFGDDNDKTHAMTEMNGVYCSTRPIRVGPATPRRSQGDSGSSPPRQSDADSTNRTVYVGGLDPNVSEEELRKAFAKYGDLASVKIPVGKQCGFVQFVNRADAEEALQGLNGSTIGKQAVRLSWGRSPASKQSRGDSGHRRNGNGMYYGTPFYGGYGYASPVPHPNMYAAAYGAYPYYGNQQLVS

SEQ ID NO: 6092 - protein, 435 aa, Pennisetum glaucum
MQMAAAAAPTDAPAAAAVAAPHHHPHAHAAAAAAAPPHPHAHAHAPHPHHHMPQPRWVVIPYPPPHHPMVAAPPPPPPQFVKHFAPPASVTPPPPPSAGSGGNGGEDNRTIWVGDLQYWMDENYLHSCFGPSGEVVTIKVIRNRHSGVSEGYGFVEFYSHASAEKALQNFSGHVMPNTDRAFKLNWASYSMGEKRSEVASDYSIFVGDLAVDVTDDMLLELFSSKYRSVKGAKVIIDANTGRSRGYGFVRFGDDNDKTHAMNEMNGVYCSTRPIRVGPATPRRSQGDSGSSPPRQSDADSTNRTVYVGGLDPSVSEEELRKAFAKYGDLVSVKIPVGKQCGFVQFVNRADAEEALQGLSGSVIGKQAVRLSWGRSPASKQSRGDSGHRRNGNGNGMYYGTPFYGGYGYASPVPHPNMYAAPYGAYPYYGNQQLVS

SEQ ID NO: 6093 - protein, 435 aa, Sorghum bicolor
MQMAAAVAPTDAPASAAAAAPHPHPHPHAAAAAAAAAAASPHPHAPPHPHHHMPQPRWVVIPYPPPHHPMVAAPPPPPPQFVKHFAPPASVTPPPPPAGSGGNGGEDNRTIWVGDLQYWMDENYLHSCFGPSGEVVNIKVIRNRHSGVSEGYGFVEFYSHVSAEKALQNFSGHVMPNTDRAFKLNWASYSMGEKRTELSSDHSIFVGDLAVDVTDEMLLELFSNKYRSVKGAKVIIDANTGRSRGYGFVRFGDDNDKTHAMTEMNGVYCSTRPIRVGPATPRRSQGDSGSSPPRQSDVDSTNRTVYVGGLDPNVSEDELRKAFAKYGDLASVKIPFGKQCGFVQFVNRADAEEALQGLNGATIGKQAVRLSWGRSPASKQSRGDSGHRRNGNGNGMYYGTPFYSGYGYASPVPHPNMYAAAYGAYPYYGNQQLVS

SEQ ID NO: 6094 - protein, 434 aa, Oryza sativa
MQMAAAAAAASTEAPAVAAAAPHHHHPHPHAHGMHPHAHHHIQAQPRWVVIPYPPPHGMVAAAPPPPPPQFVKHFAPPASVTPPPPQQAQQAQAAAAAAGGGSGGGNGDENRTIWVGDLQYWMDEGYLHNCFGPSGEVVTIKVIRNRHSGVSEGYGFVEFFSHASAEKALQNFSGHVMPNTDRAFKLNWASYSMGEKRAELASDHSIFVGDLAVDVTDEMLMDLFAKKYRSVKGAKVIIDANTGRSRGYGFVRFGDDNDKTHAMTEMNGAYCSTRPIRIGPATPRRSSGDSGSSPPRQSDSDSTNRTIYVGGLDPNATEDELRKAFAKYGDLASVKIPVGKQCGFVQFVNRPDAEEALQGLNGSTIGKQAVRLSWGRSPASKQSRGDSGHRRNGMYYGTPFYGGYGYASPLPHPNMYAAAYGAYPYYGNQQLVS

SEQ ID NO: 6095 - protein, 421 aa, Panicum virgatum
MQMAAATTDSQAAVPPHHPHAHPHAPPQHAPPHHHMPQPRWVVIPYPPPPPMVAAPPPPPQFAKHFAAGPPPPPQAAAGRRTPTPPAAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLMELFASKYRSVKGAKVIIDANTSRSRGYGFVRFGDDNDKSHAMSEMNGVYCSTRPIRIGPATPRRSSGDSGSSTPGHSDGDSSNRTVYVGGLDPNVSEDELRKAFAKYGDLASVKIPLGKQCGFVQFVSRTDAEEALQGLNGSVIGKQAVRLSWGRSPSHKQSRGDSGNRRNMYYGTPFYGGYGYASPVPHPNMYAPAYGAYPFYGGNQQLVS

SEQ ID NO: 6096 - protein, 420 aa, Setaria italica
MQMAATTTDSQAAVPPHHPHAHPHAPPQHAHPHHHMPQPRWVVIPYPPPPPMVAAPPPPPQFAKHFAAGPPPPPQAAGRRTPTPPAAGSGGNACEENKTIWVGDLQYWMDENYLHSCFGPSGEVVTIKVIRNRQTGQSEGYGFVEFFSHGSAEKALQNFTGHVMPNTDRAFKLNWASYSMGEKRSEVASDHSIFVGDLAADVTDEMLMELFASKYRSVKGAKVIIDANTGRSRGYGFVRFGDDNDKSHAMSEMNGVYCSTRPIRIGPATPRRSSGDSGSSTPGHSDGDSSNRTVYVGGLDPNVSEDELRKAFAKYGDLASVKIPLGKQCGFVQFVSRTDAEEALQGLNGSVIGKQAVRLSWGRSPSHKQSRGDSGNRRNMYYGTPFYGGYGYASPVPHPNMYAAAYGAYPFYGGNQQLVS

SEQ ID NO: 6097 - protein, 426 aa, Oryza sativa
MQMAATTTTTDSSQAAVPPHHPHPHAHPHPHAHPHPHHPMAQARWVVLPYPPPPPPMVAAPPPPPPQYAKHFAAGPPPAAAAGRRTPTPPAPAGSGGNGCEENKTIWVGDLQYWMDENYLHSCFGPSGEVVTIKVIRNRQTGQSEGYGFVEFYSHGSAEKALQNFTGHVMPNTDRPFKLNWASYSMGEKRSEVASDYSIFVGDLAADVTDEMLMELFANKYRSVKGAKVIIDANTGRSRGYGFVRFGDDNDKSHAMTEMNGAYCSTRPIRIGPATPRRSSGDSGSSTPGHSDGDSTNRTVYVGGLDPNVSEDELRKAFAKYGDVASVKIPLGKQCGFVQFVSRTDAEEALQGLNGSVIGKQAVRLSWGRSPSHKQSRADSGSRRNNMYYGTPFYGGYGYASPVPHPNMYAAAYGAYPVYGSQQLVS

SEQ ID NO: 6098 - protein, 423 aa, Sorghum bicolor
MQMAATTTDSQAAVPPHHPHAHPHVPPQHGHPHHHMPPQPRWVVIPYPPPPPMVAAPPPPPPQFAKHFAAGPPPPPQAAAGRRTPTPPAAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLLELFSSKYRSVKGAKVIIDANTGRSRGYGFVRFGDDNDKSHAMSEMNGVYCSTRPIRIGPATPRRSSGDSGSSTPGHSDGDSSNRTVYVGGLDPNVSEDELRKAFAKYGDLASVKIPLGKQCGFVQFASRTDAEEALQGLNGSLIGKQAVRLSWGRSPSHKQSRGDSGNRRNNMYYGTPFYGGYGYASPVPHPNMYAAAYGAYPMYGNQQLVS

SEQ ID NO: 6099 - protein, 430 aa, Zea mays
MQMAAAVAPTDAPASASAAAAPSRPHAHAAAAVAAASPHPHALHPHHHMPQPRWVVIPYPPPHHPMVAAPPPPSLQFVKHFTPPSSVTPPPPTGSGGNGGEDNRTIWVGDLQYWMDENYLHSCFGSSGEVVNIKVIRNRHSGVSEGYGFIEFYTHVSAEKALQNFSGHVMPNTDRAFKLNWASYSMGEKRSEISSDHSIFVGDLAVDVTDAMLLELFSNKYRSVKGAKVIIDANTGRSRGYGFVRFGDDNDKIHAMTEMNGVYCSTRPIRVGPATPRRSQGDSGTSPPRQSHVDSTNRTVYVGGLDPNVSEDELRKAFAKYGDLASVKIPFGKQCGFVQFVNRVDAEEALHGLNGSTIGKQAVRLSWGRSPASKQSRGDSGHRRNGNCNGMYYGTPFYGGYGYASPIPHPNMYAAAYEAYPYYGNQQLVS

SEQ ID NO: 6100 - protein, 422 aa, Saccharum officinarum
MQMAATTTDSQAAVPPHHPHAHPHVPPQHAHPHHHMPQPRWVVIPYPPPPPMVAAPPPPPPQFAKHFAAGPPPPPQAAAGRRTPTPPLAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLLELFSSKYRSVKGAKVIIDANTGRSRGYGFVRFGDDNDKSHAMSEMNGVYCSTRPIRIGPATPRRSSGDSGSSTPGHSDGDSSNRTVYVGGLDPNVSEDELRKAFAKYGDLASVKIPLGKQCGFVQFVSRTDAEEALQGLNGSLIGKQAVRLSWGRSPSHKQSRGDSGNRRNNMYFGTPFYGGYGYASPVPHPNMYAAAYGAYPMYGNQQLVS

SEQ ID NO: 6101 - protein, 421 aa, Panicum virgatum
MQMAATTTDSQAAVPPHHPHAHPHAPPQHAPPHHHMPQPRWVVIPYPPPPPMVAAPPPPPQFAKHFAAGPPPPPQAAAGRRTPTPPVAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLMELFASKYRSVKGAKVIIDANTGRSRGYGFVRFGDDNDKSHAMSEMNGVYCSTRPIRIGPATPRRSSGDSGSSTPGHSDGDSSNKTVYVGGLDPNVSEDELRKAFAKYGDLASVKIPLGKQCGFVQFVSRTDAEEALQGLNGSVIGKQAVRLSWGRSPSHKQSRGDSGNRRNMYYGTPFYGGYGYASPVPHPNMYAPAYGAYPFYGGNQQLVS

SEQ ID NO: 6102 - protein, 370 aa, Oryza sativa
MVAAPPPPPPQYAKHFAAGPPPAAAAGRRTPTPPAPAGSGGNGCEENKTIWVGDLQYWMDENYLHSCFGPSGEVVTIKVIRNRQTGQSEGYGFVEFYSHGSAEKALQNFTGHVMPNTDRPFKLNWASYSMGEKRSEVASDYSIFVGDLAADVTDEMLMELFANKYRSVKGAKVIIDANTGRSRGYGFVRFGDDNDKSHAMTEMNGAYCSTRPIRIGPATPRRSSGDSGSSTPGHSDGDSTNRTVYVGGLDPNVSEDELRKAFAKYGDVASVKIPLGKQCGFVQFVSRTDAEEALQGLNGSVIGKQAVRLSWGRSPSHKQSRADSGSRRNNMYYGTPFYGGYGYASPVPHPNMYAAAYGAYPVYGSQQLVS

SEQ ID NO: 6103 - protein, 424 aa, Triticum aestivum
MQMAATTTESQVAVPPHHPHAHPHPHPPPHHPHPHHHMPQPRWVVLPYPPPSMVAAPPPPPPQFAKHYAPGPPPPPAAAGRRTPTPPAAGSGGNGCEENKTIWVGDLQYWMDENYLHNCFGPSGEVVTIKVIRNRQTGQSEGYGFVEFFSHASADKALQNFTGHVMPNTDRAFKLNWASYSMGEKRSEVVSDHSIFVGDLAADVTDEMLMELFASKYRSVKGAKVIIDANTGRSRGYGFVRFGDDTDKAHAMTEMNGVYCSTRPIRVGPATPRRTSGDSGSSTPGHSDGDSNNRTVYVGGLDPNVSEDELRKSFAKYGDVASVKIPLGKQCGFVQYVNRTDAEEALQGLNGAVIGKQAVRLSWGRSPSHKQSRGDSGNRRNNNNMYYGTPFYGGYGYASPVPHPNMYAPAYGAYPFYGNQQLVS

SEQ ID NO: 6104 - protein, 382 aa, Panicum virgatum
MPQPRWVVIPYPPPHHPMVAAPPPPPPQFVKHFAPLASVTPPPPQSAGSGGNGAEDNRTIWVGDLQYWMDENYLHSCFGPSGEVVTIKVIRNRHSGVSEGYGFVEFYSHASAEKALQNFSGHVMPNTDRAFKLNWASYSMGEKRSEIASDHSIFVGDLAVDVTDDMLLELFSSKYRSVKGAKVIIDANTGRSRGYGFVRFGDDNDKTHAMSEMNGVYCSTRPIRVGPATPRRSQGDSGSSPPRQSDSDSTNRTVYVGGLDPNVSEEELRKAFAKYGDLASVKIPVGKQCGFVQFVNRADAEEALQGLNGSTIGKQAVRLSWGRSPASKQSRGDYGHRRNGNGMYYGTPFYSGYGYASPVPHPNMYAAAYGAYPYYGNQQLVS

SEQ ID NO: 6105 - protein, 428 aa, Brachypodium distachyon
MQMAATTTDSQVAVPPHHPHSHPHPHPHPPPQHAHPHHHMPQPRWVVLPYPPPPPTMVAAPPPPPPQFAKHYAPGPPPPPAAAGRRTPTPPAAGSGGNACEENKTIWVGDLQYWMDENYLHSCFGPSGEVVTIKVIRNRQTGQTEGYGFVEFYSHASADKALQNFTGHAMPNTDRPFKLNWASYSMGEKRSEVVSDHSIFVGDLAADVTDEMLMELFASKYRSVKGAKVIIDANTGRSRGYGFVRFGEDSDKSRAMTEMNGVYCSTRPIRIGPATPRRTAGDSGSSTPGHSDGDSTNRTVYVGGLDPNVSEDELRKSFAKYGDVASVKIPQGKQCGFVQYVNRTDAEEALQGLNGSVIGKQAVRLSWGRSPSHKQPRGDSGNRRNNMYYGTPFYGGYGYASPVPHPNMYAAAAAYGAYPFYGNQQLVS

SEQ ID NO: 6106 - protein, 424 aa, Hordeum vulgare
MQMAATTTESQVAVPPHQPHAHPHPHPPPHHAHPHHHMPQPRWVVLPYPPPSMVAAPPPPPPQFAKHYAPGPPPPPAAAGRRTPTPPAAGSGGNGCEENKTIWVGDLQYWMDENYLHNCFGPSGEVVTIKVIRNRQTGQSEGYGFVEFFSHASADKALQNFTGHVMPNTDRAFKLNWASYSMGEKRSEVVSDHSIFVGDLAADVTDEMLMELFGSKYRSVKGAKVIIDANTGRSRGYGFVRFGDDTDKAHAMTEMNGVYCSTRPIRIGPATPRRTSGDSGSSTPGHSDGDSNNRTVYVGGLDQNVSEDELRKSFAKYGDVASVKIPLGKQCGFVQYVNRTDAEEALQGLNGAVIGKQAVRLSWGRSPSHKQSRGDSGNRRNNNNMYYGTPFYGGYGYASPVPHPNMYAPAYGAYPFYGNQQLVS

SEQ ID NO: 6107 - protein, 237 aa, Secale cereale
MLDRGINAAIVLGASTYALTKLLTVDQDYWHGWTIFEILRYMPEHNWSAYEEALKANPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPSTIFSELKATFFPMLTAGWKLWPFAHLITYGVVPIEQRLLWVDCVELIWVTILSTYSNEKSEARILDDSSTTDTQDNSR

SEQ ID NO: 6108 - protein, 424 aa, Secale cereale
TDDSRPPHGGAAARDPQASPAAPSDKTTPAPVRKKHRSEAKAKQTATSVRREASSRARANLSARVRVWWWEVRSLAVGLQQRQRWRRPWPPPRPAAGSSPAAPSPPRLTRPRRPSSAWWGPPGASAGPCASRPRRSRPTRCRGPVRGAGRGGAGGAARGAAGGPRLPGRRGRGVRPGGSGGGGDDGNKMLDRGINAAIVLGASTYALTKLLTVDQDYWHGWTIFEILRYMPEHNWSAYEEALKANPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPSTIFSELKATSPDAYCWMKLWPFAHLITYGVVPIEQRLLWVDCVELIWVTILSTYSNEKSEARILDDSSTTDTQDNSR

SEQ ID NO: 6109 - protein, 331 aa, Secale cereale
SRLIPSNPLSASAYTAAPSLVRLAGSSRRLRRALRVSAAAEPADALPGPGAGDLDGVVPAGLLEELPEGLAFQGDVGGGFAPGGSGGGGDDGNKMLDRGINAAIVLGASTYALTKLLTVDQDYWHGWTIFEILRYMPEHNWSAYEEALKANPVLAKMMISGIVYSLGDWIAQCYEGKPIFEFDRTRMFRSGLVGFTLHGSLSHYYYHFCESLFPFKDWWAVPVKVAFDQTAWSALWNSIYFVALGFLRWESPSTIFSELKATFFPMLTAGWKLWPFAHLITYGVVPIEQRLLWVDCVELIWVTILSTYSNEKSEARILDDSSTTDTQDNSR

SEQ ID NO: 6110 - protein, 338 aa, Leymus cinereus x Leymus triticoides
MAASVATSPACSRLIPSSPLSASASTAAPSLVRLAGSSRRLRRALRVSASAEPADVLPGPGAGELDGVVPAGLPEGLAFQGDMGGGFAPGGSGGGGDDGNKMLDRGINAAIVLGASTYALTKLLTVDQDYWHGWTIFEILRYMPEHNWSAYEEALKANPVLVKMMISGVVYSLGDWIAQCYEGKPIFEFDRTRMFRSGLVGFTLQGSLSHYYYHFCESLFPFKDWWAVPVRVAFDQTAWSALWNIIYFVALGFLRWESPSTIFSELKSTFFPMLTAGWKLWPFAHLITYGVVPIEQRLLWVDCVELIWVTILSTYSKEKSEARILDDSSTTDTQDNSR

SEQ ID NO: 6111 - protein, 320 aa, Triticum aestivum
LSASAYTAAPSLVRLAGSSRRLRRALRVSAAAEPADALPGPGAGDLDGVVPAGLLEELPEGLAFQGDVGGGFAPGGGGDDGNKMLDRGINAAIVLGASTYALTKLLTVDQDYWHGWTIFEILRYMPEHNWSAYEEALKANPVLAKMMISGVVYPLGDWIAQCYEGKPIFEFDRTRMFRSGLVGFTLHGSLSHNYYHFCESLFPFKDWWAVPVKVAFDQTAWSALWNSIYFVALGFLRWESPSTIYKELKATFFPMLTAGWKLWPFAHLITYGVVPIEQRLLWVDCVELIWVTILSTYSNEKSEARILDDSSTTDTQDNSR

SEQ ID NO: 6112 - protein, 321 aa, Triticum aestivum
LSASAYTAAPSLVRLAGSTRRLRRALRVSAAAEPADALPGPGAGELDGVVPAGLLEELPEGLAFQGDMGGGFAPGGGGGDDGNKMLDRGINAAIVLGASTYALTKLLTVDQDYWHGWTIFEILRYMPEHNWSAYEEALKANPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPSTIFRELKATFFPMLTAGWKLWPFAHLITYGVVPIEQRLLWVDCVELIWVTILSTYSNEKSEARILDDSSTTDTQDNSR

SEQ ID NO: 6113 - protein, 305 aa, Triticum aestivum
GSSRRLRRALRVSAAAEPADALPGPGAGDLDGVVPAGLLEELPEGLAFQGDVGGGFAPGGGGDDGNKMLDRGINAAIVLGASTYALTKLLTVDQDYWHGWTIFEILRYMPEHNWSAYEEALKANPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPSTIYKELKATFFPMLTAGWKLWPFAHLITYGVVPIEQRLLWVDCVELIWVTILSTYSNEKSEARILDDSSTTDTQDNNFR

SEQ ID NO: 6114 - protein, 348 aa, Avena sativa
MAAAVATVASTPASRRLPAHPLSASTAAPSLVRLPGSSRRLRRAMRVSAAAEDADALPGPGAGDLEMVPAGLLEDLPLPEGSQLGIGGLAFQGDMGGGFAPGGGDGGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFMLHGSLSHYYYSFCESLFPFKDWWAVPVKVAFDQTAWSALWNSIYFVALGFLRWESPSTIFSELKSTFFPMLTAGWKLWPFAHLITYGVVPLEQRLLWVDCVELIWVTILSTYSNEKSEARISDGPSIPADSEDNSR

SEQ ID NO: 6115 - protein, 348 aa, Avena sativa
MAAAVATVASTPASRRLPAHPLSASTAAPSLVRLPGSSRRLRRALRVSAAAEDADALPGPGAGDLEMVPAGLLEDLPLPEGSQLGIGGLAFQGDVGGGFAPGGGDGGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFMLHGSLSHYYYSFCESLFPFKDWWAVPVKVAFDQTAWSALWNSIYFITLGFLRWESPSTIFSELKSTFFPMLTAGWKLWPFAHLITYGVVPLEQRLLWVDCVELIWVTILSTYSNEKSEARISDGPSISADSEDTSR

SEQ ID NO: 6116 - protein, 350 aa, Avena sativa
MAAAVATVASTPASRARRLPAHPLSASTAAPSLVRLPGSSRRLRRAMRVSAAAEDADAMPGPGAGDLEMVPAGLLEDLPLPEGTQLGIGGLAFQGDVGGGFAPGGGDGGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFMLHGSLSHYYYSFCESLFPFKDWWAVPVKVAFDQTAWSALWNSIYFVALGFLRWESPSTIFSELKSTFFPMLTAGWKLWPFAHLITYGVVPLEQRLLWVDCVELIWVTILSTYSNEKSEARISDGPSIPADSEDTSR

SEQ ID NO: 6117 - protein, 350 aa, Avena sativa
MAAAVATVASTPASRARRLPAHPLSASTAAPSLIRLPGSSRRLRRALRVSAAAEDADALPGPGAGDLEMVPVGLLEDLPLPEGTQLGIGGLAFQGDMGGGFAPGGGDGGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFMLHGSLSHYYYSFCESLFPFKDWWAVPVKVAFDQTAWSALWNNIYFVALGFLRWESPSTIFSELKSTFFPMLTAGWKLWPFAHLITYGVVPLEQRLLWVDCVELIWVTILSTYSNEKSEARISDGPSIPADSEDNSR

SEQ ID NO: 6118 - protein, 367 aa, Festuca arundinacea
HEAKPRNKAQTNQRQRARRVWWGKFSLAVGQFSRGEELLAMAAAVATVPASRRLPAHPLSASTAAPSLIRLAGSSRRLRRALRVSAAAEEADVLPGPGAGELEMLPAGLLEDLPEGALGGSQLDIGGLAFQGDIGGGFAPGGSTGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPSTIFSELKATFFPMLTAGWKLWPFAHLITYGVVPVEQRLLWVDCVELIWVTILSTYSNEKS

SEQ ID NO: 6119 - protein, 317 aa, Pseudoroegneria spicata
MAASVAFSPACRRLPCNPLSASASTAAPSLVRLAGSSRRLRRASATAEPGPGAGELLEELPEGLNKMLEELPEGLNDGNKMLDRGINAAIVLGAITLALTKLLTVDQDYWHGWTILEILRYMPEHNWWAYEEALKANPVLAKMMISGIVYSLGDWIAQCYEGKHIFEFDRTRMFRSGLIGFTLQGSLSHYYYNFCESVFPFKDWWAVPVKAAFDQTAWSALWNSIYFVALGFLRWESPSTIFSELKSTFFPMLTAGWKLWPFAHLITYGVVPIEHRLLWVDCVELIWVTILSTYSNEKSEARILDDSSTTDTRDNSR

SEQ ID NO: 6120 - protein, 285 aa, Triticum aestivum
MAEPADVLPGSGAGELDGLVPEGLLKELPEGLAFQGAAGGSGGGGGHTMLDRGINADIVLGAITFGLTKLLTVDHDYWHGWTILEILRYMPEHNWSAYEEALKANPVLVKMMISGVVYPLGDWIAQCCEGKPIFEFDRARMFRSGLIGFTLQGSLSHYYYNFCESVFPYKDWWAVPVKAAFDQTAWTALWNTIYFVSLGFLRWESPSTIFSELKSTFFPMLTAGWKLWPFAHIITYGVVPIEHRLLWVDCVELIWVTILSTYSNEKSEARTLDDSSTTDTRDNSR

SEQ ID NO: 6121 - protein, 320 aa, Triticum aestivum
MAASVAFSPACRRLPCNPLSAYTAAPSLVRLAGTSRRLRRACASAEPAGELDGLVPAGLLEELPEGLAFQGAPGGSGGGGGHTMLDRGINAAIVLGAITFALTKLLTVDQDYWHGWTILEILRYMPQHNWSAYEEALKANPLLVKMMISGIVYSLGDWIAQCCEGKPIFEFDRARMFRSGLIGFTLQGSLSHYYYNFCESVFPCKDWWAVPVKAAFDQTAWSGLWNTIYFVALGFLRWESPSTIFSELKSTFFPMLTAGWKLWPFAHLITYGVVPVEHRLLWVDCVEIIWVTILSTYSNEKSEARILDDSSTTDTRDNSR

SEQ ID NO: 6122 - protein, 329 aa, Secale cereale
MAASVAFSPACRRLPCNPLSASTAAPSLVRLAGSSRRLRPASATVEPADVLPVPGSGAGELDGVVPAAAVLLEELPEGLAFQGAPSGSGGDKMLDLGINAAIVLGAITFALTKLLTVDQDYWHGWTIFEILRYMPQHNWSAYEDALRANPLLVKMMISGIVYSLGDWIAQCCEGKPIFEFDRTRMFRSGLIGFALQGSLSHYYYNFCESVFPYKDWWAVLIKAAFDQTAWSGLWNTIYFVALGFLRWESPSTIFSELKSTFFPMLTAGWKLWPFAHIITYGVVPIEHRLLWVDCVELIWVTILSTYSNEKSEARILDDSSTTDTRDNSR

SEQ ID NO: 6123 - protein, 359 aa, Brachypodium distachyon
MAAAVASSPFPASRRLPSKNHIPACPAAPSLLRLAGGSSSRRRRLRRALRVSAAPEEADVLPGPGVIELEMVSAGLLEELPVDPLGGSQLDIGGLAFQGDVTGGFTSGGSGGAGAGGDGGNKMLDRGINTAIVLGASTYALTKLLTVDQDYWHGWTIFEILRYMPEHNWSAYEEALKTNPVLAKMMISGVVYSLGDWIAQCYEGKPIFEFDRTRMFRSGLVGFTLHGSLSHYYYHFCESLFPFKDWWAVPVKVAFDQTAWSALWNSIYFVVLGFLRFESPVTIFSELKSTFFPMLTAGWKLWPFAHLITYGVVPVEQRLLWVDCVELIWVTILSTYSNEKSEARISDASTSTDSQDNSR

SEQ ID NO: 6124 - protein, 171 aa, Triticum aestivum
MAARRTILLAVAAMAVLSTASAAIYNVGEPGGAWDLSTNYGTWASSRNFQTSDQIVFKYSPRAHDVLEVSKADYDSCSTANPITTFNSGNDVVTLTATGTRYFICGFPGHCAGGMKVKIDVMPGSSSTSPAPASGPSASNAPPPTPVSAATNVEATGFGLAVLLAIAGLMA

SEQ ID NO: 6125 - protein, 171 aa, Triticum aestivum
MAAMRLSLLIMAVMAVLSTTSAASYNVGEPGGAWDLNTNYGTWASSRKFQPSDQIVFKYSPQAHNVLEVSKADYDSCSTVNPIATLNSGNDIVTLTAVGTRYFICGFPGHCTGGMKVKIDGVPGSSSPSPAPASGPNASNAPPTTPVSTATSVKATGFGFAILLAFVGFMA

SEQ ID NO: 6126 - protein, 171 aa, Triticum aestivum
MAAMRTILLVVAAMAVLSSASAAIYNVGERGGAWDLSTNYDTWASSRNFQTSDQIVFKYSPQAHDVLEVSKADYDSCSTASPVTTFNSGNDVVTLTATGTRYFICGFPGHCAGGMKVKIDVMPGSSSSSPAPANGPSASNAPPPTPVSTATNVQATGFGLAVLLAVVGLMA

SEQ ID NO: 6127 - protein, 171 aa, Triticum aestivum
MAAMRTILLAVAVMAILNTASAAIYNVGEPGGAWDLSTNYGTWASSRNFHPSDQIVFKYSPQAHDVLEVSKADYDSCNTASPIATLNSGNDVVSLTTTGTRYFLCGFPGHCAGGMKVKIDVVPSSSSSSPAPASGPSASNAPPPAPVSAATSMEATGFGLTVLLAVAGLMA

SEQ ID NO: 6128 - protein, 171 aa, Triticum aestivum
MAAMRTILLAVAAMAILSTASAAIYNVGEPGGAWDLSTNYGTWASSRNFHPNDQIVFKYSPQAHDVLEVSKADYDSCSTASPIATLNSGNDVVSLTTTGTRYFLCGFPGHCAGGMKVKIDVVPSSSSSSPAPASGPSASNAPPPAPVSAATSMEATGFGLTILLAVAGLMA

SEQ ID NO: 6129 - protein, 171 aa, Triticum aestivum
MAAMRTILLAVAAMAILSTASAAIYNVGEPSGEWDLSTNYGTWASSRNFHPSDQIIFKYSPQAHDVLEVSKADYDSCSTASPIATLNSGNDVVSLTATGTRYFLCGFPGHCAGGMKVKIDVVPSSSSSSPAPASGPSASNAPPPVPVSAATSIEATGFGLAVLLAVAGLMA

SEQ ID NO: 6130 - protein, 171 aa, Triticum aestivum
MAAMRTILLVVAAMAVLSTASAAIYNVGEPGGAWDLSTNYDTWASSRNFQTSDQIVFKYSPQAHDVLEVSKADYDSCSTANPVTTFNSGNDVVTLTATGTRYFICGFPGHCAGGMKVKIDVIPGSSSSAPAPANGPSASNAPPPTPVSAATNVRATGFGLAILLAVVGLIA

SEQ ID NO: 6131 - protein, 170 aa, Triticum aestivum
MAARRTILLAMAAMAILSTASAAIYNVGEPGGAWDLSTNYGTWASSRNFQTGDQIVFKYSPQAHDVLEVSKADYDSCSTASPVTTFNSGNDVVTLTTTGTRYYICGFPGHCAGGMKVKIDVMPGSSSSPAPASGPSASNAPPPTPVSAATNVEATGFGLAVLLAVAGLMA

SEQ ID NO: 6132 - protein, 171 aa, Triticum aestivum
MAAMRTILLAVAAMAILSTASAAIYNVGEPGGAWDLRTNYGTWASSRNFHPSDQIVFKYSPQAHDVLEVSKADYDSCSTASPIATLNSGNDVVSLIATGTRYFLCGFPGHCAGGMKVKIDVVPSSSSSSPAPASSPSASNAPPPAPVSAATSMEATGFGLAVLLAVASLMA

SEQ ID NO: 6133 - protein, 171 aa, Secale cereale
MAATRTILLAVAAMTILSTASAAIYNVGEPGGAWDLSTNYGTWASSRNFHPSDQIVFKYSPQAHDVLEVGKADYDSCSTASPIATLKSGNDVVSLTATGTRYFICGFPGHCAAGMKVKIDVVPSSSSSSPAPASGPSATNAPPPAPVSAATSMEATGFGLTVLLAVAGLMA

SEQ ID NO: 6134 - protein, 171 aa, Hordeum vulgare
MAATRTILLAVATMTILSTASAAIYNVGEPGGAWDLSTNYGTWASSRNFHPSDRIVFKYSPQAHDVLEVSKADYDSCSTASPIATLNSGNDVVSLTATGTRYFICGFPGHCAGGMKVKIDVVPSSSSSSPAPASGPSASNAPPPVPVSAATSVATTGFGLAILLIVAGLMS

SEQ ID NO: 6135 - protein, 169 aa, Triticum aestivum
MAVTRTILAVAVMAILSTASAAIYNVGEPGGAWDLSTNYGTWASSRNFKADDQIVFKYSPQAHDVLEVSKADYDSCSTASPITTLNSGNDVVTLTASGTRYFICGFPGHCAGGMKVKIDVMSGSSSSPAPASGPSASNAPPPTPVSTATNVEAIGYGLAVLLAIAGLMA

SEQ ID NO: 6136 - protein, 171 aa, Secale cereale
MAGRRTIFLAMAAMAVMSTASAAIYNVGEPGGAWDLSTNYGTWASSRNFQTSDQIVFKYSPQAHDVLEVSKADYDSCSTASPVTTLTSGNDVVTLTANGTRYFICGFPGHCAGGMKVKIDVMPGSSSSSPAPANGPSANNAPPPTPVSAATSVEATGFGLAVLLAFVGLMV

SEQ ID NO: 6137 - protein, 168 aa, Triticum aestivum
MAVTRTILAVAVMAILSTASAAIYNVGEPGGAWDLSTNYGTWASSRNFKADDQIVFKYSPQAHDVLEVSKADYDSCSTASPITTLNSGNDVVTLTASGTRYFICGFPGHCAGGMKVKIDVMSGFSSPAPASGPSASNAPPPTPASAATNVEATGFGLAVLLAVAGLMA

SEQ ID NO: 6138 - protein, 171 aa, Secale cereale
MAATRTILLAVAAMTILSTASAAIYNVGEPGGAWDLSTNYGTWASSRNFHPRDQIVFKYSSQAHDVLEVGMADYDSCSTASPIATLKSGNDVVSLTATGTRYFICGFPGHCAAGMKVKIDVVPSSSSSSPAPASGPSATNAPPPAPVSAATSMEAIGFGLTVLLAVAGLMA

SEQ ID NO: 6139 - protein, 335 aa, Unknown
  Sequence found in Organisms: Secale cereale, Triticum aestivum
MAAASEEAIKQFSVLMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNEYRDRVVLPGASEMSGKQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHSLKGGDGISRSFSRITIEGP

SEQ ID NO: 6140 - protein, 335 aa, Triticum aestivum
MAAASEEAIKQFSVLMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNEYRDRVVLPGASEMSGKQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHSLKAGDGISRSFSRITIEGP

SEQ ID NO: 6141 - protein, 335 aa, Triticum aestivum
MAAASEEAIKQFSVLMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNEYRDRVVLPGASEMSGKQINTCLKVMDMTGLKLSALNQIKMLSTITAVDDLNYPEKTEMYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHSLKGGDGISRSFSRITIEGP

SEQ ID NO: 6142 - protein, 335 aa, Triticum aestivum
MAAASEEAIKQFSVLMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNEYRDRVVLPGASEMSGKQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHNLKGGDGISRSFSRITIEGP

SEQ ID NO: 6143 - protein, 333 aa, Avena sativa
MAAPSEEAIKQFSALMEQLEEPLKTTFQHVHQGYPRGTLVRFLKAREWNVLKAHKMLMDSLNWRLQNEIDTVLAKPILPPDLYRSIRDTLLVGLTGYSKQGQPVYAFGVGLSTFDKASVHYYLQSHIQMNEYRDRVVLPGASEMFGKQINTCLKVMDMTGLKLSALNQIKMLSTITAVDDLNYPEKTETYYIVNAPYVFSACWKVVKPLLQERTKKKIKVLSGPGRDELLKVMDYQTLPHFCKREGSGSSSDEVDCYSYDHPFHQQLYNFVKQQAQSQDMVGPLKQGSMHVKVPTPDLEEAKIMQTIESELQNLRGGGDGMSRSFNRITIEGP

SEQ ID NO: 6144 - protein, 333 aa, Brachypodium distachyon
MAAVVSEEAIKQFSALMEQLEEPLKTTFQHVHQGYPRGTVMRFLKAREWNVPKAHKMLMDCLNWRLQNEIDSVLAKPIVPSDLYRSIRETLLVGLTGYSKQGQPVYAFGVGLSTFDKASVHYYLQSHIQMNEYRDRVVLPGASNMFGKQVNTCLKIMDMTGLKLSALNQIKMLSTITAVDDLNYPEKTETYYIVNAPYVFSACWKVVKPLLQERTKKKIKVLYGPGRDELLKVMDHEALPHFCNREGSGSLSDGVDCYSYDHPFHQQLYNFVKQQALSQDIVGPLKQGSMHVHVPVPDIEDAKIAETIESELHKLREGNGLSRSFNRINIEGP

SEQ ID NO: 6145 - protein, 335 aa, Oryza sativa
MAAASEEAIKQFSALMELLDEPLKTTFQHVHQGYARGTLVRFLKAREWNVPKAHKMLMDCLNWRIQNGIDSVLAKPIVPSDLYRTIRDTLLVGLTGYSKQGQPVYAFGVGLSTLDKASVHYYVQSHIQMNEYRDRVVLPKASKMFGKQINTCLKVMDMTGLKLSALNQIKMLSTITAIDDLNYPEKTETYFIVNAPYVFSACWKVVKPLLQERTKRKIKVLYGSGRDELLKVMDYEALPNFCKREGSGSSNDSSDGVDCYSYDHPFHQELYNYIKQQALNEDFIGPIKQGSMHVDVPTPDLEEAKIMETIESELHKFSGANGLSHSFNKIKIEGP

SEQ ID NO: 6146 - protein, 335 aa, Setaria italica
MAAASEEAIKQFSALMEQLEEPLKTTFQNVHQGNLRGTLVRYLKAREWSVPKAHKMLMDCLNWRIQNEIDSVLAKPIVPPDLYRAIRDTLLVGLTGYSKQGQPVYAFGVGLSTFDKASVNYYVQSHIQMNEYRDRVVLPAASKKFGRQINTCLKVMDMTGLKLSALSQIKMLTMITTVDDLNYPEKTETYYIVNAPYVFSACWKVVKPLLQERTKKKIQVLYGSGRDELLKVMDYQSLPHFCKREGSGSSSDSLDGVDCYSYDHPFHQQMYNYVKQQSLKLDSVGPIKQGSLHVDVPSPGFEEVKIAETIESELHKLRGGNGLTHSFNRIKIEGP

SEQ ID NO: 6147 - protein, 336 aa, Zea mays
MAATSEEAIKQFSALMEQLEEPLKSTFQNVHQGNLRGTLMRFLKAREWSVPKAYKMLMDCLNWRVQNEIDIVLAKPILPSDIYRVIRDTLLVGLTGYSKQGQPVYAFGVGLSTFDKASVNYYVQSHIQMNEYRDRVVLPAASKKFGRQINTCLKVMDMTGLKLSALSQIKMLTMITTVDDLNYPEKTETYYIVNAPYVFSACWKVVKPLLQERTKKKIQVLYGSGRDELLKVMDYESLPHFCKREGSGSSSDSLDGVDCYSYDHPFHQQLYNYMKQQQSLNQDSVGPRKQGSVHVDVPSPGLEEAKIAETIKAELQNLRGSGGLAHSFSSIQIEGP

SEQ ID NO: 6148 - protein, 335 aa, Pennisetum glaucum
MAAASDEAIKQFSALMEQLEEPLKITFQIVHQGNLRGTLVRYLKAREWSVPKAHKMLMDCLHWRIQNEIDSMLAKPIVPPDLYRAIRDTLLVGLTGYSKQGQPVYAFGVGLSTFDKASVNYYVQSHIQMNEYRDRVVLPAASRKFGRQINTCLKVMDMTGLKLSALSQIKMLTMITTVDDLNYPEKTETYYIVNAPYVFSACWKVVKPLLQERTKKKIQVLYGSGRDELLKVMDYQSLPHFCKREGSGSSTDSLDGVDCYSYDHPFHQQMYNYVKQQSLKLDSVGPVKQGSLHVDVPSPGFEEVKIAETIESELHKLRGGNGLTHSFNRIKIEGP

SEQ ID NO: 6149 - protein, 335 aa, Saccharum officinarum
MAATSEKAIKQFSALMEQLEEPLKTTFQNVHQGNLRGTLLRFLKAREWSIPKAHKMLMDCLNWRVQNEIDSVLAKPILPSDLYRAIRDTLLVGLTGYSKQGQPVYAFGVGLSTFDKASVNYYVQSHIQMNEYRDRVVLPAASKKFGRQINTCLKVMDMTGLKLSALSQIKMLTMITTVDDLNYPEKTETYYIVNAPYVFSACWKVVKPLLQERTKKKIQVLYGSGRDELLKVMDHESLPHFCKREGSGSSRDSLDGVDCYSYDHPFHQQLYSYMRQQSLNQDSLGPRKQGSVHVDVPSPGLEEVKIAETIKAELQNLRGSNGLTHSFNSIQIEGP

SEQ ID NO: 6150 - protein, 280 aa, Panicum virgatum
MLIDCLNWRIQNGIDSVLAKPIVPSDLYRAIRDTLLVGLTGYSKQGQPVYAFGVGLSTFDKASVNYYVQSHIQMNEYRDRVVLPAASKKFGRQINTCLKVMDMTGLKLSALSQIKMLTMITTVDDLNYPEKTETYYIVNAPYVFSACWKVVKPLLQERTKKKIQVLYGSGRDELLKVMDYESLPHFCKREGSGSSSDSLDGVDCYSYDHPFHQQLYNYMKQQSLKLDSVGPIKQGSLHVDVPSPGLEEVKIAKTIESELHKLRGGNGLTHSFNRIKIEGP

SEQ ID NO: 6151 - protein, 333 aa, Cynodon dactylon
MAATSEEAIKQFAALMEHLEEPLKTTFQNVHQGYPRGTLVRFLKAREWSVPKAHKMLMDSLNWRVQNEIDSVLAKPIVPSDLYRSIRDTLLVGLTGYSKQGQPVYAFGVGLSTFDKASVNYYVQSHIQMNEYRDRIVLPAASKKFGRQINTCLKVMDMTGLKLSALNQIKMLTMITSVDDLNYPEKTETYYIVNAPYVFSACWKVVKPLLQERTKKKIQVLHGSGRDELVKVMDYESLPHFCKREGSGSSRDSFDGVVCYSYDHPFHQQLYNYMKQQAVKQDVVVKQESFHVDLPTPELEEVKIAKKIESEIHHLRGHNGLSHQFNSIEIEGP

SEQ ID NO: 6152 - protein, 280 aa, Triticum aestivum
MLMDCLNWRLQNEIDSVLAKPILPADLYRSIRDTLLVGLTGYSKQGQPVYAFGVGLSTFDRASVNYYLQSHIQMNEYRDRVVLPGASEMSGKQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHNLKGGDGISRSFSRITIEGP

SEQ ID NO: 6153 - protein, 735 aa, Hordeum vulgare
MDYSTSLLRLTFLALGAALILLVTRSAFRLPLAIDAPAASFLHGSGGCTRFSPWACRPPRTGKSPPRRSSHESDVPRHPLDPLTVTEISRARELLRAHPPFASAPSALVVHALALDEPDKPAVRRWRKGAHALPPRRAVAVVRFRGESHVLALDLATGSVTPLPTPASGYPTMTMDEMTALCAAPFSDPAFNATILRRGVRLADVACLPISPGWYGPAEDDGGRRFIKSQCYSTEGTANFYMRPIEGLTVLIDMDTGKVVHISDRGAGIPIPAAKNTEYRHAANDDADDKFGYQTVRAPSMEPAPEGPGFEVSDGHTVRWAGWEFHLKADARAGLIVSRATVQDPATGARREVMYKGMASELFVPYMDPTEAWYFKTYMDAGEYGFGLQAMPLVPLNDCPRHARYMDGVFVAADGRPYVREKMICVFERYAGDIAWRHSESPITGMDIRESRAKVTLVARMAASVANYDYIVDWEFQTDGLIRIKVGLSGILMVKGSPYSHMNQVRKNEEMHGTLLSENIIGVIHDHYVTFRLDMDVDGADNSFVRVDMARQDTAPGESPRRSYLKATRHVASTEKDAKVRLKLYEPAEFHVINPTKKTRVGNPVGYKVVPAGTAASLLDPEDPPQKRGAFTNNQIWVTPYNKSEEWAGGLFVYQSKGEDTLATWTERDRPIENKDLVLWYTLGFHHIPCQEDFPIMPTVSSSFDLKPVNFFESNPILKQRPTMEKDLPVCVATA

SEQ ID NO: 6154 - protein, 733 aa, Triticum aestivum
MDYSTSLLRLTFLALGAALVLIVARSAFRLPLAINAPAASFLHGAGGCTRFSPWACRSPRTGKAPPRRPSHESDVPRHPLDPLTVTEVNRARELLRAHPPFASAPSALAVHALALDEPDKPAVRRWRKGAHALPPRRAVAVVRFQGESHVLAVDLAAGKVAPLPVPASGYPTMTMDEQTALCAAPFRDPAFNATIRRRGVRLADVACLPISPGWYGPAEDGGRRLIKSQCYSTEGTANFYMRPIEGLTVLIDMDTGKVVHISDRGAGIPIPAAKNTDYRLAANDDADRFGYQTVRAPSMEPAPEGPGIQIEDGHTVRWAGWEFHLKADARAGLVVSRATVQDPATGARREVMYKGMASELFVPYMDPTEAWYFKTYMDAGEYGFGLQAMPLVPLNDCPRHARYMDGVFVAADGRPYVRDNMICVFERYAGDIAWRHSESPITGMDIRESRPKVTLVARMAASVANYDYIVDWEFQTDGLIRIKVGLSGILMVKGTPYSHMNQVRQNEEMHGTLLSENVIGVIHDHYVTFRLDMDVDGADNSFVRVDMARQDTAPGESPRRSYLKATRHVASTEKDARVRLKLYEPAEFHIINPTKKTRVGNPVGYKVVPAGTAGSLLDPEDPPQKRGAFTNNQIWVTPYNKNEEWAGGLFVYQSKGEDTLATWSERDRPIENKDLVLWYTLGFHHIPCQEDFPIMPTVSSSFDLKPVNFFESNPILKQRPTMEKDLPVCAATA

SEQ ID NO: 6155 - protein, 749 aa, Avena sativa
MDYSTSLLRLTFLALGAALVLLVVRSAFRLPGHGIDTATSSLFDDGAGCTRFSPWACHQRQRQTDKTSKSKPSPPRSSHESDVPRHPLDPLTVTEVNRARELLRAYPPFASSPSSLAVHELALDEPDKPVVRRCRKGDGNALPPRRAVAVVRFRGESHVLAVDLEAGTVTPLPAPASGYPTMTMDEQRALCAAPFADPAFNASIRRRGVRMADVACLPISPGWYGPVEDGGRRLIKSQCFSTEGTANFYMRPIEGLTVLIDMDTREVVHLSDRGAGIPIPAAKNTDYRRAAAAEEEEDAGGAKTFGYQTVRAPSMEPAPEGPGFEVEDGHTVRWAGWEFHLKADARAGLIVSRAGVQDPSTGARREVMYKGMASELFVPYMDPTEAWYFKTYMDAGEYGFGLQAMPLVPLNDCPRHARYMDGVFVAADGRPYVRENMICVFERYAGDIAWRHSESPITGMDIRESRPKVTLVARMAASVANYDYIMDWEFQMDGLIRIKVGLSGILMVKGTPYSHMNQVRRNEEMYGTLLSENVVGVIHDHYVTFRLDMDVDGADNSFVRVEMARQDTAPGESPRRSYLKATRHVASTENDAKIRMKLYEPAEFHVINPTKKTRVGNPVGYKVVAAGTAASLLDPEDPPQKRGAFTNNQIWVTPYNKSEQWAGGLFVYQSKGEDTLATWSERDRPIENKDIVLWYTLGFHHVPCQEDFPIMPTVSSSFDLKPVNFFESNPILRQRPTQVNDLPVCAVTA

SEQ ID NO: 6156 - protein, 750 aa, Oryza sativa
MDHSTSLLRLIFLALGAALVVLVVRSAFRLPGDIDTTTTSLFDDGNGGSCTRFSPWACRQGRGDPRSKPSKPRRPSHESDVPRHPLDPLTVREVNRVRELLRAHPLFASAPSSLFVHSLELDEPEKSVVKSWRKGADPLPPRRAVAVVRFRGESHVLGVDLSEGDGAVTPLPVPASGYPMMNMDEQTSLCFAPFKDEAFNASLLRRGVRASDVACLPISLGWYGPAEENRRLIKSQCFSTEGTANFYMRPIEGLTVLVDMDTAEVLHVSDRGAGIPIPAAANTDYRHGHSAPTPAEAQAQGRHGYQTVRVPSMEPPAGGPGFELVDGHTVRWGGWEFHLKPDARAGMVVSRARVQDPATGEHRDVMYKGMASELFVPYMDPTEAWYFKTYMDAGEYGFGLQAMPLVPLNDCPRHARYLDAVFVAADGRPYVRENMICVFERYAGDIAWRHSESPITGMDIRESRPKVTLVARMAASVANYDYIVDWEFQMDGLVRIKVGLSGILMVKGTQYSHMNQVHQNDNMYGTLLSENVIGVIHDHFVTFRLDMDIDGADNSFVKVAMARQNTGAGESPRKSYLKATRHVARTEKDAQVRLKLYEPSEFHIVNPMKKTRVGNPVGYKVVPAGTAASLLDPEDPPQKRGAFTNNQIWVTPYNKTEEWAGGLFVYQSKGEDTLATWSERDRPIENKDLVLWYTLGFHHVPCQEDFPIMPTVSSSFDLKPVNFFESNPILGQRPTQENDLPVCAAAATTS

SEQ ID NO: 6157 - protein, 738 aa, Setaria italica
MDHSTSLLRFIFLSLGAALILLVVRSAFRLPRGIDTSTASLLDAAAAAGSGCTRFAPWGCRQANRMTKPKPPSHEDDVPRHPLDPLTIGEINRARELLRAHPPFASSPSSLFVHSLALDEPEKAVVLGWRKGDPLPPRHAVAVVRFRGEASVLAVDLAGSAVTPLPVPASGYPTMTMDEQVSLCFAPFADPKFNATIRRRGVRMSDVACLPISLGWYGPTEENRRLIKVQCFSAEGTANFYMRPIEGLTVLVDMDTSEVVHISDRGAGIPIPDAANTDYRLARHMQERQDAGLGYQKVRAPSMEPAPSGPGVELVDGHTVRWGGWELHLKADARAGMVVSRARVQDPGTGAHREVMYKGMASELFVPYMDPSEAWYFKTYMDAGEYGFGLQAMPLVPLNDCPRHAQYVDGVFVAADGRPYVRGNMICVFERYAGDVAWRHSESPITGMDIRESRPKVTLVARMVASVANYDYIMDWEFQMDGLVRIKVGLSGILMVKGTAYSHLSEASENEDMHGTLLSENVIGVIHDHYVTFRLDMDVDGTDNSFVRVEMARQETGPGESPRRSYLKATRHVAQTEKDAQVRLKLYQPEEFHVINPTKKTRVGNPVGYKVVPAGTAASLLDPEDPPQKRGAFTNNQIWVTPYNKSEEWAGGLFVYQSKGEDTLATWSERDRPIENRDLVLWYTLGFHHIPCQEDFPIMPTVSSSFDLKPVNFFESNPILKQRPTEDDDLPVCAAAAR

SEQ ID NO: 6158 - protein, 752 aa, Sorghum bicolor
MDHSTSLLRLIFLALGAALVLLIVRSAFRLPRGIDTPTTSLFDDATAGSSCTRFAPWGCRQADRIKQEQKPKPEPPSHENDVPLHPLDPLTVTEINRARELLRAHPPFASSPSSMFVHSLALDEPDKPVVLSWRKGADPLPPRRAVAVVRFRGEAFVLAIDLASGAVTPLPAPASGYPTMTMDEQVSLCYAPFSDPAFNATVQRHGVRMSDVACLPISLGWYGPTEENRRLIKIQCFSAEGTANFYMRPIEGLTVLLDMDTREVIRISDRGGGIPIPPAANTDYRYARHMQEDVGGDQTTSRSEAGFQKVRAPSMEPGPSSGPGVELVDGHTVRWGGWEFHLKADARAGMVVSRARVQDPGTGAHREVLYKGMASELFVPYMDPTEAWYFKTYMDAGEYGFGLQAMPLVPLNDCPRHARYLDGVFVAADGRPYVREKMICVFERYAGEVAWRHSESPITGMDIRESRPKVTLVARMVASVANYDYIMDWEFQMDGLVRIKVGLSGILMVKGTAYSHLREARENEDTHGTLLSENVIGVIHDHYVTFRLDMDVDGADNNSFVRVEMARQETAPGESPRRSYLKATRHVARTEKDAQVRLKLYDPAEFHVVNPTKKTRVGNPVGYKLVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTKEDDLPICSATAV

SEQ ID NO: 6159 - protein, 744 aa, Zea mays
MDRSTSLLRLILLALGAALVLLVVRSAFRLPRGIDTPTTSLFDDEATAGSSCTRFAPWGCRQADRIKQKPPSHENDVPRHPLDPLTISEVNRARELLRAHPPFASSPSSMFVHSLALDEPDKPVVLSWRKGVDPLPPRRAVAVVRFRGEAFVLAIDLASGAVTPLPVPASGYPTMTMDEQVLLCYTPFRDPAFNATIQRHGVRLSDVACLPISLGWYGPSEENRRLIKIQCFSAEGTANFYMRPIEGLTVLVDMDTREVVRISDRGAGIPIPPAANTDYRYSRHMQDEGDDQQTAGFQKVRAPSMEPGPSSGPRVELVDGHTVRWGGWEFHLKADARAGMVVSRARVQDPGTGAHREVLYKGMASELFVPYMDPTEAWYFKTYMDAGEYGFGLQAMPLVPLNDCPRHARYLDGVFVAADGRPYVREKMICVFERYAGEVAWRHSESPITGLDIRESRPKVTLVARMVASVANYDYIMDWEFQMDGLVRIKVGLSGILMVKGTSYSHLSEARGNEGDMHGTLLSENVIGVIHDHYVTFRLDMDVDGADNSFVRVEMARQETGPGDESPRRSYLRATRRVAETEKDARVRLSLYHPAEFHVVNPAKKTRVGNPVGYKVVPAGTAASLLDPEDPPQKRGAFTNNQIWVTPYNKSEEWAGGLFVYQSKGEDTLDTWSERDRPIENKDLVLWYTLGFHHIPCQEDFPIMPTVSSSFDLKPVNFFESNPILKQRPTKEDDLPICTASTAA

SEQ ID NO: 6160 - protein, 110 aa, Unknown
  Sequence found in Organisms: Secale cereale, Triticum aestivum
MAPTKKSKKSTENINNKLQLVMKSGKYTLGYKTVLKTLRSSKGKLIILANNCPPLRKSEIEYYAMLSKISVHHFHGNNVDLGTACGKYYRVCCLSILDPGDSDIITTVPQ

SEQ ID NO: 6161 - protein, 112 aa, Hordeum vulgare
MAPTKKAKKSGENINNKLQLVMKSGKYTLGYKTVLKTLRSSKGKLIILANNCPPLRKSEIEYYAMLAKISVHHFHGNNVDLGTACGKYYRVCCLSILDPGDSDIINTTTTTQ

SEQ ID NO: 6162 - protein, 112 aa, Unknown
  Sequence found in Organisms: Secale cereale, Triticum aestivum
MAPTKKAKKSGENINNKLQLVMKSGKYTLGYKTVLKTLRSSKGKLIILANNCPPLRKSEIEYYAMLAKISVHHFHGNNVDLGTACGKYYRVCCLSILDPGDSDIISTTTTTQ

SEQ ID NO: 6163 - protein, 112 aa, Brachypodium distachyon
MAPTKKAKKSTENINNKLQLVMKSGKYTLGYKTVLKTLRSSKGKLIILANNCPPLRKSEIEYYAMLAKISVHHFHGNNVDLGTACGKYYRVCCLSIIDPGDSDIISTTPGTQ

SEQ ID NO: 6164 - protein, 113 aa, Avena sativa
MAPTKKTKKNTENINNKLQLVMKSGKYTLGYKTVLKTLRSSKGKLIILANNCPPLRKSEIEYYAMLAKISVHHFHGNNVDLGTACGKYYRVCCLSILDPGDSDIITTAPGAAQ

SEQ ID NO: 6165 - protein, 79 aa, Triticum aestivum
MAPTKKAKKSGENINNKLQLVMKSGKYTLGYKTVLKTLRSSKGKLIILANNCPPLRKSEIEYYAMLAKISVHHFHGKQC

SEQ ID NO: 6166 - protein, 160 aa, Triticum aestivum
MAPTKKAKKSGENINNKLQLVMKSGKYTLGYKTVLKTLRSSKGKLIILANNCPPLRKSEIEYYAMLAKISVHHFHGNNVDLGTACGKYYRVCCLSILDLVTRTSSAPPPPPVKRREESLHYLFSRVVGPVVLSKHPGILGLCTFCDADWSCHTDNTHMGV

SEQ ID NO: 6167 - protein, 113 aa, Brachypodium distachyon
MAPTKKTKKSTENINNKLQLVMKSGKYTLGYKTVLKTLRSSKGKLIILANNCPPLRKSEIEYYAMLAKISVHHFHGNNVDLGTACGKYYRVCCLSIIDPGDSDIISTAPGTTQ

SEQ ID NO: 6168 - protein, 112 aa, Avena sativa
MAPTKKAKKSTENINNKLQLVMKSGKYTLGYKTVLKTLRNSKGKLIILANNCPPLRKSEIEYYAMLAKISVHHFHGNNVDLGTACGKYYRVCCLSILDPGDSDIINTTSTTQ

SEQ ID NO: 6169 - protein, 109 aa, Festuca arundinacea
MAPTKKAKKSTENINNKLQLVMKSGKYTLGYRTVLKTLRSSKGKLIILANNCPPLRKSEIEYYAMLAKISVHHFHGNNVDLGTACGKYYRVGCLSIIDPGDSDIINTTT

SEQ ID NO: 6170 - protein, 112 aa, Setaria italica
MAPTKKSKKSTESINNKLQLVMKSGKYTLGYKTVLKTLRNSKGKLIILANNCPPLRKSEIEYYAMLAKVSVHHFHGNNVDLGTACGKYYRVCCLSIIDPGDSDIISTTPGTQ

SEQ ID NO: 6171 - protein, 112 aa, Unknown
  Sequence found in Organisms: Pennisetum glaucum, Panicum virgatum
MAPTKKSKKSTESINNKLQLVMKSGKYTLGYKTVLKTLRNSKGKLIILANNCPPLRKSEIEYYAMLAKVSVHHFHGNNVDLGTACGKYYRVCCLSIIDPGDSDIISTTPGAQ

SEQ ID NO: 6172 - protein, 112 aa, Avena sativa
MAPTKKAKKSTENINNKLQLVMKSGKYTLGYKTVLKTLRNSKGKLIILANNCPPLRKSEIEYYAMLAKISVHHFHGNNVDLGTACGKYYRVCCLSIIDPGDSDIINTTSTTQ

SEQ ID NO: 6173 - protein, 113 aa, Avena sativa
MAPTKKTKKNTENINNKLQLVMKSGKYTLGYKTVLKTLRSSKGKLIILANNCPPLRKSEIEYYAMLAKISVHHFHGNNVDLGTACGKYYRVCCLSIIDPGDSDIITAAPGAAQ

SEQ ID NO: 6174 - protein, 112 aa, Unknown
  Sequence found in Organisms: Zea mays, Sorghum bicolor, Saccharum officinarum
MAPTKKSKKSTESINNKLQLVMKSGKYTLGYKTVLKTLRNSKGKLIIIANNCPPLRKSEIEYYAMLAKVSVHHFHGNNVDLGTACGKYYRVCCLSIIDPGDSDIISTTPGTQ

SEQ ID NO: 6175 - protein, 44 aa, Secale cereale
MAPTKKAKKSGENINNKLQLVMKSGKYTLGYKTVLKTCAAPRGS

SEQ ID NO: 6176 - protein, 113 aa, Festuca arundinacea
MAPTKKAKKSTENINNKLQLVMKSGKYTLGYRTVLKTLRSSKGKLIILANNCPPLRKSEIEYYAMLAKISVHHFHGNNVDLGTACGKYYRVGCLSIIDPGDSDIINTTTTTAQ

SEQ ID NO: 6177 - protein, 112 aa, Oryza sativa
MAPTKKAKKSTDNINNKLQLVMKSGKYTLGYKTVLKTLRNSKGKLIILANNCPPLRKSEIEYYAMLGKVSVHHFHGNNVDLGTACGKYYRVCCLSIIDPGDSDIINTTPASQ

SEQ ID NO: 6178 - protein, 99 aa, Triticum aestivum
MAPTKKSKKSTESINNKLQLVMKSGKYTLGYKTVLKTLRNSKGKLIIIANNCPPLRKSEIEYYAMLAKVSVHHFHGNNLILALPAASTTRCAASVSSTK

SEQ ID NO: 6179 - protein, 74 aa, Zea mays
VDWSPRWFRSMQKKSTESINNKLQLVMKSGKYTLGYKTVLKTLRNSKGKLIIIANNCPPLRKSEIEYYAHAGQS

SEQ ID NO: 6180 - protein, 112 aa, Unknown
  Sequence found in Organisms: Pennisetum glaucum, Cenchrus ciliaris, Setaria italica
MVATKKSKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGDQ

SEQ ID NO: 6181 - protein, 113 aa, Avena sativa
MVASTKKAKKSGDNINNKLQLVMKSGKYTLGYKTVLRTLRNSKSKLVIIANNCPPLRKSEIEYYAMLAKITVHHYHGNNVDLGTACGKYFRVCCLSILDPGDSDIITTTPAGQ

SEQ ID NO: 6182 - protein, 112 aa, Zea mays
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGEQ

SEQ ID NO: 6183 - protein, 112 aa, Panicum virgatum
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGDQ

SEQ ID NO: 6184 - protein, 112 aa, Persea americana
MVAVKKSKKTHESINNRLALVMKSGKYTLGYKTVLKSLRSSKGKLIIIANNCPPLRKSEIEYYAMLAKVGVHHFNGNNVDLGTACGKYYRVCCLSIIDPGDSDIIKSVPGDQ

SEQ ID NO: 6185 - protein, 112 aa, Unknown
  Sequence found in Organisms: Zea mays, Sorghum bicolor, Saccharum officinarum
MVAAKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGEQ

SEQ ID NO: 6186 - protein, 112 aa, Panicum virgatum
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTSGDQ

SEQ ID NO: 6187 - protein, 126 aa, Triticum aestivum
MVATKKTKKSTDNINNKLQLVMKSGKYTLGYKTVLRTLRNSKSKLVIIANNCPPLRKSEIEYYAMLAKSLSTTSMETMSTLELPVVNTSGCCLSIMILGDLISSRLHRVSSKEPCSRGSYAFVLVC

SEQ ID NO: 6188 - protein, 90 aa, Sequoia sempervirens
MAITKKTKKTHENINSRLALVMKSGKYTLGYKSVLHSLRSSKGNLLSLLTIALHYKSQKLSIMPCLRKLECIISMETMLIWELHVANIIV

SEQ ID NO: 6189 - protein, 112 aa, Ananas comosus
MAPAKKTKKSTESINNKLALVMKSGKYTLGYKTVLRTLRSSKGKLIIIANNCPPLRKSEIEYYAMLAKVGVHHFNGNNVDLGTACGKYFRVCCLSIVDAGDSEILKSIPGDQ

SEQ ID NO: 6190 - protein, 112 aa, Unknown
  Sequence found in Organisms: Sorghum bicolor, Saccharum officinarum
MVAAKKTKKSTDNINNKLQLVMKSGKYTLGYKTVLRTIRNSKSKLVIIANNCPPLRKSEIEYYAMLAKVTVHHFHGNNVDLGTACGKYFRVCCLSIIDPGDSDIIKTTPGEQ

SEQ ID NO: 6191 - protein, 111 aa, Oryza sativa
MVAAKKTKKSTDNINNKLQLVMKSGKYTLGYKTVLRTLRNSKAKLVIISNNCPPLRKSEIEYYAMLAKVTVHHFHGNNVDLGTACGKYFRVCCLSIIDPGDSDIIKTTGEQ

SEQ ID NO: 6192 - protein, 54 aa, Cajanus cajan
MVAAKKTKKTHESINNRLALVMKSGKYTLGYKTVLKSLRSSKGNSLSLPTTVPL

SEQ ID NO: 6193 - protein, 91 aa, Sequoia sempervirens
MKSGKYTLGYKTTLKSIRTNKGKLIIIANNCPPLRRSEIEYYAMLAKIGVHHFNGNNVDLGTACGKYYRVCCLSITDPGDSDIIKTVPSDQ

SEQ ID NO: 6194 - protein, 113 aa, Hordeum vulgare
MVASTKKTKKSGDNINNKLQLVMKSGKYTLGYKTVLRTLRNSKAKLVILANNCPPLRKSEIEYYAMLAKVTVHHYHGNNVDLGTACGKYFRVCCLSIIDPGDSDIINATPAGQ

SEQ ID NO: 6195 - protein, 113 aa, Brachypodium distachyon
MVASTKKAKKSGDNINNKLQLVMKSGKYTLGYKTVLRTLRNSKSKLVIIANNCPPLRKSEIEYYAMLAKVTVHHYHGNNVDLGTACGKYFRVCCLSIIDPGDSDIINTTPGGQ

SEQ ID NO: 6196 - protein, 113 aa, Festuca arundinacea
MVASTKKAKKSGDNINNKLQLVMKSGKYTLGYKTVLKTLRNSKSKLVIIANNCPPLRKSEIEYYAMLAKVTVHHFHGNNVDLGTSCGKYFSVCCLSIIDPGDSDIITSTPAGQ

SEQ ID NO: 6197 - protein, 113 aa, Triticum aestivum
MVTSTKKTKKSGDNINNKLQLVMKSGKYTLGYKTVLRTLRNSKAKLVILANNCPPLRKSEIEYYAMLAKITVHHYHGNNVDLGTACGKYFRVCCLSIIDPGDSDIINATPAGQ

SEQ ID NO: 6198 - protein, 112 aa, Musa acuminata
MAPVKKAKKSTESINNRLALVMKSGKYTLGYKTVLRSLRNSKGKLIIIANNCPPLRKSEIEYYAMLAKVGVHHFSGSNVDLGTACGKYFRVCCLSIIDPGDSDIIKSIPGEQ

SEQ ID NO: 6199 - protein, 112 aa, Cicer arietinum
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIVDPGDSDIIKTMPTDQ

SEQ ID NO: 6200 - protein, 112 aa, Unknown
  Sequence found in Organisms: Glycine max, Phaseolus coccineus, Vigna unguiculata, Arachis hypogaea, Cajanus cajan
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIIDPGDSDIIKTLPGEQ

SEQ ID NO: 6201 - protein, 112 aa, Epimedium sagittatum
MVAAKKTKKSYDNINTKLALVMKSGKYTLGYKTVLKSLRSSKGKLIIIANNCPPLRKSEIEYYAMLAKVGVHHFNGNNVDLGTACGKYYRVCCLSIIDAGDSDIIKSIPGDQ

SEQ ID NO: 6202 - protein, 112 aa, Elaeis guineensis
MAPTKKAKKSTESINNRLALVMKSGKYTLGYKTVLRSLRNSKGKLILIANNCPPLRKSEIEYYAMLAKVGVHHFNGNNVDLGTACGKYFRVSCLSIIDPGDSDIIKSIPGDQ

SEQ ID NO: 6203 - protein, 112 aa, Aristolochia fimbriata
MVATKKTKKTHESINNRLALVMKSGKYTLGYKTVLKSLRSSKGKLVIIANNCPPLRKSEIEYYAMLAKCGVHHFNGNNVDLGTACGKYYRVCCLSIIDPGDSDIIKSLPGDQ

SEQ ID NO: 6204 - protein, 112 aa, Musa acuminata
MAPVKKAKKSTESINNRLALVMKSGKYTLGYKTVLRSLRNSKGKLIIIANNCPPLRKSEIEYYAMLAKVGVHHFSGSNVDLGTACGKYFRVCCLSIIDPGDSDIIKSIPREQ

SEQ ID NO: 6205 - protein, 112 aa, Phaseolus coccineus
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIVDPGDSDIIKTMPTEQ

SEQ ID NO: 6206 - protein, 112 aa, Chelidonium majus
MVAAKKTKKTHESINNRLALVMKSGKYTLGYKTVLRSLRSSKGKLIIIANNCPPLRKSEIEYYAMLAKVGVHHFNGNNVDLGTACGKYYRVCCLSIIDPGDSDIIKTIPGDQ

SEQ ID NO: 6207 - protein, 112 aa, Zingiber officinale
MAPVKKSKKNAENINSRLALVMKSGKYTLGYKTVLRTLRISKAKLIIIANNCPPLRKSEIEYYAMLAKVGVHHFSGNNVDLGTACGKYFRVCCLSIIDPGDSDIIKSIPGDQ

SEQ ID NO: 6208 - protein, 112 aa, Vitis vinifera
MAAPKKTKKTQENINNKLALVMKSGKYTLGYKTVLKSLRSSKGKLILISNNCPPLRKSEIEYYAMLSKVSVHHFHGNNVDLGTACGKYFRVSCLSIVDPGDSDIIKQMPSDH

SEQ ID NO: 6209 - protein, 112 aa, Lotus japonicus
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIIDPGDSDIIKTLPGDQ

SEQ ID NO: 6210 - protein, 112 aa, Lotus japonicus
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIIDPGDSDIIKTLPSDQ

SEQ ID NO: 6211 - protein, 112 aa, Unknown
  Sequence found in Organisms: Medicago truncatula, Trigonella foenum-graecum
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIVDPGDSDIIKTIPGDQ

SEQ ID NO: 6212 - protein, 112 aa, Carica papaya
MVSAKKTKKTHESINNRLALVMKSGKYTLGYKTVLKSLRSSKGKLIIISNNCPPLRKSEIEYYAMLAKIGVHHFNGNNVDLGTACGKYYRVSCLSIVDPGDSDIIKTLPGDQ

SEQ ID NO: 6213 - protein, 112 aa, Oryza sativa
MAPVKKTKKNAEGINNKLQLVMKSGKYTLGYKTVLKTLRNSKGKLVIVANNCPPLRKSEIEYYAMLGKVSVYHFNGNNVDLGTACGKYYRVCCLSVVDPGDSDITKQLPESH

SEQ ID NO: 6214 - protein, 112 aa, Trigonella foenum-graecum
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIVDPGDSDIIKTIPGEQ

SEQ ID NO: 6215 - protein, 111 aa, Cucumis sativus
MVAAKKTKKTHESINNRLALVMKSGKYTLGYKTVLKTLRSSKGKLIIIANNCPPLRKSEIEYYAMLAKVGVHHYNGSNVDLGTACGKYYRVCCLSIIDPGDSDIIKSMPES

SEQ ID NO: 6216 - protein, 112 aa, Amborella trichopoda
MVTAKKTKKTQESINNRLALVMKSGKYTLGYKTVLRSLRSSKGKLIIIANNCPPLRKSEIEYYAMLAKVGVHHFNGNNVDLGTACGKYFRVCCLSITDPGDSDIIKSIPGDQ

SEQ ID NO: 6217 - protein, 112 aa, Musa acuminata
MAPVKKAKKSTESINNRLALVMKSGKYTLGYKTVLRSLRSSKAKLVMIANNCPPLRKSEIEYYAMLAKVGVHHFSGSNVDLGTACGKYFRVCCLSIIDPGDSDIIKSMPGEQ

SEQ ID NO: 6218 - protein, 112 aa, Fagus grandifolia
MVAAKKTKKTHESINNRLALVMKSGKYTLGYKTVLKTLRNSKGKLVIIANNCPPLRKSEIEYYAMLAKVGVHHYNGNNVDLGTACGKYYRVCCLSIIDPGDSDIIKSIPGEH

SEQ ID NO: 6219 - protein, 112 aa, Unknown
  Sequence found in Organisms: Cannabis sativa, Humulus lupulus
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKNMPGEH

SEQ ID NO: 6220 - protein, 112 aa, Cicer arietinum
MVAAKKTKKTHESINNRLALVMKSGKFTLGYKTVLKSLRSSKGKLIIIANNCPPLRKSEIEYYAMLAKVGVHHYNGNNVDLGTACGKYYRVCCLSIIDPGDSDIIKSIPGDQ

SEQ ID NO: 6221 - protein, 112 aa, Medicago truncatula
MVAAKKTKKTHESINNRLALVMKSGKYTLGYKTVLKSLRNNKGKLIIIANNCPPLRKSEIEYYAMLAKVGVHHYNGNNVDLGTACGKYYRVCCLSIVDPGDSDIIKTIPGDQ

SEQ ID NO: 6222 - protein, 112 aa, Elaeis guineensis
MAPPKKAKKSAESINNRLALVMKSGKYTLGYKTVLRSLRNSKGKLILIANNCPPLRKSEIEYYAMLAKVGVHHFNGNNVDLGTACGKYFRVSCLSIIDPGDSDIIKSIPGDQ

SEQ ID NO: 6223 - protein, 112 aa, Allium cepa
MAPIKKTKKTTESINNRLALVMKSGKYTLGFKTVLRSLRNSKGKLIIIANNCPPLRRSLIEYYAMLAKVGVHHFNGNNVDLGTACGKYFRVCCLSIIDPGDSDIIKTLPGDQ

SEQ ID NO: 6224 - protein, 112 aa, Acacia harpophylla
MVAAKKTKKTHESINNRLALVMKSGKYTLGYKTVLKSLRNSKGKLIIIANNCPPLRKSEIEYYAMLAKVGVHHYNGNNVDLGTACGKYFRVCCLSIIDPGDSDIIKTMPSEQ

SEQ ID NO: 6225 - protein, 112 aa, Amborella trichopoda
MVNTKKTKKTHESINNRLALVMKSGKYTLGYKTVLKSMRNSKGKLIIIANNCPPLRKSEIEYYAMLCKVGVHHFNGNNVDLGTACGKYYRVSCLSITDPGDSDIIKTLPGDL

SEQ ID NO: 6226 - protein, 112 aa, Amorphophallus konjac
MVSTKKTKKTHESINNRLALVMKSGKYTLGYKTVLRTLRSSKAKLIIISNNCPPLRKSEIEYYAMLAKVGVHHFNGNNVDLGTACGKYFRVCCLSIIDPGDSDIIKSLPGDQ

SEQ ID NO: 6227 - protein, 112 aa, Aquilegia formosa
MVAAKKTKKTHESINNRLALVMKSGKYTLGYKTVLDSLRSSKGKLIIIANNCPPLRKSEIEYYAMLAKVGVHHFNGNNVDLGTACGKYFRVSCLSIIDPGDSDIIKTLPGDH

SEQ ID NO: 6228 - protein, 112 aa, Aristolochia fimbriata
MVTAKKTKKTHESINNRLALVIKSGKYTLGYKTVLKSLRSSKGKLIIIANNCPPLRKSEIEYHAMLAKCGVHHFNGNNVDLGTACGKYYRVCCLSIIDPGDSDIIKSLPGDQ

SEQ ID NO: 6229 - protein, 112 aa, Manihot esculenta
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIVDPGDSDIIKSMPGDH

SEQ ID NO: 6230 - protein, 112 aa, Ricinus communis
MVVAKKTKKTHESINNRLALVMKSGKYTLGYKTVLKSLRSSKGKLVIIANNCPPLRKSEIEYYAMLAKVGVHHYNGNNVDLGTACGKYYRVCCLSIIDPGDSDIIKSMPGEH

SEQ ID NO: 6231 - protein, 112 aa, Unknown
  Sequence found in Organisms: Castanea mollissima, Quercus alba
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKSMPGDH

SEQ ID NO: 6232 - protein, 112 aa, Cryptomeria japonica
MAITKKTKKTHENINSRLALVMKSGKYTLGCKTVLHSLRSSKGKLIIISNNCPPLQKSEIEYYAMLAKIGVHHFHGNNVDLGTACGKYFRVSCLSITDPGDSDIIKAAPSAP

SEQ ID NO: 6233 - protein, 112 aa, Cucumis sativus
MAPAKKTKKTHESINNRLALVMKSGKYTLGYKTVLRTIRGSKGKLIILSNNCPPLRKSEIEYYAMLAKIGVHHYNGSNVDLGTACGKYYRVSCLSIIDPGDSDIIKSLPGDQ

SEQ ID NO: 6234 - protein, 112 aa, Cucurbita pepo
MVAAKKTKKTHESINNRLALVMKSGKYTLGYKTVLKTLRNSKGKLIIIANNCPPLRKSEIEYYAMLAKVGVHHYNGSNVDLGTACGKYYRVCCLSIIDPGDSDIIKSLPGES

SEQ ID NO: 6235 - protein, 112 aa, Distylium racemosum
MVATKKTKKAHESINNRLALVMKSGKYTLGYKTTLKSIRTNKGKLVIIANNCPPLRRSEIEYYAMLAKIGVHHFNGNNVDLGTACGKYYRVCCLSITDPGDSDIIKTVPSDQ

SEQ ID NO: 6236 - protein, 113 aa, Eucalyptus grandis
MVAAKKTKKTHESINNRLALVMKSGKYTLGYKTVLKTLRNSKGKLVIIANNCPPLRKSEIEYYAMLAKVGVHHYNGNNVDLGTACGKYYRVCCLSIIDPGDSDIIKSMPGGDH

SEQ ID NO: 6237 - protein, 112 aa, Zingiber officinale
MAPVKKTKKNAESINSRLALVMKSGKYTLGYKTVLKSLRGSKGKLIIISNNCPPLRKSEIEYYAMLAKVGVHHFNGNNVDLGTACGKYFRVCCLSIIDPGDSDIIKSIPGEQ

SEQ ID NO: 6238 - protein, 112 aa, Momordica charantia
MVAAKKTKKTHESINNRLALVMKSGKYTLGYKTVLKTLRNSKGKLIIIANNCPPLRKSEIEYYAMLAKVGVHHYNGSNVDLGTACGKYYRVCCLSIIDPGDSDIIKSIPGES

SEQ ID NO: 6239 - protein, 112 aa, Phalaenopsis aphrodite
MPPTKKTKKSTESINNRLALVMKSGKYTLGYKTVLRSLRNNKGKLVIIANNCPPLRKSEIEYYAMLGKVGVHHFNGNNVDLGTACGKYFRVCCLSIIDPGDSDIIKSIPGDQ

SEQ ID NO: 6240 - protein, 132 aa, Lippia dulcis
LLPSPPHPHSPPPHFPVSTVVATGKKTKKTHENINNRLALVMKSGKYTLGYKTVLKTLRSSKGKLILISNNCPPLRKSEIEYYAMLAKIGVHHYSGNNVDLGTACGKYFRVSCLSIVDPGDSDIIKNLPGDH

SEQ ID NO: 6241 - protein, 91 aa, Cajanus cajan
MKSGKYTLGYKTVLKSLRSSKGKLIIIANNCPPLRKSEIEYYAMLAKVGVHHYNGNNVDLGTACGKYYRVCCLSIIDPGDSDIIKTLPGEQ

SEQ ID NO: 6242 - protein, 112 aa, Platanus occidentalis
MVATKKTKKTHESINNRLALVMKSGKYTLGYKTVLRSLRNSKGKLIIIANNCPPLRKSEIEYYAMLAKVGVHHFNGNNVDLGTACGKYFRVCCLSIIDPGDSDIIKSMPSDH

SEQ ID NO: 6243 - protein, 112 aa, Platanus occidentalis
MVATKKTKKTHESINNRLALVMKSGKYTLGYKTVLRSLRNSKGKLIIIANNCPPLRKSEIEYYAMLAKVGVHHFNGNNVDLGTACGKYFRVCCLSIIDPGDSDIIKSMPSDQ

SEQ ID NO: 6244 - protein, 112 aa, Populus trichocarpa
MVTAKKTKKTHESINNRLALVMKSGKYTLGYKTVLKTLRSSKGKLILLSNNCPPLRKSEIEYYAMLAKVGVHHYNGNNVDLGTACGKYFRVSCLSIIDAGDSDIIKTVPGDH

SEQ ID NO: 6245 - protein, 112 aa, Primula obconica
MPAGKKTKKTHESINNRLALVMKSGKYTLGYKTVLKTLRSSKGKLIIISNNCPPLRKSEIEYYAMLAKVGVHHYSGNNVDLGTACGKYFRVSCLSIVDPGDSDIIKTLPGDQ

SEQ ID NO: 6246 - protein, 100 aa, Primula obconica
MPAGKKTKKTHESINNRLALVMKSGKYTLGYKTVLKTLRSSKGKLIIISNNCPPLRKSEIEYYAMLAKVGVHHYSGNNVDLGTACGKYFRVSCLSIVDPR

SEQ ID NO: 6247 - protein, 112 aa, Glycine max
MVAAKKTKKTHESINNRLALVMKSGKFTLGYKTVLKSLRNSKGKLIIIANNCPPLRKSEIEYYAMLAKVGVHHYNGNNVDLGTACGKYYRVCCLSIIDPGDSDIIKTLPGDQ

SEQ ID NO: 6248 - protein, 112 aa, Nicotiana tabacum
MVAAKKTKKTHESINNRLALVMKSGKYTLGYKTVLKTLRNSKGKLVIIANNCPPLRKSEIEYYAMLAKIGVHHYNGNNVDLGTACGKYFRVCCLSIIDPGDSDIIKSMPGDQ

SEQ ID NO: 6249 - protein, 112 aa, Nicotiana tabacum
MVAAKKTKKTHESINNRLALVMKSGKYTLGYKTVLKTLRNSKGKLIIIANNCPPLRKSEIEYYAMLAKVGVHHYNGNNVDLGTACGKYFRVCCLSIIDPGDSDIIKSMPDDK

SEQ ID NO: 6250 - protein, 112 aa, Triphysaria pusilla
MAATKKTKKTHESINNRLALVMKSGKYTLGYKTVLKTLRSSKGKLILISNNCPPLRKSEIEYYAMLAKVGVHHYNGNNVDLGTACGKYFRVSCLSIVDPGDSDIIKSLPGDH

SEQ ID NO: 6251 - protein, 112 aa, Zamia vazquezii
MVTVKKTKKTHESINNRLALVMKSGKYTLGYKTVLRSLRSSKAKLIIIANNCPPLRKSEIEYYAMLAKVGVHHFNGNNVDLGTACGKYFRVGCLSITDPGDSDIIKTVPSDQ

SEQ ID NO: 6252 - protein, 112 aa, Zostera marina
MVVGKKTKKTHDNINNRLALVMKSGKYTLGYKTVLKTLRNSKSKLIIISNNCPPLRKSEIEYYAMLAKIGVHHFNGNNVDLGTACGKYYRVGCLSIIDPGDSDIIKSLPSDH

SEQ ID NO: 6253 - protein, 113 aa, Unknown
  Sequence found in Organisms: Pseudoroegneria spicata, Secale cereale
MVTSTKKTKKSGDNINNKLQLVMKSGKYTLGYKTVLRTLRNSKAKLVILANNCPPLRKSEIEYYAMLAKVTVHHYHGNNVDLGTACGKYFRVCCLSIIDPGDSDIINATPAGQ

SEQ ID NO: 6254 - protein, 112 aa, Eschscholzia californica
MVAAKKTKKTHESINNRLALVMKSGKYTLGYKTVLRTLRSSKGKLIIIANNCPPLRKSEIEYYAMLAKVGVHHYNGNNVDLGTACGRYYRVCCLSIIDPGDSDIIKTIPGDQ

SEQ ID NO: 6255 - protein, 112 aa, Plantago ovata
MAPTKKTKKTHESINNRLALVMKSGKYTLGYKTVLKSLRSSKGKLILISNNCPPLRKSEIEYYAMLAKIGVHHYSGNNVDLGTACGKFHRVSCLSIIDPGDSDIIKTLPGDN

SEQ ID NO: 6256 - protein, 112 aa, Unknown
  Sequence found in Organisms: Cucurbita pepo, Cucumis melo, Citrullus lanatus
MAPAKKTKKTHESINNRLALVMKSGKYTLGYKTVLRTIRSSKGKLIILSNNCPPLRKSEIEYYAMLAKIGVHHYNGSNVDLGTACGKYYRVSCLSIIDPGDSDIIKSLPGDQ

SEQ ID NO: 6257 - protein, 112 aa, Persea americana
MVAAKKTKKSHESINNRLALVMKSGKYTLGYKTVLKSLRSSKGKLIIIANNCPPLRKSEIEYYAMLSKVGVHHFNGNNVDLGTACGKYYRVCCLSIIDAGDSDIIKSIPGDQ

SEQ ID NO: 6258 - protein, 112 aa, Musa acuminata
MAPVKKAKKSTESINNRLALVMKSGKYTLGYKTVLRSLRNSKGKLIIIANNCPPLRKSEIEYYAMLGKVGVHHFSGSNVDLGTACGKYFRVCCLSIIDPGDSDIIKSIPGEQ

SEQ ID NO: 6259 - protein, 112 aa, Unknown
  Sequence found in Organisms: Cephalotaxus harringtonia, Cryptomeria japonica
MVATKKTKKAHESINNRLALVMKSGKYTLGYKTTLKSIRTNKGKLIIIANNCPPLRRSEIEYYAMLAKIGVHHFNGNNVDLGTACGKYYRVCCLSITDPGDSDIIKTVPSDQ

SEQ ID NO: 6260 - protein, 112 aa, Chelidonium majus
MVAAKKTKKTHESINNRLALVMKSGKYTLGYKTVLRSLRSSKGKLIIIANNCPPLRKSEIEYYAMLAKVGVHHFNGNNVDLGTACGKYYRVCCLSIIDPGDSDIIKSIPGDQ

SEQ ID NO: 6261 - protein, 112 aa, Vigna unguiculata
MVAAKKTKKTHESINNRLALVMKSGKYTLGYKTVLKSLRSSKGKLIIVANNCPPLRKSEIEYYAMLAKVGVHHYNGNNVDLGTACGKYYRVCCLSIIDPGDSDIIKTMNTEQ

SEQ ID NO: 6262 - protein, 112 aa, Cucurbita pepo
MVAAKKTKKTHESINNRLALVMKSGKYTLGYKTVLKTLRSSKGKLIIIANNCPPLRKSEIEYYAMLAKVGVHHYNGSNVDLGTACGKYYRVCCLSIIDPGDSDIIKSIPGDS

SEQ ID NO: 6263 - protein, 112 aa, Cyamopsis tetragonoloba
MVAAKKTKKTHESINNRLALVMKSGKYTLGYKTVLKTLRNSKGKLIIIANNCPPLRKSEIEYYAMLAKVGVHHYNGNNVDLGTACGKYFRVCCLSIIDPGDSDIIKTLPGEH

SEQ ID NO: 6264 - protein, 112 aa, Cyamopsis tetragonoloba
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKTLPGDQ

SEQ ID NO: 6265 - protein, 112 aa, Cycas rumphii
MVTVKKTKKTHESINNRLALVMKSGKYTFGYKTVLKSLRNSKGKLIIIANNCPPLRKSEIEYYAMLAKIGVHHFNGNNVDLGTACGKYFRVGCLSITDPGDSDIIKTVPSDQ

SEQ ID NO: 6266 - protein, 112 aa, Solanum melongena
MVASKKTKKTHESINNRLALVMKSGKYTLGYKTVLKTLRNSKGKLIIIANNCPPLRKSEIEYYAMLAKVGVHHYNGNNVDLGTACGKYYRVCCLSIIDPGDSDIIKSMPSDQ

SEQ ID NO: 6267 - protein, 112 aa, Ipomoea nil
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIIDPGDSDIIKSMPSDQ

SEQ ID NO: 6268 - protein, 112 aa, Glycyrrhiza uralensis
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKTMPNEQ

SEQ ID NO: 6269 - protein, 112 aa, Glycyrrhiza uralensis
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKTMPSEQ

SEQ ID NO: 6270 - protein, 112 aa, Liriodendron tulipifera
  misc_feature (15)..(15): Xaa can be any naturally occurring amino acid
MVATKKTKKTHESIXNRLALVMKSGKYTLGYKTVLRSLRSSKGKLIIIANNCPPLRKSEIEYYAMLAKVGVHHFNGNNVDLGTACGKYYRVCCLSIIDPGDSDIIKSIPGDQ

SEQ ID NO: 6271 - protein, 112 aa, Liriodendron tulipifera
MVATKKTKKTHESINNRLALVMKSGKYTLGYKTVLRSLRSSKGKLIIISNNCPPLRKSEIEYYAMLAKVGVHHFNGNNVDLGTACGKYYRVSCLSIIDPGDSDIIKTLPGDQ

SEQ ID NO: 6272 - protein, 112 aa, Lotus japonicus
MVAAKKTKKTHESINNRLALVMKSGKFTLGYKTVLKSLRSSKGKLIIIANNCPPLRKSEIEYYAMLAKVGVHHYNGNNVDLGTACGKYYRVCCLSIIDPGDSDIIKTLPGDQ

SEQ ID NO: 6273 - protein, 112 aa, Nuphar advena
MASTKKAKKTHESINNRLALVMKSGKYTLGYKTVLRSLRSSKAKLIIIANNCQPLRKSEIEYYAMLAKVGVHHFNGNNVDLGTACGKYFRVCCLSITDPGDSDIIKSVPGDQ

SEQ ID NO: 6274 - protein, 112 aa, Arachis hypogaea
MVAAKKTKKTHESINNRLALVMKSGKYTLGYKTVLKSLRTSKGKLIIIANNCPPLRKSEIEYYAMLAKVGVHHYNGNNVDLGTACGKYYRVCCLSIIDPGDSDIIKTLPAEQ

SEQ ID NO: 6275 - protein, 112 aa, Arachis hypogaea
MVAAKKTKKTHESINNRLALVMKSGKYTLGYKTVLKSLRNSKGKLIIIANNCPPLRKSEIEYYAMLAKVGVHHYNGNNVDLGTACGKYYRVCCLSIIDPGDSDIIKTLPGEQ

SEQ ID NO: 6276 - protein, 112 aa, Pisum sativum
MVAAKKTKKTHESINNRLALVMKSGKYTLGYKTVLKSLRSSKGKLIIIANNCPPLRKSEIEYYAMLAKVGVHHYNGNNVDLGTACGKYYRVCCLSIVDPGDSDIIKSIPGDQ

SEQ ID NO: 6277 - protein, 112 aa, Unknown
  Sequence found in Organisms: Solanum lycopersicum, Capsicum annuum
MVAAKKTKKTHESINNRLALVMKSGKYTLGYKTVLKTLRNSKGKLIIIANNCPPLRKSEIEYYAMLAKVGVHHYNGNNVDLGTACGKYYRVCCLSIIDPGDSDIIKSMPGDQ

SEQ ID NO: 6278 - protein, 112 aa, Phalaenopsis aphrodite
MAPVKKAKKSTESINNRLALVMKSGKYTLGYKTVLRSLRNSKGKLVIIANNCPPLRKSEIEYYAMLGKVGVHHFNGNNVDLGTACGKYFRVCCLSIIDPGDSDIIKSLPGDH

SEQ ID NO: 6279 - protein, 112 aa, Unknown
  Sequence found in Organisms: Solanum tuberosum, Solanum phureja
MVAAKKTKKTHESINNRLALVMKSGKYTLGYKTVLKTLRNSKGKLIIIANNCPPLRKSEIEYYAMLAKVGVHHYNGNNVDLGTACGKYYRVCCLSIIDPGDSDIIKSIPGDQ

SEQ ID NO: 6280 - protein, 112 aa, Glycine max
MVAAKKTKKTHESINNRLALVMKSGKFTLGYKTVLKSLRSSKGKLIIIANNCPPLRKSEIEYYAMLAKVGVHHYNGNNVDLGTACGKYYRVCCLSIIDPGDSDIIKTLPGEQ

SEQ ID NO: 6281 - protein, 111 aa, Carpinus betulus
MVAAKKTKKTHESINNRLALVMKSGKYTLGYKTVLKSLRSSKGKLVIIANNCPPLRKSEIEYYAMLAKIGVHHYNGNNVDLGTACGKYFRVCCLSIIDPGDSDIIKSMPDY

SEQ ID NO: 6282 - protein, 111 aa, Cucumis melo
MVAAKKTKKTHESINNRLALVMKSGKYTLGYKTVLKTLRNSKGKLIIIANNCPPLRKSEIEYYAMLAKVGVHHYNGSNVDLGTACGKYYRVCCLSIIDPGDSDIIKSMPES

SEQ ID NO: 6283 - protein, 113 aa, Ipomoea batatas
MVTTGKKTKKTHESINNRLALVMKSGKYTLGYKTVLKTLRSSKGKLILISNNCPPLRKSEIEYYAMLAKIGVHHYNGNNVDLGTACGKYFRVSCLSIVDPGDSDIIKSLPSEQ

SEQ ID NO: 6284 - protein, 113 aa, Vinca minor
MAATGKKVKKTHESINNRLQLVMKSGKYTLGYKTVLKTLRSSKGKLILISNNCPPLRKSEIEYYAMLAKVGVHHYSGNNVDLGTACGKYFRVSCLSVIDPGDSDIIKSLPGDQ

SEQ ID NO: 6285 - protein, 113 aa, Vinca minor
MATTGKKVKKTHESINNRLQLVMKSGKYTLGYKTVLKTLRSSKGKLILISNNCPPLRKSEIEYYAMLAKVGVHHYSGNNVDLGTACGKYFRVSCLSVIDPGDSDIIKSLPGDQ

SEQ ID NO: 6286 - protein, 112 aa, Musa acuminata
MAPVKKAKKSTESINNRLALVMKSGKYTLGYKTVLRSLRSSKAKLVMISNNCPPLRKSEIEYYAMLAKVGVHHFSGSNVDLGTACGKYFRVCCLSIIDPGDSDIIKSMPGEQ

SEQ ID NO: 6287 - protein, 112 aa, Vaccinium corymbosum
MAAGKKTKKTHESINNRLALVMKSGKFTLGYKTVLKTLRSSKGKLIIISNNCPPLRKSEIEYYAMLSKVGVHHYNGNNVDLGTACGKYFRVSCLSIIDPGDSDIIKTLPGDQ

SEQ ID NO: 6288 - protein, 112 aa, Unknown
  Sequence found in Organisms: Gossypium hirsutum, Gossypium raimondii, Heritiera littoralis
MVAAKKTKKTHESINNRLALVMKSGKYTLGYKTVLKSLRSSKGKLIIIANNCPPLRKSEIEYYAMLCKVGVHHYNGNNVDLGTACGKYFRVCCLSIIDPGDSDIIKSMPGDH

SEQ ID NO: 6289 - protein, 112 aa, Allium cepa
MAPIKKTKKTTESINNRLALVMKSGKYTLGFKTVLRSLRSSKAKLVIIANNCPPLRRSLIEYYAMLAKVGVHHFNGNNVDLGTACGKYFRVCCLSIIDPGDSDIIKTLPGDQ

SEQ ID NO: 6290 - protein, 112 aa, Papaver somniferum
MVAVKKMKKTHESINNRLALVMKSGKYTLGYKTVLRTLRSSKSKLIIISNNCPPLRKSEIEYYAMLAKVGVHHFNGNNVDLGTACGRYYRVSCLSIIDPGDSDIIKTLPGDQ

SEQ ID NO: 6291 - protein, 112 aa, Papaver somniferum
MVVAKKMKKTHESINNRLALVMKSGKYTLGYKTVLRTLRSSKSKLIIISNNCPPLRKSEIEYYAMLAKVGVHHFNGNNVDLGTACGRYYRVSCLSIIDPGDSDIIKTLPGDQ

SEQ ID NO: 6292 - protein, 112 aa, Papaver somniferum
MVMAKKMKKTHESINNRLALVMKSGKYTLGYKTVLRTLRSSKSKLIIISNNCPPLRKSEIEYYAMLAKVGVHHFNGNNVDLGTACGRYYRVSCLSIIDPGDSDIIKTLPGDQ

SEQ ID NO: 6293 - protein, 112 aa, Aquilegia formosa
MVAAKKTKKTHESINNRLALVMKSGKYTLGYKTVLDSLRSSKGKLIIIANNCPPLRKSEIEYYVMLAKVGVHHFNGNNVDLGTACGKYFRVPCLSIIDPGDSDIIKTLPGDH

SEQ ID NO: 6294 - protein, 112 aa, Manihot esculenta
MVAAKKTKKTHESINNRLALVMKSGKYTLGYKTVLKSLRNSKGKLIIIANNCPPLRKSEIEYYAMLAKVGVHHYNGNNVDLGTACGKYFRVCCLSIIDPGDSDIIKSMPGDH

SEQ ID NO: 6295 - protein, 112 aa, Catharanthus roseus
MAPGKKVKKTHESINNRLALVMKSGKYTLGYKTVLKTLRNSKGKLILISNNCPPLRKSEIEYYAMLAKVGVHHYNGNNVDLGTACGKYFRVSCLSIVDPGDSDIIKSLPGDQ

SEQ ID NO: 6296 - protein, 112 aa, Chelidonium majus
MVAVKKTKKTHESINNRLALVMKSGKYTLGYKTVLRTLRSSKSKLIIISNNCPPLRKSEIEYYAMLAKVGVHHFNGNNVDLGTACGRYYRVSCLSIVDPGDSDIIKTLPGDQ

SEQ ID NO: 6297 - protein, 112 aa, Cirsium arvense
MVSGKKTKKTHESINNRLALVMKSGKYTLGYKTVLESLRSSKGKLIIISNNCPPLRKSEIEYYAMLAKIGVHHYNGNNVDLGTACGKYFRVSCLSIVDPGDSDIIKTLPGDN

SEQ ID NO: 6298 - protein, 112 aa, Cucurbita pepo
MAPAKKTKKTHESINNRLALVMKSGKYTLGYKTVLRTIRSSKGKLIILSNNCPPLRKSEIEYYAMLAKVGVHHYNGSNVDLGTACGKYFRVSCLSIIDPGDSDIIKSLPSEQ

SEQ ID NO: 6299 - protein, 112 aa, Eucalyptus grandis
MVASKKTKKTHESINNRLALVMKSGKYTLGYKTVLKTLRNSKGKLVIIANNCPPLRKSEIEYYAMLAKVGVHHYNGNNVDLGTACGKYFRVCCLSIIDPGDSDIIKSMPGDS

SEQ ID NO: 6300 - protein, 112 aa, Fagopyrum esculentum
MVAAKKTKKTHESINNRLALVMKSGKYTLGYKTVLKTLRSSKAKLVIISNNCPPLRKSEIEYYAMLAKVGVHHYNGNNVDLGTACGKYYRVCCLSIIDPGDSDIIKNMPSDH

SEQ ID NO: 6301 - protein, 112 aa, Zingiber officinale
  misc_feature (40)..(40): Xaa can be any naturally occurring amino acid
  misc_feature (48)..(48): Xaa can be any naturally occurring amino acid
  misc_feature (58)..(58): Xaa can be any naturally occurring amino acid
  misc_feature (80)..(80): Xaa can be any naturally occurring amino acid
MAPVKKSKKNAENINSRLALVMKSGKYTLGYKTVLRTLRXSKAKLIIXSNNCPPLRKXEIEYYAMLAKVGVHHFSGNNVXLGTACGKYFRVCCLSIIDPGDSDIIKSIPGDQ

SEQ ID NO: 6302 - protein, 112 aa, Vitis vinifera
MVAGKKTKKTHESINNRLALVMKSGKYTLGYKTVLKSLRSSKGKLILISNNCPPLRKSEIEYYAMLAKVGVHHFNGNNVDLGTACGKYFRVSCLSIIDPGDSDIIKTLPGDH

SEQ ID NO: 6303 - protein, 114 aa, Humulus lupulus
MVAAKKTKKTHESINNRLALVMKSGKYTLGYKTVLKSLRNSKGKLIIIANNCPPLRKSEIEYYAMLAKVGVHHYNWEQRRRGDCMWKNTTEYAALALLIQVIRISLRTCLVNIK

SEQ ID NO: 6304 - protein, 112 aa, Ipomoea nil
MVAAKKTKKTHESINNRLALVMKSGKYTLGYKTVLKSLRSSKGKLIIISNNCPPLRKSEIEYYAMLAKVGVHHYNGNNVDLGTACGKYFRVCCLSIIDPGDSDIIKSLPSEQ

SEQ ID NO: 6305 - protein, 112 aa, Nuphar advena
MASTKKTKKTHESINNRLALVMKSGKYTLGYKTVLRSLRGSKAKLIIISNNCPPLRKSEIEYYAMLSKVGVHHFNGNNVDLGTACGKYYRVCCLSITDPGDSDIIKSIPSEQ

SEQ ID NO: 6306 - protein, 112 aa, Carica papaya
MVSAKKTKKTHESINNRLALVMKSGKFTLGYKTVLKSLRNSKGKLIIISNNCPPLRKSEIEYYAMLAKIGVHHFNGNNVDLGTACGKYFRVSCLSIIDPGDSDIIKTLPGDQ

SEQ ID NO: 6307 - protein, 112 aa, Petunia hybrida
MVAAKKTKKTHESINNRLALVMKSGKYTLGYKTVLKTLRNSKGKLIIIANNCPPLRKSEIEYYAMLAKVGVHHYNGNNVDSGTACGKYYRVRCLSIIDPGDSDIIKSMPGDQ

SEQ ID NO: 6308 - protein, 112 aa, Petunia hybrida
MVAAKKTKKTHESINNRLALVMKSGKYTLGYKTVLKTLRNSKGKLIIIANNCPPLRKSEIEYYAMLSKVGVHHYNGNNVDLGTACGKYFRVCCLSIIDPGDSDIIKSMPGDQ

SEQ ID NO: 6309 - protein, 91 aa, Petunia hybrida
MKSGKYTLGYKTVLKTLRSSKGKLILISNNCPPLRKSEIEYYAMLAKIGVHHFNGNNVDLGTACGKYYRVSCLSIIDPGDSDIIKSLPGDH

SEQ ID NO: 6310 - protein, 112 aa, Lippia dulcis
MVAAKKTKKTHESINNRLALVMKSGKYTLGYKTVLKTLRSSKGKLILISNNCPPLRKSEIEYYAMLAKIGVHHYNGNNVDLGTACGKYFRVSCLSIVDPGDSDIIKSLPGDH

SEQ ID NO: 6311 - protein, 112 aa, Podocarpus macrophillus
MVATKKTKKTHESINNRLALVMKSGKYTLGYKTTVKSIRNNKGKLIIIANNCPPLRRSEIEYYAMLGKIGVHHFNGNNVDLGTACGKYYRVCCLSITDPGDSDIIKTVPSDQ

SEQ ID NO: 6312 - protein, 112 aa, Podocarpus macrophillus
MVATKKTKKAHESINNRLALVMKSGKYTLGYKTTVKSIRNNKGKLIIIANNCPPLRRSEIEYYAMLGKIGVHHFNGNNVDLGTACGKYYRVCCLSITDPGDSDIIKTVPSDQ

SEQ ID NO: 6313 - protein, 112 aa, Populus trichocarpa
MVAAKKTKKTHESINNRLALVMKSGKYTLGYKTVLKSLRNSKGKLIIISNNCPPLRKSEIEYYAMLAKVGVHHYNGNNVDLGTACGKYFRVCCLSIIDPGDSDIIKSVPGDH

SEQ ID NO: 6314 - protein, 112 aa, Populus trichocarpa
MVTAKKTKKTHESINNRLALVMKSGKYTLGYKTVLKSLRSSKGKLILLSNNCPPLRKSEIEYYAMLAKVGVHHYNGNNVDLGTACGKYFRVSCLSIVDAGDSDIIKTVPGDH

SEQ ID NO: 6315 - protein, 138 aa, Papaver somniferum
  misc_feature (113)..(113): Xaa can be any naturally occurring amino acid
  misc_feature (125)..(126): Xaa can be any naturally occurring amino acid
  misc_feature (130)..(131): Xaa can be any naturally occurring amino acid
  misc_feature (133)..(134): Xaa can be any naturally occurring amino acid
MVAVKKMKKTHESINNRLALVMKSGKYTLGYKTVLRTLRSSKSKLIIISNNCPPLRKSEIEYYAMLAKVGVHHFNGNNVDLGTACGRYYRVSCLSIIDPGDSDIIKTLPGDQXVKKASCIQSLDXXFSLXXSXXLFSI

SEQ ID NO: 6316 - protein, 113 aa, Primula obconica
MSTVGKKTKKTHESINNRLALVMKSGKYTLGYKTVLKTLRSSKGKLIIISNNCPPLRKSEIEYYAMLAKVGVHHYSGNNVDLGTACGKYFRVSCLSIVDPGDSDIIKTLPGDQ

SEQ ID NO: 6317 - protein, 112 aa, Salvia sclarea
MVAGKKTKKTHESINNRLALVMKSGKYTLGYKTVLKTLRSSKGKLILISNNCPPLRKSEIEYYAMLAKIGVHHYNGNNVDLGTACGKYFRVSCLSIVDPGDSDIIKSLPSDH

SEQ ID NO: 6318 - protein, 112 aa, Sciadopitys verticillata
MVATKKTKKAHESINNRLALVMKSGKYTLGYKTTIKSIRGNKGKLIIIASNCPPLRRSEIEYYAMLAKIGVHHFNGNNVDLGTACGKYYRVCCLSITDPGDSDIIKTVPSDQ

SEQ ID NO: 6319 - protein, 91 aa, Taxus baccata
MKSGKYTLGYKTTLKSIRTNKGKLIIIANNCPPLRRSEIEYYAMLAKIGVHHFNGNNVDLGTACGRYYRVCCLSITDPGDSDIIKTVPSDQ

SEQ ID NO: 6320 - protein, 112 aa, Triphysaria pusilla
MAATKKTKKTHESINNRLALVMKSGKYTLGYKTVLKTLRSSKGKLILISNNCPPLRKSEIEYYAMLSKVGVHHYNGNNVDLGTACGKYFRVSCLSIVDPGDSDIIKSLPGDH

SEQ ID NO: 6321 - protein, 112 aa, Valeriana officinalis
MAAGKKTKKTHESINNRLALVMKSGKYTLGYKTVLESLRSSKGKLIIISNNCPPLRKSEIEYYAMLAKIGVHHYNGNNVDLGTACGKYFRVSCLSIVDPGDSDIIKSLPGDQ

SEQ ID NO: 6322 - protein, 112 aa, Valeriana officinalis
MAAGKKTKKTHESINNRLALVMKSGKYTLGYKTVLDSLRSSKGKLIIISNNCPPLRKSEIEYYAMLAKIGVHHYNGNNVDLGTACGKYFRVSCLSIVDPGDSDIIKSLPGDQ

SEQ ID NO: 6323 - protein, 112 aa, Juglans hindsii x Juglans regia
MVAAKKTKKTHESINNRLALVMKSGKYTLGYKTVLKSLRNSKGKLIIIANNCPPLRKSEIEYYAMLAKVGVHHYNGNNVDLGTACGKYFRVCCLSIIDPGDSDIIKSMPSEH

SEQ ID NO: 6324 - protein, 112 aa, Zostera marina
MVAAKKTKKSHDNINNRLALVMKSGKYTLGYKTVLKTIRSSKSKLVIICNNCPPLRKSEIEYYAMLAKIGVHHFNGNNVDLGTACGKYFRVGCLSILDPGDSDIIKSLSSDH

SEQ ID NO: 6325 - protein, 372 aa, Triticum aestivum
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIHKIVAAIRHRDGAMYYPTTRLICLENTHGNTGGKCLSVEYTDKVGEVAKSHGLKLHIDGARIFNASVALGVPVHRLVRAADSVSVCLSKGLGAPVGSVIVGSKAFIDKAKILRKTLGGGMRQVGILCAAAYLAVRDTVGKLADDHRKAKVLADGLTKIKQFTVDLASVETNMVFFDIADPRITPDKLCQVLEQRNVLAMPASSKSVRLVTHYQISDSDVQYTLTCIEKAVEEILSGNAKFERLTNGTTTNSYGH

SEQ ID NO: 6326 - protein, 372 aa, Triticum aestivum
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIDKIVAAIRHRDGAMYYPTTRLICLENTHGNTGGKCLSVEYTDKVGEVAQSHGLKLHIDGARIFNASVALGVPVHRLVRAADSVSVCLSKGLGAPVGSVIVGSKAFIDKAKILRKTLGGGMRQVGILCAAAYVAVRDTVGKLADDHTKAKVLADGLKKIKQITVDLASVETNMVFFDIADPRITPDKLCQVLEQRNVLAMPASSKSVRLVTHYQISDSDVQYTLTCIEKAVEEILSGNAKFERLTNGTTTNSYGH

SEQ ID NO: 6327 - protein, 372 aa, Triticum aestivum
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIHKIVAAIRHPDGAMYYPTTRLICLENTHGNTGGKCLSVEYTDKVGEVGKSHGLKLHIDGARIFNASVALGVPVHRLVRAADSVSVCLSKGLGAPVGSVIVGSNAFIDKAKILRKTLGGGMRQVGILCAAAYLAVRDTVGKLADDHRKAKVLADGLTKIKQFTVDLASVETNMVFFDIADPRITPDKLCQVLEQRNVLAMPASSKSVRLVTHYQISDSDVQYTLTCIEKAVEEILSGNAKFERLTNGTTTNSYGH

SEQ ID NO: 6328 - protein, 372 aa, Triticum aestivum
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGIATLGGVHPRTVPNNPDGTMDVDKIVAAIRHRDGAMYYPTTRLICLENTHGNTGGKCLSVEYTDKVGEVAQSHGLKLHIDGARIFNASVALGVPVHRLVRAADSVSVCLSKGLGAPVGSVIVGSKDFIYKAKILRKTLGGGMRQVGILCAAAYVAVRDTVGKLADDHTKAKVLADGLKKIKQFTVDLTSVETNMVFFDIADPHITPDKLCQVLEQRNVLAMPASSKSVRLVTHYQISDSDVQYTLTCIEKAVEEILSGNAKFERLTNGTTTNSYGH

SEQ ID NO: 6329 - protein, 372 aa, Triticum aestivum
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIDKIVAAIRHRDGAMYYPTTRLICLENTHGNTGGKCLSVEYTDKVGEVAQSHGLKLHIDGARIFNASVALGVPVNRLVRAADSVSVCLSKGLGAPVGSVIVGSKAFIDKAKILRKTLGGGMRQVGILCAAAYVAVRDTVGKLADDHTKAKVLADGLKKIKQITVDLASVETNMVFFDIADPRITPDKLCQVLEQRNVLAMPASSKSVRLVTHYQISDSDVQYTLTCIEKAVEEILSGNAKFERLTNGTTTNSYGH

SEQ ID NO: 6330 - protein, 373 aa, Secale cereale
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIDKIVAAIRHPDGGLYYPTTRLICLENTHGNSGGKCISVEYTDKVGEVAKSHGLKLHIDGARIFNASVALGVPVHRLVRAADSVSVCLSKGLGAPVGSVIVGSKAFIDKAKILRKTLGGGMRQVGILCAAAWVAVRDTVGRLADDHRKAKVLADGLKKIKQFTVDLTSVETNMVFFDIADPRITPGKLCQVLEQRNVLAMPASSKSVRLVTHYQISDSDVQFTLTCIEKAVEEILTGNAKFERLTNGTSTTNSYGH

SEQ ID NO: 6331 - protein, 373 aa, Secale cereale
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPRTVPNNPDGTMDIDKIVAAIRHPDGGLYYPTTRLICLENTHGNSGGKCISVEYTDKVGEVAKSHGLKLHIDGARIFNASVALGVPVDRLVRAADSVSVCLSKGLGAPVGSVIVGSKVFIDKAKILRKTLGGGMRQVGILCAAACVAVRDTVGKLADDHRKAKVLADGLKKIKQFTVDLTSVETNMVFFDIADPRITPGKLCQVLEQRNVLAMPASSKSVRLVTHYQISDSDVQYTLTCIEKAVEEILTGNAKFERLTNGTSTTNSYGH

SEQ ID NO: 6332 - protein, 372 aa, Brachypodium distachyon
MVTKVVDLRSDTVTKPSDAMRAAMAAADVDDDVLGADPTAQRFEAEMARIMGKEAALFVPSGTMANLVSVLVHCDTRGSEIILGDTSHIHIYENGGISSLGGVHPKTLPNNPDGTMDIDKIVAAIRHQDGALYYPTTRLICLENTHANCGGKCLSVEYTDKVGEVAKSHGLKLHIDGARIFNASVALGVPVHRLVRAADSVSVCLSKGLGAPVGSVIVGSKAFIDKAKIVRKTLGGGMRQVGILCAAAYVGVRDTVGKLADDHRKAKVLAEGLKKIKQFTVDLTSVETNMVFFDITDPRISPDKLCQVLEQRNVLAMPASSKSVRLVIHYQISDTDVQYALTCIEKVVEEILSGNVKLEHLTNGTTANSYGH

SEQ ID NO: 6333 - protein, 374 aa, Triticum aestivum
MVTKVVDLRSDTVTKPSEAMRAAMAAAEVDDDVLGADPTAQRFEAEMARITGKEAALFVPSGTMGNLVSVLTHCDTRGSEVILGDTSHIHMCENGGISTIGGVHPRTVRNNPDGTMDIDMIVAAIRHHVGAGALHYPTTRLICLENTHGRSGGKCLSVEYTDKVGEVAQSHGLKLHIDGARIFNASVALGVPVDRLVRAADSVSVCLSKGLGAPVGSVIVGSKAFIDKARILRKTLGGGMRQVGVLCAAAYVAVRDNVAKLADDHRKAKVLADGLKKIKQFTVDLTSVETNMVFFDISDPRITSDKLCQLLERRNVLAMPGSSKSVRLVIHYQISDSDVQYTLTCIEKAVEEILSGNVKFEHLTNGSTTNSYGH

SEQ ID NO: 6334 - protein, 183 aa, Triticum aestivum
MVTKVVDLRSDTVTKPSEAMRAAMAAAEVDDDVLGADPTAQRFEAEMARITGKEAALFVPSGTMGNLVSVLTHCDTRGSEVILGDTSHIHMCENGGISTIGGVHPRTVRNDPDGTMDIDMIVAAIRHHVGAGALHYPTTRLICLENTHGRSGGEVSICRIHRQGWRSCSKPWLEASYRRSSYL

SEQ ID NO: 6335 - protein, 374 aa, Hordeum vulgare
MVTKVVDLRSDTVTKPSEAMRAAMAAAEVDDDVLGADPTAQRFEAEMARITGKEAALFVPSGTMGNLVSVLTHCDTRGSEVILGDSSHIHMCENGGISTIGGVHSMPVVNNPDGTMDIDRIVAAIRHRVGAGALHYPTTRLICLENTHGRSGGKCLSAEYIDKVGEVAQSHGLKLHIDGARIFNASVALGVPVDRLVRAADSVSVCLSKGLGAPVGSVIVGSKAFIDQARILRKTLGGGMRQVGVLCAAAYVAVRDNVGKLADDHRKAKVLADGLKKIKQFTVDLTSVETNMVFFDIADPRITSDKLCQLLERRNVLAMPGTSKSVRLVIHYQISDSDVQYILTCIEKAVEEILSGNAKFEHLTNGSTTNSYGH

SEQ ID NO: 6336 - protein, 374 aa, Secale cereale
MVTKVVDLRSDTVTKPSEAMRAAMAAAEVDDDVLGADPTAQRFEAEMARIMGKEAALYVPSGTMGNLISVLTHCDTRGSEVILGDSSHIHMCENGGISTIGGVHPRTVRNNPDGTMDIDMIVAAIRHHVGAGALHYPTTRLICLENTHGRSGGKCLSVEYIDKVGEVAQSHGLKLHIDGARIFNASVALGVPVDRLVRAADSVSVCLSKGLGAPVGSVIVGSKAFIDKARILRKTLGGGMRQVGVLCAAAHVAVRDNVAKLADDHRKAKVLAEGLKKIKQFTVDLTSVETNMVFFDIADPRITSDKLCQLLERRNVIAMPGSSKSVRLVIHYQISDGDVQYTLTCIEKAVEEILSGNAKFEHLTNGSTTNSYGH

SEQ ID NO: 6337 - protein, 374 aa, Secale cereale
MVSKVVDLRSDTVTKPSEAMRAAMAAAEVDDDVLGADPTAQRFEAEMARITGKEAALFVPSGTMGNLISVLTHCDIRGSEVILGDSSHIHMCENGGISTIGGVHPRAVRNNADGTMDIDMIVAAIRHHVGAGALHYPTTRLICLENTHGRSGGKCLSVEYIDKVGEVAQSHGLKLHIDGARIFNASVALGVPVDRLVRAADSVSVCLSKGLGAPVGSVIVGSKAFIDKARILRKTLGGGMRQVGVLCAAAYVAVRDNVAKLADDHRKAKVLAEGLKKIEQFTVDLTSVETNMVFFDIADPRITSDKLCQVLERRNVIAMPGSSKSVRLVIHYQISDSDVQYTLTCIEKAVEEILSGNAKFEHLTNGGTTNSYGH

SEQ ID NO: 6338 - protein, 374 aa, Secale cereale
MVTKVVDLRSDTVTKPSEAMRAAMAAAEVDDDILGADPTAQRFEAEMARITGKEAALFVPSGTMGNLISVLTHCDIRGSEVILGDSSHIHMCENGGISTIGGVHPRAVRNNTDGTMDIDMIVAAIRHHVGAGALHYPTTRLICLENTHGRSGGKCLSVEYIDKVGEVAQSHGLKLHIDGARIFNASVALGVPVDRLVRAADSVSVCLSKGLGAPVGSVIVGSKAFIDKARILRKTLGGGMRQVGVLCAAAHVAVRDNVAKLADDHRKAKVLAEGLKKIKQFTVDLTSVETNMVFFDIADPRITSDKLCQVLERRNVIAMPGSSKSVRLVIHYQISDSDVQYTLTCIEKAVEEILSGNSKFEHLTNGGTTNSYGH

SEQ ID NO: 6339 - protein, 210 aa, Secale cereale
MVSKVVDLRSDTVTKPSEAMRAAMAAAEVDDDVLGADPTAQRFEAEMARITGKEAALFVPSGTMGNLISVLTHCDIRGSEVILGDSSHIHMCENGGVSTIGGVHPRTVRNNPDGTMDIDMIVAAIRHHVGAGALHYPTTRLICLENTHGRSGGKCLSVEYIDKVGEVAQSHGLKLHIDGARIFNASVALGVPVDRLVRAADSVSVCLSKV

SEQ ID NO: 6340 - protein, 372 aa, Oryza sativa
MVTNVVDLRSDTVTKPSDAMRAAMAAADVDDDVLGADPTAHRFEMEMARITGKEAALFVPSGTMANLISVLVHCDTRGSEVILGDNSHIHIYENGGISTIGGVHPKTVRNNPDGTMDIDKIVVAIRHPDGALYYPTTRLICLENTHANCGGKCLSAEYTDEVGEVAKSHGLKLHIDGARIFNASVALGVPVHRLVKAADSVSVCISKGLGAPVGSVIVGSTAFIEKAKILRKTLGGGMRQVGILCAAAYVAVRDTVGKLADDHRRAKVLADGLKKIKHFRVDTTSVETNMVFFDIVDSRISPDKLCQVLEQRNVLAMPAGSKSMRLVIHYQISDSDVQYALTCVEKAAEEILTGSKKFEHLTNGTTRNSYGH

SEQ ID NO: 6341 - protein, 369 aa, Hordeum vulgare
MATKVVDLRSDTVTKPSEAMRAAMAAADVDDDVLGADPTARRFEAEMARIMGKEAALFVPSGTMANLISVLAHCDTRGSEVILGDDSHIHVYEHGGISTLGGVHPRTVPNNPDGTMDVDRIVAAIRSPDGALYYPTTRLICLENTHGNSGGKCLTVEYTDKVGEVAKAHGLKLHIDGARIFNASVALGVPVDTLVRAADSVSVCLSKGIGAPVGSVIVGSKAFINKTKILRKTLGGGMRQVGVLCAAAEVGVRDTIGKLTDDHRKAKVLADGLKKIEQFTVDLTSVETNMVFFHMADPRITPAKLCKVLEQRNVLAMPTSSKSVRLVVHYQISDSDVQYTLTCIEKAVGEILACDAKLERPTNGAAANS

SEQ ID NO: 6342 - protein, 372 aa, Setaria italica
MVTKVVDLRSDTVTKPTEAMRAAMAAADVDDDVLGADPTAQRFEAEMAKLMGKEAALFVPSGTMANLVSVLVHCDVRGSEVILGDNSHIHIYENGGISTIGGVHPRTVKNNPDGTMDIDKIVAAIRNRAGALLYPTTRLICLENTHANCGGKCLSAEYTDKVGEVAKSHGLKLHIDGARIFNASVALGVPVDRLVKAADSVSVCLSKGLGAPVGSVIVGSQAFIDKAKILRKTLGGGMRQIGVVCAAAYVAVRDTVGKLADDHRKAKALAEGLKKIKQFKVDSASVETNMVFFDIMDPRISPDRLCQVLEQRNVLAMPASSKSMRFVLHYQISDSDVKYALTCVEKAVEELLKGSTKFEHLTNGFTKHSYGH

SEQ ID NO: 6343 - protein, 369 aa, Hordeum vulgare
MAAKVVDLRSDTVTKPSEAMRAAMAAADVDDDVLGADPTARRFEAEMARIMGKEAALFVPSGTMANLISVLAHCDARGSEVILGDDSHIHVYEHGGISTLGGVHPRTVPNNPDGTMDVDRIVAAIRSPDGALYYPTTRLICLENTHGNSGGKCLTVEYTDKVGEVAKAHGLKLHIDGARIFNASVALGVPVDTLVRAADSVSVCLSKGIGAPVGSVIVGSKAFINKAKILRKTLGGGMRQVGVLCAAAEVGVRDTIGKLTDDHRKAKVLADGLKKIEQFTVDLTSVETNMVFFHMADPRITPAKLCKVLEQRNVLAMPTSSKSVRLVVHYQISDSDVQYTLTCIEKAVGEILACDAKLERPTNGAAANS

SEQ ID NO: 6344 - protein, 370 aa, Sorghum bicolor
MASKVVDLRSDTVTKPSEAMRAAMAAAVVDDDVLGADPTAQRFEAEMAAIMGKEAALFVPSGTMGNLISVLVHCDVRGSEAILGDNSHIHVYENGGISTIGGVHPRTVKNNPDGTMDVDKIVAAIRHPDLHYPTTRLICLENTHGNSGGKCLSVEYTDKVGEIAKSHGLKLHIDGARIFNASVALGVPVDRLVKAADSVSVCLSKGLGAPVGSIIVGSKAFIDKAKILRKTLGGGMRQVGVLCAAAHVAIRDTVGKLADDHRKAKVLAEGLKKIEQLTVDSASVQTNMVFFDIMDPRISPDKLCAVLEQHNVLAMPASSKRIRFVIHYQISDSDVQYALTCVEKAVEELLKGSTEFEHLTNGTTKSSYGH

SEQ ID NO: 6345 - protein, 367 aa, Secale cereale
MATKVVDLRSDTVTKPSEAMRAAMAAAEVDDDVLGADPTACRFEAEMARIMGKEAALFVPSGTMANLISVLAHCDARGSEVILGDDSHIHVYEHGGISTLGGVHPRTVPNNPDGTMDVDKIVAAIRSPDGALYYPTTRLICLENTHGNSGGKCLTVEYTDKVGEVAKAHGLKLHIDGARIFNASVALGVPVDRLVRAADSVSVCLSKGIGAPVGSVIVGSEAFINKAKILRKTLGGGMRQVGVLCAAAEVGVRDTVGKLADDHRKAKVLADGLKKFKQFTVDLTSVETNMVFFDMADPRLTPAKLCQALKQRNVLAMPTSSKSVRFVVHYQISDSDIQYALTCIEEAVEEMLACDAKSERCSTNGTS

SEQ ID NO: 6346 - protein, 367 aa, Triticum aestivum
MLTKVVDLRSDTVTKPSEAMRAAMAAADVDDDVLGADPTACRFEAEMARIMGKEAALFVPSGTMANLISVLAHCDARGSEVILGHDSHIHVYEHGGISTLGGVHPRTVPNNPDGTMDVDRIVAAIRSTDGALYYPTTRLICLENTHGNSGGKCLTVEYTDKVGEVAKAHGLKLHIDGARIFNASVALGVPVDRLVRAADSVSVCLSKGIGAPVGSVIVGSKAFIHKAKILRKTLGGGMRQVGVLCAAAEVGVRDTVGKLADDHRKAKVLADGLKKIKQFTVDLSSVETNMVFFDMADPRISPAKLCQALKQRNVLAMPTSSKSVRFVVHYQISDSDIQYTLKCIEEAVEEILACDAKSERCSTNGTS

SEQ ID NO: 6347 - protein, 367 aa, Secale cereale
MAAKVVDLRSDTVTKPSEAMRAAMAAAEVDDDVLGADPTACRFEAEMARIMGKEAALFVPSGTMANLISVLAHCDARGSEVILGDDSHIHVYEHGGISTLGGVHPRTVPNNPDGTMDVDRIVAAIRSPDGALYYPTTRLICLENTHGNSGGKCLTVEYTDKVGEVAKAHGLKLHIDGARIFNASVALGVPVDRLVRAADSVSVCLSKGIGAPVGSVIVGSEAFINKAKILRKTLGGGMRQVGVLCAAAEVGVRDTVGKLADDHKKAKVLADGLKKFKQFTVDLTSVETNMVFFDMADPRITPAKLCQALKQRNVLAMPASSKSVRFVVHYQISDSDIQYALTCIEEAVEEMLACDAKPERCSTNGTC

SEQ ID NO: 6348 - protein, 372 aa, Zea mays
MVTNVVDLRSDTVTKPSDAMRAAMAAADVDDDVLGADPTARRFEAEMAALLGKEAALFVPSGTMANLVSVLAHCDVRGSEVILGDASHIHVYENGGISTLGGVHPRTVPNNPDGTMDLARIVDAIRNPDGALLYPTTRLICLENTHANSGGKCLSVEYTDKVGEIAVNHGLKLHIDGARIFNASVALGVPVHRLVKAADSVSVCLSKGLGAPIGSVVVGSEAFIDKARILRKTLGGGMRQVGVLCAAAYVAVRDTVGKLADDHRKAKALAEGLKKIKQLTVDSSSVETNMVFFDIVDPRISPSKLCQVLEQRNVLAMPASSKSVRFVIHYQISDSDVQYALTCVEKAVEELLKGGTKLEHLTNGTAKNSYWH

SEQ ID NO: 6349 - protein, 367 aa, Triticum aestivum
MATKVVDLRSDTVTKPSEAMRAAMAAADVDDDVLGADPTACRFEAEMARIMGKEAALFVPSGTMANLISVLAHCDARGSEVILGHDSHIHVYEHGGISTLGGVHPRTVPNNPDGTMDVDRIVAAIRSTDGALYYPTTRLICLENTHGNSGGKCLTVEYTDKVGEVAKAHGLKLHIDGARIFNASVALGVPVDRLVRAADSVSICLSKGIGAPVGSVIVGTKAFIHKAKILRKTLGGGMRQVGVLCAAAEVGVRDTVGKLADDHRKAKVLADGLKKIKQFTVDLSSVETNMVFFDMADPRISPAKLCQALKQRNVLAMPTSSKSVRFVVHYQISDSDIQYTLKCIEEAVEEILACDAKSERCSTNGTS

SEQ ID NO: 6350 - protein, 372 aa, Sorghum bicolor
MVTKVVDLRSDTVTKPSDAMRAAMAAADVDDDVLGADPTARRFEGEMAALTGKDAALFVPSGTMANLISVLVHCDVRGSEVILGDNSHIHVYENGGISTIGGVHPRTVPNNPDGTMDVDKILAAIRNPDGALLYPTTRLICLENTHANCGGKCLSVEYTDKVGQIAVNHGLKLHIDGARIFNASVALGVPVHRLVKAADSVSICLSKGLGAPIGSVIVGSKAFIDKAKILRKTLGGGMRQVGVLCAAAYVAVRDTVGKLADDHRKAKALAEGLKKIKQFTVDSSSVETNMVFFDIVDPRISPNKLCQVLEQRNVLAMPASSKSVRFVVHYQISDSDVQYALTCVEKAVEELLKGGTKLEHLTNGTVKNAYWH

SEQ ID NO: 6351 - protein, 369 aa, Panicum virgatum
KVVDLRSDTVTKPSDAMRSAMASADVDDDVLGADPTARRFEAEMAALMGKEAALFVPSGTMANLVSVLVHCDVRGSEVILGDASHIHVYENGGISTIGGVHPKTVPNNPDGTMDIDRIVAAIRDRAGALLYPTTRLICLENTHANCGGKCLSVEYTDKVGEIAKSHGLKLHIDGARIFNASVALGVPVDRLVKAADSVSVCLSKGLGAPVGSVIVGSKAFIDKAKILRKTLGGGMRQIGVLCAAAYVAVRDNRGKLADDHRRAKVLAEGLKKIKQFSVDSASVETNMVFFDIMDPRISPHRLCQVLEQRNVLAMPASSKSVRFVLHYQISDSDVQYALTCVEKAVDDLLKGGAKFEHLTNGTTKNSYGH

SEQ ID NO: 6352 - protein, 367 aa, Secale cereale
MAAKVVDLRSDTVTKPSEAMRAAMAAAEVDDDVLGADPTARRFEAEMARIMGKEAALFVPSGTMANLISVLAHCDARGSEVILGDDSHIHVYEHGGISTLGGVHPRTVPNNPDGTMDVDRIVAAIRSPDGALYYPTTRLICLENTHGNSGGKCLTVEYTDKIGEVAKAHGLKLHIDGARIFNASVALGVPVDRLVRAADSVSVCLSKGIGAPVGSVIVGSEAFINKAKILRKTLGGGMRQVGVLCAAAEVGVRDTVGKLADDHRKAKVLADGLKKFKQFTVDLTSVETNMVFFDMADPRLTPAKLCQALKQRNVLAMPTSSKSVRFVVHYQISDSDIQYALTCIEEAVEEVLACDAKPERCSTNGTC

SEQ ID NO: 6353 - protein, 367 aa, Triticum aestivum
MATKVVDLRSDTVTKPSEAMRAAMAAADVDDDVLGADPTACRFEAEMARIMGKEAALFVPSGTMANLISVLAHCDARGSEVILGDDSHIHVYEHGGISTLGGVHPRTVPNNPDGTMDVDRIVAAIRSTDGALYYPTTRLICLENTHGNSGGKCLTVEYTDKVGEVAKAHGLKLHIDGARIFNASVALGVPVDRLVRAADSVSVCLSKGIGAPVGSVIVGSKAFIQKAKILRKTLGGGMRQVGVLCAAAEVGVRDTLGKLADDHRKAKVLADGLKKIKHFTVDLTSVETNMVFFDMADPRITPAKLCQALKQRSVLAMPTSSKSVRFVVHYQISDGDIQYTLKCIEEAVEEMLACDAKSERCSTNGTS

SEQ ID NO: 6354 - protein, 170 aa, Triticum aestivum
MATKVVDLRSDTVTKPSEAMRAAMAAADVEDDILGSDPTARRFEAEMARIMGKEAALFVPSGTMANLISVLAHCDTRGSEAILGDNSHIHVYEHGGISTLGGVHPRIVANNADGTMDIDKIVAAIRSPDGSLYYPTTRLICLENTQGNCGGKCLSVEYTDKVGEVAKPTA

SEQ ID NO: 6355 - protein, 370 aa, Panicum virgatum
MASKVVDLRSDTVTKPSQAMRAAMAAADVDDDVVGVDPTAQRFQAEMAALMGKEAALFVPSGTMGNLISVLVHCDVRGSEAILGDNSHIHVYENGGISTIGGVHPKTVPNNSDGTMDIDKIVAAIRHPDLHYPTTRLICLENTHGNSGGKCLSVEYTDKVGEIATSHGLKLHIDGARIFNASVALGVPVDRLVKAADSVSVCLSKGLGAPVGSVIVGSKDFIEKAKILRKTLGGGMRQVGVLCAAAQVAVRDTVGKLADDHRKARALAEGLKKIKHITVDPASVETNMVFFDIVDPRISPDNLCQVLEQYNVLTMPASSKSIRFVLHYQISDSDVQYAVTCVEKAFEELLKGGTNLELLTNGTTRSSYGH

SEQ ID NO: 6356 - protein, 370 aa, Panicum virgatum
MASKVVDLRSDTVTKPSEAMRAAMAAADVDDDVVGVDPTARRFQAEMASLMGKEAALFVPSGTMGNLISVLAHCDVRGSEAILGDNSHIHVYENGGISTIGGVHPKTVPNNPDGTMDIDKIVAAIRHPDLHYPTTRLICLENTHGNSGGKCLSAEYTDKVGEIAKSHGIKLHIDGARIFNASVALGVPVDRLVKAADSVSVCLSKGLGAPVGSVIVGSKDFIEKAKILRKTLGGGMRQVGVLCAAAQVAVRDTVGKLADDHRKARVLAEGLKKIKHVTVDPASVETNMVFFDIVDPRISPDNLCQVLEQHNVFAMPASSKSIRFVLHYQISDADVRYAVTCVEKAFEELLKGGTNLEPLTNGTIRSSYGH

SEQ ID NO: 6357 - protein, 355 aa, Secale cereale
MVTKVVDLRSDTVTKPSEAMRAAMAAAEVDDDILGADPTAQRFEAEMARITGKEAALFVPSGTMGNLISVLTHCDIRGSEVILGDSSHIHMCENGGISTIGGVHPRAVRNNTDGTMDIDMIVAAIRHHVGAGALHYPTTRLICLENTHGRSGGKCLSVEYIDKVGEVAQSHGLKLHIDGARIFNASVALGVPVDRLVRAADSVSVCLSKGLGAPVGSVIVGSKAFIDKARILRKTLGGGMRQVGVLCAAAYVAVRDNVAKLADDHRKAKVLAEGLKKIEQFTVDLTSVETNMVFFDIADPRITSDKLCQVLERRNVIAMPGSSKSVRLVIHYQISDSDVQYTLTCIEKAVGEILG

SEQ ID NO: 6358 - protein, 374 aa, Saccharum officinarum
MATNKVVVDLRSDTVTKPSDAMRAAMAAAEVDDDVRGADPTARRFQEAMAAIMGKEAALFVPSGTMGNLVSVLVHCDVRGSEAILGDGSHIHLYENGGISTIGGVHPKTVRNNADGTMDIDRIVAAIRPPGGGLYYPTTRLICLENTHGNSGGKCLSVEYTDKVGEIAKSHGLKLHIDGARIFNASVALGVPVDRLVRAADSVSVCLSKGLGAPVGSVIVGSKEFIDKAKILRKTLGGGMRQVGVLCAAAHVAVRDTVGKLADDHRKAKALADGLNKIEQFTVDSASVETNMVFLDIVDSRIPSDKLCQVLGTHNVLANPRSPKSVRLVLHYQISDTDVQYALTCFKKAVEELLMGSSELEHLADTTTKNSYGH

SEQ ID NO: 6359 - protein, 370 aa, Zea mays
MASKVVDLRSDTVTKPSEAMRAAMAAADVDDDVLGADPTAHRFEAEMAAVMGKEAALFVPSGTMGNLISVLVHCDVRGSEAILGDNSHIHVYENGGISTIGGVHPRTVKNNPDGTMDIDKIVAAIRHPDLHYPTTRLICLENTHGNTGGKCLSVEYTDKVGEIAKSHGLKLHIDGARIFNASVALGVPVDRLVKAADSVSVCLSKGLGAPVGSVIVGSKAFIDKARILRKTLGGGMRQVGVLCAAAHVAVRDTVGKLADDHRKAKALAEGLKKIEQITVDSASVETNMVFFEVMDPRISPDKLCQVLEQDNVLALPANSKSIRFVIHYQISDADVGYALACVEKAIKELLEGSTELGHSINGATKSSYGH

SEQ ID NO: 6360 - protein, 370 aa, Pennisetum glaucum
MASKVVDLRSDTVTKPSEAMRAAMAAAVVDDDVVGVDPTAHRFQEEMAALMGKEAALFVPSGTMANLIAVLVHCDVRGSEVILGDNSHIHVYENGGISTIGGVHPRTVRNNPDGTMDVDEIVAAIRHPDLHYPTTRLICLENTHGNCGGKCLSVEYIDKVGEIAKSHGLKLHIDGARIFNASVALGVPVDRLVKAADSVSVCLSKGLGAPVGSVIVGSFAFIDKARILRKTLGGGMRQVGVLCAAAEIAVRDTLGKLEDDHRKAKALAEGLKKIKHITVDPASVETNMVFFGITDLRISPDNLCQLLEQHNVLAMPASSKSIRFVLHYQISDSDVQYALTCVEKAIEELLKGGTNLEQLANGATKSSYGH

SEQ ID NO: 6361 - protein, 377 aa, Zea mays
MATKVVVDLRSDTVTKPSEAMRASMAAADVDDDVRGADPTARRFQEEMAALMGKEAALFVPSGTMGNLVSVLAHCDVRGSEVILGDDSHIHLYENGGISTLGGVHPKTVRNNSDGTMDIDSIVAAIRPPGGGLYYPTTRLICLENTHGNSGGKCLSAEYTEKVGEIAKSHGLKLHIDGARIFNASVALGVPVDRLVRAADSVSVCISKGLGAPVGSVIVGSKAFIDKAKILRKTLGGGMRQVGVLCAAAHVAVRDNVGKLADDHRKAKALADGLNKIEQFRVDSASVQTNMVFLDIVDSRISSNKLCQVLGTHNVLASPRSPKSVRLVLHYQISDDDVQYALTCFKKAAEQLLMGSTELEHLAEQLLMGTTKNSYGQ

SEQ ID NO: 6362 - protein, 288 aa, Triticum aestivum
MQKVYLSRNPTAEKILDLVHSYDGDHICFDHFAFRTFGVDGYGINSLAEFFTDFGYESREELRFPAKKLRALWFSPPNNDGYTRAGIYGPLPRIFISELLVDELSAPSQEIIRKYIKTSANGNKYAVLASTFGELTWEKPTYSDFQVLSRESEYAGWTLVNGYALNHATVSTHRLESDIRSISKFNKFVEDNGFKLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 6363 - protein, 288 aa, Triticum aestivum
MQKVYLSRNPTAEKILDLVHSYDGDHICFDHFAFRTFGVDGYGIDSLAEFFTDFGYESREELRFPAKKLRALWFSPPNNDGYTRAGIYGPLPRIFISELLVDELSAPSQEIIRKYIKTSANGNKYAVLASTFGELTWEKPTYSDFQVLSRESEYAGWTLVNGYALNHATVSTHRLESDIRSISKFNKFVEDNGFKLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 6364 - protein, 216 aa, Secale cereale
MVSPPNNDGYTRTGIHGPLPRIFISELLVDELSAPSQEIIREYIKTSANGNKYAVLASTFGELTWEKPTYSDFQVLSRESEYAGWTLVNGYALNHATVSTHRLESDIRSISKFNKFVEDNGFKLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 6365 - protein, 288 aa, Avena sativa
MQKVYLSRNPTAEKILGLVRSYDGDNICFDHFAFRTFALDGYGINSLAEFFTDFGYESREELRFPAKKLRALWFSPPKSDGYSGTGAYGPLPRIFISELLVDELSAPSQEIVRKYIKSSAKGNKYAVLATTSGELTWEKPIYSDFQALSRESEYAAWTLANGYALNHATVSTHRLESDIRSISKFNKFVEDNGFKLNTEGGILKVSPDGLLQQSSTVADSDLFTFADGITESIPRSYIEFAERLPLPQFKDLQDEEVKEHHRRDGFEVGNADKIFESTSRDQLTRRSA

SEQ ID NO: 6366 - protein, 318 aa, Pseudoroegneria spicata
MAAAAAPSPIPASDPLPKGSDLFFRSVLSNMQKVYLSRNSTAEKILDLVHSYDGDNICFDHFAFRTFGVDGYGINSLAEFFTDFGYESREELRFPAKKLRALWFSPPNNDGYSRTGIYGPLPRIFISELLVDELSAPSQEIIRKYIKTSANGNKYAVLASTFGELTWEKPTYSDFQVLSRESEYAGWTLVNGYALNHATVSTHRLESDIRSISKFNKFVEDNGFRLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 6367 - protein, 366 aa, Brachypodium distachyon
MAGATLGAAKFPATVALLRTRRSPAIAATALGPSGLRHYRRGVAMAAAGTSSSTPSRVPAVDAIPKGADLFFRSILSNMQKVYLSRNPTAEKILDLVRSYDGDHICFDHFAFRTFGVDGYGINSLAEFFTDFGYVSREELRFPAKKLRALWFSPPANDGYTRTGIYGPLPRIFISELLVDELSAQSQEIICKYVKTSGRGNKYSVLASTYGELTWEKPIYSDFQVLSRESEYAAWTLVNGYALNHATVSTHRLESDIRSINNFNKFVEENGFKLNTEGGILKVSPDGLLQQSSTVADSALFTFANGITEAIPRSYIEFAERLPLPQFKDLQEQEVKEHHRRDGFEVGNADKIFESTSKDQLTRRFA

SEQ ID NO: 6368 - protein, 322 aa, Brachypodium distachyon
MAAAGTSSSTPSRVPAVDAIPKGADLFFRSILSNMQKVYLSRNPTAEKILDLVRSYDGDHICFDHFAFRTFGVDGYGINSLAEFFTDFGYVSREELRFPAKKLRALWFSPPANDGYTRTGIYGPLPRIFISELLVDELSAQSQEIICKYVKTSGRGNKYSVLASTYGELTWEKPIYSDFQVLSRESEYAAWTLVNGYALNHATVSTHRLESDIRSINNFNKFVEENGFKLNTEGGILKVSPDGLLQQSSTVADSALFTFANGITEAIPRSYIEFAERLPLPQFKDLQEQEVKEHHRRDGFEVGNADKIFESTSKDQLTRRFA

SEQ ID NO: 6369 - protein, 371 aa, Festuca arundinacea
  misc_feature (10)..(10): Xaa can be any naturally occurring amino acid
  misc_feature (42)..(42): Xaa can be any naturally occurring amino acid
  misc_feature (48)..(48): Xaa can be any naturally occurring amino acid
  misc_feature (51)..(51): Xaa can be any naturally occurring amino acid
  misc_feature (53)..(53): Xaa can be any naturally occurring amino acid
  misc_feature (59)..(59): Xaa can be any naturally occurring amino acid
  misc_feature (61)..(63): Xaa can be any naturally occurring amino acid
  misc_feature (105)..(105): Xaa can be any naturally occurring amino acid
  misc_feature (243)..(243): Xaa can be any naturally occurring amino acid
ARGRSISRPXMAQATLAAARFPAAVALLRTRRSPAIAAPLCXSGLRHXRRXFXMAAAPXPXXXPASDPPPKGADLFFRSVLSKMQKVYLSRNPTAEKILGLVHSXDGDNICFDHFAFRTFGVDGYGINSLADFFTDFGYEPREELRFPAKKLRALWFSPPKSDGYTGTGIYGPLPRIFISELLVDELSAPSQEIICKYIKTSAKGNKYAVLASTSGELTWEKPIYSDFQALSRESEYAAWALXNGYALNHATVSTHRLESDIRSISKFNKFAEDNGFKLNTEGGILKVSPDGLLQQSSTVADSALFSFADGITESIPRSYIEFAERLPLPQFKDLQDKEVKEHHRRDGFEVGNADKIFESTSRDQLTRRSA

SEQ ID NO: 6370 - protein, 523 aa, Brachypodium distachyon
MDYERIEKPSFPTQGGGFSPKRLRAMLLGVEKRRKGPPPPPEAGAGAGDDDGGDRDEDVEEEEYGAVPMASVRSDARKSENCGMCSHVGGGGGGVCEEYKDVDVVSTMSGSSSSLETGGGHRPRDCHSMGSRFRVPEEDSCDSESVASNFEFHKERGTSARSAPVVPPFSKALPSKWDDAQKWIASPTTNRPGRTSGALPRKMEKAGFGGGRLPATKVVLDTMEEIDTKRIDPSQDKREIGWQKAANWATPDPYPEVEACTKTAIADSAVTLSCDSSTTLQSATACIPPPPTVRSVSMRDMGTEMTPIASQEPSRTGTPVRATSPDCSQPTTPRRTLGTNAAGAVISRGECSNVELSEQELQMKTRREIMLLGTQLGKTSIAAWASKKEEEKDASLSLKTVSLDQSIQNTTEIRAAAWEEAEKAKYLARFKREEIKIHAWEDHQKAKIEAEMRKIEVEVERMRARAQDKLMSKLASARHAADEQRATAETKRDHAAARTAEQAEHIRRTGRMPPSLGCWNWCS

SEQ ID NO: 6371 - protein, 269 aa, Secale cereale
MEKTGFGGGRLPATKVVLEAMEEIDTKRIDPSQEKREIGWQKAANWATPEPYPEVEPCAKSAPAAESTIIDSAVTLSCDSSTTLQSATACIPPPPTVRSVSMRDMGTEMTPIASQEPSRTGTPVRATSPDCSRPTTPRRTLGINAAGPVINRGECSIADLSEEELQMKTRREIMLLGTQLGKTSIAAWASKKEEEKDASLSLKTVSSDQSVQNATEVRAAAWEEAEKAKYLARFKREEIKIHAWEDHQKAKIEAEMRKIEVEVERMRAR

SEQ ID NO: 6372 - protein, 510 aa, Oryza sativa
MEYERIEKPFPTQGGGFSPKRLRAMLLGVEKRRKGQEEEEEGDAGEVDDEYGAVPKSSVRSDADSDARRGGSMCEEYKDVDVVSTISESSSSLETGSGHRSRDTHSMGSRVRVPEEDSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWAPPDPYPEVETCAKSALAEEITVADSAVTFSRHDSSATLQSATTCIPPPPTVRSVSMRDMGTEMTPIASQEPSRTGTPVRATSPDCSRPTTPRKTIGPNAIGAVIGHGECSNVELSEQELQMKTRREIMLLGTQLGKTNIAAWASNKEEEKDASLSLKGVPMDQSTQKVTEIRAAAWEEAEKAKYLARFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 6373 - protein, 572 aa, Triticum aestivum
MSGAASLGLRTGSCGTLPAPGAGAAVPVGRKARGWGLRAGADAGGGDKERLQLPHRALRLVGRRGAGLLLLLAVASAALFCSLFAVVKDDNTSSIIIASNYEVTNAIQNSVYPSTTRPLMMSNDHNKFEHPNRLHLSPGNFTNHPCEGFAVPPILFDKKRTGPRPCPVCYVSVDQAFALMPLQASPSPVLENLDYALEDSVTANFSNPGSAFGGHLSLEQRNKSFDITNSMTVHCGFVRGKKPGQGTGFDISDDDLLEMEQCRELVVASAIFGNYDMIQHPRNVSELSKANACFYMFVDEETMAYVKNSSSLYKDNKVGLWRLVVVRNLPYEDPRRTGKIPKLLLHRLFPNVRFSVWIDAKLQLVVDPYLLLERFLWRKNSSFAISRHYRRFDVYEEAEANKAAGKYDNASIDEQIDFYRNEGLTHYSPAKLPITSDVPEGCVIIREHVPISNLFTCLWFNEVDRFTARDQISFSTVRDKIRAKVGWMPQMFLDCERRNFVVQAYHRELLEQMIASGRNTPPIAVEPSRKIRPGSSRRAPPSKKPVVRRKKEKKSSSRRRVAKPVTWAMDAV

SEQ ID NO: 6374 - protein, 93 aa, Secale cereale
MEQCRELVVASAIFRDYDMIQHPRNVSELSKANACFYMFVDEETMAYVKNSSSLYKDNKVGLWRLVVVRNLPYEDPRRTGKIPKLLLHRLFQM

SEQ ID NO: 6375 - protein, 483 aa, Secale cereale
DNTSSIIIASNYEVTNAIQNSVYPSTTRPLMMSNDQNKFEHPNRLHLSPDNFTTHPCEGFAVQPILFDKKRTGPRPCPVCYVSVDQAFALMPLQASLSPVLENLDYALEDSVTANFSNPGSAFGGHLSLEQRNKSFDITNSMTVHCGFVRGKKPGRGTGFDISDDDLLEMEQCRELVVASAIFGNYDMIQHPRNVSELSKANACFYMFVDEETMAYVKNSSSLYKDNKVGLWRLVVVRNLPYEDPRRTGKIPKLLLHRLFPNVRFSVWIDAKLQLVVDPYLLLERFLWRKNSSFAISRHYRRFDVYEEAEANKAAGKYDNASIDEQIDFYRNEGLTHYSPAKLPITSDVPEGCVIIREHVPISNLFTCLWFNEVDRFTARDQISFSTVRDKIKAKVGWMPQMFLDCERRNFVVQAYHRELLEQMIASGRNAPPIAVEPSRKIRPGSSRRAPPSKKPVMKRKKEKKSSSRRRVPKPVTWAMDAV

SEQ ID NO: 6376 - protein, 400 aa, Triticum aestivum
GTRAFALMPLQASPSPVLENLDYALEDSVTANFSNPGSAFGGLLSLEQRNKSFDITNSMTVHCGFVRGKKPGQGTGFDISDDDLLEMEQCRELVVASAIFGNYDMIQHPRNVSELSKAYACFYMFVDEETMAYVKNSSSLYKDNKVGLWRLVVVRNLPYEDPRRTGKIPKLLLHRLFPNVRFSVWIDAKLQLVVDPYLLLERFLWRKNSSFAISRHYRRFDVYEEAEANKAAGKYDNASIDEQIDFYRNEGLTHYSPAKLPITSDVPEGCVIIREHVPISNLFTCLWFNEVERFTARDQISFSTVRDKIRAKVGWMPQMFLDCERRNFVVQAYHRELLEQMIASGRNTPPIAVEPSRKIRPGSSRRAPPSKKPVVRRKKEKKSSSRRRAVKPVTWAMDAV

SEQ ID NO: 6377 - protein, 559 aa, Brachypodium distachyon
MSGAASLGLRTGSCGSLAAGGGRKAGARGWGWRGEKERLQLLHRALRLVGRRGAGLLLLLAVASAALFCSLFAVAKDDNTSSIIIASNYEVTNAIQNSVYPSTTRPLMSSQDQYSASGVNETEHPNQLLLPFANFTNHPCEGFAVPPTLFDKKRTGPRPCPVCYVSVDQAFALMPLQASQSPVLEILNYVAEDSTTANFSNRGSAFGGYLSLEQRNKSFDITNSMTVHCGFVRGKKPGQGTGFDINNDDLLEMEQCRGLVVASAIFGNYDMIQHPRNVSELAKENACFYMFVDEETNAYVKNSSSLYRDNKIGIWRLVVVQNLPYKDPRRTGKIPKLLLHRLFPNVRYSIWIDAKLQLVVDPYLLLERFLWRKNATFAISRHYRRFDVFEEAEANKAAGKYDNSSIDEQIDFYRNEGLTHYSTAKLPITSDVPEGCVIIREHVPISNLFTCLWFNEVDRFTARDQISFSTVRDKIRAKVGWMPQMFLDCERRNFVVQAYHRELLEQMIASGRNVPPIAGEPSGKLRLGSRKAPPSKKPLLKRKKRRRVQKPIALTIDAM

SEQ ID NO: 6378 - protein, 571 aa, Setaria italica
MSGSAAGLGLRSGSYGSLAAAVGGSGGGARKAGGRGWALRGEKERLQLLHRALRLVGRRRAGVLLLLAVASAAVFCSLFAVVKDDSSSISIVNNYEVPNAIQKSVYPSTTRPLKMSGDQYSSVVNKIELPNRLHLSYANFTHPCEGFSVPPPLVDKKRTGPRPCPVCYVSVDQAFALMPLQASPSPVLKNLNYISEDGIVANLSSQGSEFGGHPSLEQRNKSFDISESMTVHCGFVRGKKPGQGTGFDIKDDDLVEMEQCRELVVASAIFGNYDMIQHPRNISEFSKANACFYMFVDEETEAYVKNSSSLYNNNKVGLWRLVVVRNLPYEDPRRTGKIPKLLLHRLFPNVRFSVWIDAKLELVADPYLLLERFLWRKKATFAISRHYKRFDVFEEAEANKAAGKYDNASVDYQIEFYRNEGLSHYSPAKFPITSDVPEGCVIIREHIPITNLFTCLWFNEVDRFTSRDQISFSTVRDKIRARVGWMPEMFLDCERRNFVVQAYHRELLEQMIASGRRPPSTTDAPPSRKLRPGSRKAPPSKKPSVKRKKEKKSSSRRRVPKPPVAGGMGAM

SEQ ID NO: 6379 - protein, 573 aa, Zea mays
MTDSAASLGLRSESYGSLAAAVGGERKAGAAAACRPLRGEKDRLQLLHRALRLGGRRRAGVLLLLAVVSAAVFSSLFAVVKDDSNSISIVNNYEVPNAIQKSVYPSTTRPLMMSGNQYSTSVVNKIELPNRLHLTYANFTHPCEGFSVPPPLVDKKRTGPRPCPVCYVSVDQAFALMPLQASPSPVVKNLNYVSEDGVTANLSNLGSGFGGHPSLEQRNKSFNINESMTVHCGFVRGKKPGQGTGFDIKDDDLLEMEQCRELVVASAIFGNYDMIQHPRNISEFSKANACFYMFVDEETEAYVKNSSSLYNNNKVGLWRLVVVRNLPYEDPRRTGKIPKLLLHRLFPNVKFSVWIDAKLQLVADPYLLLERFLWRKNTTFAISRHYKRFDVFEEAEANKAAGKYYNASIDYQIEFYRNEGLTHYSPAKLPITSDVPEGCVIIREHIPITNLFTCLWFNEVDRFTSRDQISFSTVRDKIRARVGWMPEMFMDCERRNFVVQAYHRELLEQMIASGRMPPSGAVVVTDAAPSRKVRAGSRKATPSKKPSVKRKKEKKSSSRRRLPKPVAGGLGAM

SEQ ID NO: 6380 - protein, 576 aa, Sorghum bicolor
MTGSAASLGLRSGSYGSLAAAVVVGSGGGRKAGAGAACRPLRGEKERLQLLHRALRLVGRRRAGVLLLLAVASAAVFCSLFAVVKDDSNSISIVNNYEVPNAIQKSVYPSTTRPLMMSGNQYSTSVVNKIELPNRLHLSYANFTHPCEGFSVPPPLVDKKRTGPRPCPVCYVSVDQAFALMPLQASPSPVLKNLNYVSEDGITANLSNQGSGFGGHPSLEQRNDSFNINESMTVHCGFVRGKKPGQGTGFDIKDDDLLEMEQCRELVVASAIFGNYDMIQHPRNISEFSKANACFYMFVDEETEAYVKNSSSMYNNNKVGLWRLVVVRNLPYEDPRRTGKIPKLLLHRLFPNVRFSVWIDAKLELVADPYLLLERFLWRKNTTFAISRHYKRFDVFEEAEANKAAGKYDNSSIDYQIEFYRNEGLTHYSTAKLPITSDVPEGCVIIREHIPITNLFTCLWFNEVDRFTSRDQISFSTVRDKIRARVGWMPEMFMDCERRNFVVQAYHRELLEQMIASGRMPPSAVAATDAPPSRKVRAGSRKAPPSKKPSVKRKKEKKSSLRRRLPKPVAGGLGAM

SEQ ID NO: 6381 - protein, 550 aa, Hordeum vulgare
PAAAAVPAGRKARGWGLRAGAAAGDKERLQLLHRALRLVGRRGAGLLLLLAVASAALFCSLFAVVKDDNTSSIIIASNYEVTNAIQNSVYPSTTRPLMMSNDHNKFEHPNRLHLSPSNFTNHPCEGFAVPPILFDKKRTGPRPCPVCYVSVDQAFALMPLQASPSPVLENLKYALEDSVTANFSNPGSAFGGHLSLEQRNKSFDITDSMTVHCGFVRGKKPGQGTGFDISDDDLLEMEQCRELVVASAIFGNYDMIQHPRNVSELSKANACFYMFVDEETMAYVKNSSSLYKDNKVGLWRLVVVRNLPYEDPRRTGKIPKLLLHRLFPNVRFSVWIDAKLQLVVDPYLLLERFLWRKDSSFAISRHYRRFDVYEEAEANKAAGKYDNASIDEQIDFYRNEGLTHYSPAKLPITSDVPEGCVIIREHVPISNLFTCLWFNEVDRFTARDQISFSTVRDKIRSKVGWMPQMFLDCERRNFVVQAYHRELLEQMIASGRNTPPTAVEPSRKIRPGGSRRAPPSKKPVVKRKKEKKSSSRRRVPKPVTWAMDAV

SEQ ID NO: 6382 - protein, 575 aa, Oryza sativa
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCRELVVASAIFGNYDMIQHPRNASEFSKANACFYMFVDEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYAPAKLPITSDVPEGCVIIREHIPITNLFTCLWFNEVDRFTSRDQISFSTVRDKIRARVGWMPEMFLDCERRNFVIQGYHRELLEQMIASGWKPPPTASEPSRKLRLGSRKAPPSKKSSMKRKRVKKSSSRRRLPKPITRMTDTTTWQKLGA

SEQ ID NO: 6383 - protein, 579 aa, Zea mays
MTGSAASLGLRSGSYGSLAAAAVVGSGGRKAGATACRTLRVEKERLHRALRLVGRRRTGVLLLLAVASAALFCSLFAVVKDDANSTSIVNNYEVPNAIQKSVYPSRTRPLMMSGNQESTSVVNKIDFPNRLHLSFANFTHPCEGFSVPPPLVDKKRTGPRPCPVCYVSVDQAFALMPLQASPSPVLKDLNYVSEDGVTANLSNQGSGFGGHPSLDQRNDSFNINESMTVHCGFVRGKKPGQGTGFDIKDDDLLEMEQCHDLVVASAIFGNYDMIQHPRNISDFSKANACFYMFVDEETEAYVKNSSSLYNNNKVGLWRLVVVRNLPYEDPRRTGKIPKLLLHRLFPNVRFSVWIDAKLELVVDPYLLLERFLWRKNTTFAISRHYKRFDVFEEAEANKAAGKYDNASIDYQIEFYRNEGLTHYSSAKLPITSDVPEGCVIIREHIPITNLFTCVWFNEVDRFTSRDQISFSTVRDKIRARVGWMPEMFMDCERRNFVVQVYHRELLEQMIASGRMPPLAAAVTHANVRVGSRKAPPTKKPSVKRKREKKSSSRRRLPKPIAQGLDANVTQVFFSVAESG

SEQ ID NO: 6384 - protein, 433 aa, Cenchrus ciliaris
FTHPCEGFSVPPPLVDKKRTGPRPCPVCYVSVEQAFALMPLQASPSPVLKNLNYISEDDIVANSSSQGSRFGGHPSLEQRNKSFDIGESMNVHCGFVRGKKPGQGTGFDIKDDDLLEMEECRELFLASAIFGNYDMIQHPRNISEFSKANACFYMFVDEETEAYVKNSSSLYNNNKIGLWRLVVVRNLPYEDPRRTGKIPKLLLHRLFPNVRFSVWIDAKLELVADPYLLLERFLWRKNVTFAISRHYKRFDVFEEAEANKAAGKYDNASIDYQIEFYRNEGLSHYSPAKFPITSDVPEGCVIIREHIPITNLFTCLWFNEVDRFTSRDQISFSTVRDKIRARVGWMPEMFLDCERRNFVVQAYHRELLEQMIASGRRPPSTTDAPPSRKLRPGSRKAPPSKKPSVKRKKEKKSSSRRRVPKPPLVAGGMGAM

SEQ ID NO: 6385 - protein, 382 aa, Hordeum vulgare
MSVASASAAALRSSSGRRCGVGTGLNGGNKFLMMQRRDLLTKGVALSVSSSLLASSTSSDGAAAQALERLPFKADGYSFWTWRGRRIHYVEQGSGQPIVLIHGFGASAFHWRYNIPELAKKYKVYAVDLLGFGWSEKALVEYDATIWMEQVSDFLREVVQSPSVVVGNSLGGFTTLFAATEVPELVRGVVLLNSAGQFGDPNAPPKAEEAAEEEVSAVTRLIVKPLKEAFQRVVLGFLFWQAKQPARVEKVLKSVYKDPSNVDEYLISSITAPTADPNAGEVYYRLMSRFMANQSRYTLDKLLGKLTCPLLLLWGDLDPWVGPAKAARIHEFYANSTVVNLQAGHCPHDEAPEQFNAALLQWLASLEEEAGDKPAEPSLQVV

SEQ ID NO: 6386 - protein, 381 aa, Leymus cinereus x Leymus triticoides
MSVASASAAALRSSSGRRCGVGTGLNGGNKFLMMQRRDLVTKGVALSVCSSLLASSSSNGAAAQALERLPFKADGYSFWTWRGRRIHYVEQGSGQPIVLIHGFGASAFHWRYNIPELAKKYKVYAVDLLGFGWSEKALVEYDATIWMEQVSDFLREVVQSPSVVVGNSLGGFTTLFAATEVPELIRGVVLLNSAGQFGDPNASPKAEEAVEEEVSAVTRLIVRPLKEVFQRVVLGFLFWQAKQPARVEKVLKSVYKDPSNVDEYLIGSITAPTADPNAGEVYYRLMSRFMANQSRYTLDKLLGKLTCPLLLLWGDLDPWVGPAKAARIHEFYANSTVVNLQAGHCPHDEAPEQFNAALLQWLASLEEEAVDKPAEPSLQVV

SEQ ID NO: 6387 - protein, 382 aa, Triticum aestivum
MSVASAPAAALRSSSGRRCGVGTGLNGGNKFLMMQRRDLVTKGVALSVCSSLLTSSPNGAAAQALERLPFKADGYSFWTWRGRKIHYVEQGSGQPIVLIHGFGASAFHWRYNIPELAKKYKVYAVDLLGFGWSEKALVQYDATIWMEQVSDFLREVVQSPSVVVGNSLGGFTTLFAATEVPELVRGVVLLNSGGQFADPNAPPKAEEAAAAEEEVSAVTRLIVRPLKEAFQRVVLGFLFWQAKQPARVEKVLKSVYKDPSNVDEYLISSITAPTADPNAGEVYYRLMSRFVANQSQYTLDKLLGKLTCPLLLLWGDLDPWVGPSKAARIHEFYANSTVVNLQAGHCPHDEAPEQFNAALLQWLASLEEEAGDKPAEPSLQVV

SEQ ID NO: 6388 - protein, 383 aa, Triticum aestivum
MSVASASAAALRSSSGRRCGVGTGLNGGNKFLMMQRRDLVTKGVALSVCSSLLASSTSNGAAAQALERLPFKADGYSFWTWRGRKIHYVEQGSGQPIVLIHGFGASAFHWRYNIPELAKKYKVYAVDLLGFGWSEKALVQYDATIWMEQVSDFLREVVQSPSVVVGNSLGGFTTLFAATEVPELVRGVVLLNSAGQFADPNAPPKAEEAAAAEEEVSALTRLIVKPLKEAFQRVVLGFLFWQAKQPARVEKVLKSVYKDPSNVDEYLISSITAPTADPNAGEVYYRLMSRFVANQSQYTLDKLLGKLTCPLLLLWGDLDPWVGPSKAARIHEFYANSTVVNLQAGHCPHDEAPEQFNAALLQWLASLEEEAGDKPAEPSLQVV

SEQ ID NO: 6389 - protein, 383 aa, Secale cereale
MSVASASAAALRSSSGRRCGVGTGLNGGNKFLMMQRRDLVTKGVTFTVCSSLLASSTSSDVAAAQALERLPFKADGYNFWTWRGRRIHYVEQGSGQPIVLIHGFGASAYHWRYNIPELAKKYKVYAVDLLGFGWSEKALVEYDATIWMEQVSDFLREVVQSPSVVVGNSLGGFTTLFAATEVPELVRGVVLLNSAGQFGDPNAAPKAEEAAAEEEVSAVTRLIVRPLKEAFQRVVLGFLFWQARQPARVEKVLKSVYKDPSNVDDYLISSITAPTADPNAGEVYRRLMSRFMANQSQYTLDKLLGKLTCPLLLLWGDLDPWVGPAKAARIHEFYTNSTVVNLQAGHCPHDEAPEQFNAALLQWLASLEEEAGDKPAEPSLQVV

SEQ ID NO: 6390 - protein, 379 aa, Avena sativa
MSVASASAATLWSSSGRRSGELNGGNRFLMMQRRDVVTKGIALTVCSSLLASSSPNGAADAQALERLPFKADGYSFWTWRGRRIHYVEQGSGQPIVLIHGFGASAFHWRYNIPELAKKYKVYAVDLLGFGWSEKALVEYDATIWMEQVSDFLREVVQSPSVLVGNSLGGFTTLFTATEVPELVRGIVLVNSAGQFGDPNAPPKAEQAEEEVSALTRLILKPIKEAFQRVVLGFVFWQSKQPARVEKVLKSVYKDPTNVDDYLISSITAPTADPNAGEVYYRLMSRFVANQTQYTLDKLLGKLSCPLLLLWGDLDPWVGPAKAARIHEFYANSTVVNLQAGHCPHDEAPEQVNAALLQWLASLEEETGDKPPAEPSLQAV

SEQ ID NO: 6391 - protein, 380 aa, Avena sativa
MSVASASAATLRSSSGRRSGELNGGNKFLMMQRRDVVTKGIALTVCSSLLANSSPNGAADAQAALERLPFKADGYSFWTWRGRRIHYVEQGSGQPIVLIHGFGASAFHWRYNIPELAKKYKVYAVDLLGFGWSEKALVEYDATIWMEQVSDFLREVVQSPSVLVGNSLGGFTTLFTATEVPELVRGIVLVNSAGQFGDPNAPPKAEEAKEEASAVTRLILKPIKEAFQRLVLAFVFWQSKQPARVEKVLKSVYKDPTNVDDYLISSITAPTADPNAGEVYYRLMSRFVANQTQYTLDKLLGKLSCPLLLLWGDLDPWVGPAKAARIHEFYANSTVVNLQAGHCPHDEAPEQVNAALLQWLASLEEETGDKPPAEPSLQAV

SEQ ID NO: 6392 - protein, 317 aa, Leymus cinereus x Leymus triticoides
MAASCTLTVPGPLAAASSSSTSARRYRRFGVVAMASVGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPAVTLELKDDSYSRSMWDFSFQALYKVALHSTSLSTTLKITNTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKQSWVAEQKIELI

SEQ ID NO: 6393 - protein, 318 aa, Triticum aestivum
MAASCTLTVPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELI

SEQ ID NO: 6394 - protein, 318 aa, Leymus cinereus x Leymus triticoides
MAASCTLTLPAPFAAASSSSSTSARRHRRFGVVAMASVGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLKGSKTLNKDPDPKNPLEGKEEREEVTFPGFVDCVYLGAPSELTLDNGLGDKIVISNTNWSDAVLWNPHLQMEACYKDFVCVENAKIETVQLGPKQSWVAEQKIELI

SEQ ID NO: 6395 - protein, 318 aa, Pseudoroegneria spicata
MAASCTLTVPAPFAAASSSSPTSARRYRRFGVVAMASVGQKVYAPGVAVSEGDGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELI

SEQ ID NO: 6396 - protein, 318 aa, Secale cereale
MAASCTLTVPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGTMQQHGFARNVNWSITDSEVTEGDPTVTLELKDDQYSRSMWDFSFQALYKVALHSTSLSTTLKIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 6397 - protein, 318 aa, Secale cereale
MAASCTLTVPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGTMQQHGFARNVNWSITDSEVTEGDPTVTLELKDDQYSRSMWDFSFQALYKVALHSTSLSTTLKIINTDDKPFSFNSALHTYFTASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 6398 - protein, 317 aa, Avena sativa
MAASCTLTVPAPFAASSSSSSSARRSRRFGVVAMASVGQKVYAPGVAVSEGNGGLPKISLKSPQGSEAEIYLFGGCVTSWKVPSGKDLLFVRPDAVFNGQKPISGGIPHCFPQFGPGAIQQHGFARNVNWSFTDSEVTEGDPAVTLELKDNSYSRSMWDFSFQALYKVVLHSTSLSTTLTITNTDDKPFSFNSALHTYFSASIAGVSVKGLKGSKTLNKDPDPKNPIEGKEERDEVTFPGFVDCVYLGAPSELTLDNGLGDKIVISNTNWSDAVLWNPHLQMEACYKDFVCVENAKIETVQLGPKESWVAKQKIELI

SEQ ID NO: 6399 - protein, 317 aa, Triticum aestivum
MAASCTLTVPAPFAAASSSSSTARRYRRFGVVAMASVGQKVYAPGVAVSDGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLKGSKTLNKDPDPKNPLEGKEERDEVTFPGFVDCVYLGAPTELTLDNGLGDKIVISNTNWSDAVLWNPHLQMEACYKDFVCVENAKIETVQLGPKESWVAEQKIELV

SEQ ID NO: 6400 - protein, 315 aa, Hordeum vulgare
MAASCTLTVPGPFAAASSTSARRHRRFGVVAMASAGQKVYATGVAVSEGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRAMWDFSFQALYKVALHSTSLSTTLTIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 6401 - protein, 314 aa, Hordeum vulgare
AASCTLTVPGPFAAASSTSARRHRRFGVVAMASAGQKVYATGVAVSEGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRAMWDFSFQALYKVALHSTSLSTTLTIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 6402 - protein, 311 aa, Festuca arundinacea
MFAVSAPFAASSSSNSARRSRRFGVVAMASVGQKVYAPGVAVSEGNGGLPKISLKSPQGSEAEIYLFGGCVTSWKVPSGKDLLFVRPDAVFNGQKPISGGIPHCFPQFGPGAIQQHGFARNVNWSITDSEVTEGDPAVTLELKDDSYSRSMWDFSFHALYKVTLHSTSLSTTLTIINTDDKPFSFNSALHTYFSASIAGVSVKGLKGSKTLNKDPDPKNPLEGKEEREEVTFPGFVDCVYLGAPSELTLDNGLGDKIVISNTNWSDAVLWNPHLQMEACYKDFVCVENAKIETVQLGPKESWVAEQKIELI

SEQ ID NO: 6403 - protein, 319 aa, Oryza sativa
MAASCALTLPSAISVSVSVSSNSPRRFRRSRRVVAMASVGQKVYAPGVAVSEGNGGLPKIDLKSPHGSEAEIYLFGACVTSWKVPSGKDLLFVRPDAVFNGQKPISGGIPHCFPQFGPGTMQQHGFARNMNWSITDSEANEGDPAVTLELKDDSYSRSMWDFSFQALYKVALHSTSLSTTLKITNTDDKPFSFNSALHSYFSASISGVSVKGLKGCKTLNKDPDPKNPLEGKEEREEVTFPGFVDCIYLGAPSELTLDNGLGDKIVISNANWSDAVLWNPHLQMEACYKDFVCVENAKIETLQLGPNQSWVAEQKIELI

SEQ ID NO: 6404 - protein, 315 aa, Zea mays
MAASCASTLPPLSFVSSSSSPRRFRRSGVVAMASVGQKVYAPGVAVSEGNGGLPKIDLKSPHGSEAEIYLFGACVTSFKVPNGKDLLFVRPDAVFNGQKPISGGIPHCFPQFGPGPMQQHGFARNVNWSITDSEVTEGDPAVTLELKDDTYSRSMWDFSFHALYKVSLHSKSLSTTLAIINTDDKPFSFNSALHTYFSASITGVSVKGLKGCKTLNKDPDPKNPLEGKEEREEVTFPGFVDCVYLGAPSELILDNGLGDKIAIANSNWSDAVLWNPHLQMEACYKDFVCVENAKIEMVQLEPKQSWVAEQKIELV

SEQ ID NO: 6405 - protein, 316 aa, Sorghum bicolor
MAASCASTLPSLSFVSSSSSSSRRFRRSGVVAMASVGQKVYAPGVAVSEGNGGLQKIDLKSPHGSEAEIYLFGACVTSFKVPNGKDLLFVRPDAVFNGQKPISGGIPHCFPQFGPGPMQQHGFARNVNWSITDSEVMEGDPTVTLELKDDSYSRSMWDFSFHALYKVSLHSTSLSTTLEIINTDVKPFSFNSALHTYFSASIAGVSVKGLKGCKTLNKDPDPKNPLEGKEEREEVTFPGFVDCIYLGAPSELILDNGLGDKIAIANSNWSDAVLWNPHLQMEACYKDFVCVENAKIEMVQLEPKQSWVAEQKIELV

SEQ ID NO: 6406 - protein, 317 aa, Panicum virgatum
MAASCASTLPSLSFVSSSSSNSPRRFRRSRVVAMASVGQKVYAPGVAVSEGNGGLPKIDLKSPHGSEAEIYLFGACVTSFKVPNGKDLLFVRPDAVFNGQKPISGGIPHCFPQFGPGPMQQHGFARNVNWSIADSEVTEGDPAVTLELKDDSYSRSMWDFSFQALYKVSLHSTSLSTTLKITNMDDKPFSFNSALHTYFRASIAGVSVKGLKGCKTLNKDLDPKNPLEGKEEREEVTFPGFVDCIYLGAPSQLILDNGLGDKIAISNSSWSDAVLWNPHQQMEACYKDFVCVENAKIETVQLEPKQSWVAEQKIELV

SEQ ID NO: 6407 - protein, 317 aa, Setaria italica
MAASCASTLPSLSFVSNSYCNSPRRFRRSAVVAMASVGQKVYAPGVAVSEGNGGLQKIDLKSPHGSETEIYLFGACVTSFKVPNGKDLLFVRPDAVFNGQKPISGGIPHCFPQFGPGPMQQHGFARNVNWSITDSEVTEGDPAVTLELKDDSYSRSMWDFSFQALYKVSLHSTSLSTTLKITNTDDKPFSFNSALHTYFRASITGVSVKGLKGCKTLNKDPDPKNPLEGKEEREEVTFPGFVDCIYLGAPSELILDNGLGDKIAISNSNWSDAVLWNPHLQMEACYKDFVCVENAKIETVQLEPKQSWVAEQKLELL

SEQ ID NO: 6408 - protein, 316 aa, Saccharum officinarum
MAASCASTLPSLPFVSSSSSSSHRFRRSGVVAMASVGQKVYAPGVAVSEGNGGLQKIDLKSPHGSEAEIYLFGACVTSFKVPNGKDLLFVRPDAVFNGQKPISGGIPHCFPQFGPGPMQQHGFARNVNWSITDSELTEGDPAVTLELKDDSYSRSMWDFSFHALYKVSLHSTSLSTTLEIINTDVKPFSFNSALHTYFSASITGVSVKGLKGCKTLNKDPDPKNPLEGKEEREEVTFPGFIDCIYLGAPSELILDNGLGDKIAITNSNWSDAVLWNPHLQMEACYKDFVCVENAKIETVQLEPKQSWVAEQKIELV

SEQ ID NO: 6409 - protein, 317 aa, Pennisetum glaucum
MAASCASTVPSLSFVSTYSSNSPRRFRRSAVVAMASVGQKVYAPGVAVSEGNGGLQKVDLKSPHGSEAEIYLFGACVTSFKVPNGKDLLFVRPDAVFNGQKPISGGIPHCFPQFGPGPMQQHGFARNVNWSITDSEVTEGDPAVTLELKDDSYSRSMWDFTFQALYKVSLHSTSLSTTLKITNTDDKPFSFNSALHTYFRASITGVSVKGLRGCKTLNKDPDPNNPLEGKEEREEVTFPGFVDCIYLGAPTELILDNGLGDKIVISNSSWSDAVLWNPHLQMEACYKDFVCVENAKIETVQLEPKQSWVAEQKIELL

SEQ ID NO: 6410 - protein, 128 aa, Triticum aestivum
MAASCTLTVPAPFAAASSSSSTSARRYRRFGVVAMASVGQKVYAPGVAVSDGNGGLPKISLKSPHGSEAEIYLFGACVTSWKVPSGKDLLFVRPDAVFNGQKPISGGIPHCSPSLAPVPCSSMDSQGM

SEQ ID NO: 6411 - protein, 330 aa, Secale cereale
  misc_feature (13)..(13): Xaa can be any naturally occurring amino acid
  misc_feature (71)..(71): Xaa can be any naturally occurring amino acid
  misc_feature (150)..(150): Xaa can be any naturally occurring amino acid
  misc_feature (222)..(222): Xaa can be any naturally occurring amino acid
  misc_feature (247)..(247): Xaa can be any naturally occurring amino acid
  misc_feature (249)..(249): Xaa can be any naturally occurring amino acid
TEVSASPRGQAEXAASCTLTVPAPFAAASSSSSTSARRYRRFGVVAMASAGQKVYAPGVAVSEGNGGLPKXSLKSPHGSEAEIYLFGACVTSWKVPNGKDLLFVRPDAVFNGQKPISGGIPHCFPQFGPGTMQQHGFARNVNWSITDSPXTEGDPTVTLELKDDQYSRSMWDFSFQALYKVALHSTSLSTTLKIINTDDKPFSFNSALHTYFTASIAGVSVXGLKGSKTLNKDPDPKNPLEGKEERXGXTFPGFVDCVYLGAPSELTLDNGLGDKIVISNTNWSDAVLWNPHLQMEACYKDFVCVENAKIETVQLGPKESWVAEQKIELV

SEQ ID NO: 6412 - protein, 298 aa, Panicum virgatum
SNSPRRFRRSRVVAMASVGQKVYAPGMAVSEGNGGLPKINLKSPHGSEAEIYLFGACVTSFKVPNGKDLLFVRPDAVFNRQKPISGGIPHCFPQFGPGPMQQHGFARNVNWSIADSEVTEGDPAVILELKDDSYSRSMWDFSFQALYKVSLHSKSLSTTLKITNMDDKPFSFNSALHTYFRASITGVSVKGLKGCKTLNKDPDPKNPLEGKEEREEVTFPGFVDCIYLGAPGELILDNGLGDKIAISNSSWSDAVLWNPHLQMEACYKDFVCVENAKIETVQLEPKQFWVAEQKIELI

SEQ ID NO: 6413 - protein, 302 aa, Secale cereale
ASVGQMVYAPGVAVSEGNGGLPKISLKSPHGSEAEIYLFGACVTSWKVPNGKDLLFVRPDAVFNGQKPISGGIPHCFPQFGPGTMQQHGFARNVNWSITDSEVAEGDPTVTLELKDDSYSRSMWDFSFQALYKVALHSTSLSTTLKIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVVLKMQRLKQYNWVQKNLGWQSRKLNLSEANGLRTVQCGEYVVKGPF

SEQ ID NO: 6414 - protein, 282 aa, Secale cereale
SAGQKVYAPGVAVSEGNGGLPKISLKSPHGSEAEIYLFGACVTSWKVPNGKDLLFVRPDAVFNGQKPISGGIPHCFPQFGPGTMQQHGFARNVNWSITDSEVTEGDPTVTLELKDDQYSRSMWDFSFQALYKVALHSTSLSTTLKIINTDDKPFSFNSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 6415 - protein, 299 aa, Lolium multiflorum
FTIAAPFASSSSSSSARRSRRFGVVAMASVGQKVYAPGVAVSEGNGGLPKISLKSPQGSEAEIYLFGGCVTSWKVPSGKDLLFVRPDAVFNGQKPISGGIPHCFPQFGPGAIQQHGFARNVNWSITDSEVTEGDPAVTLELKDDSYSRSMWDFSFHALYKVTLHSTSLSTTLTIINTDDKPFSFNSALHTYFSASIAGVSVKGLKGSKTLNKDPDPKNPLEGKEEREEVTFPGFVDCVYLGAPSELTLDNGLGDKIVISNTNWSDAVLWNPHLQMEACYKDFVCVENAKIETVPARAAA

SEQ ID NO: 6416 - protein, 214 aa, Triticum aestivum
MAAEEPKKVEVEAAPEPEAAPPAVPAAEPEAPAKDVTEEKAVIPAPAPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 6417 - protein, 213 aa, Pseudoroegneria spicata
MAAEEPKKVEVEAAPEPEAAPAVPAAEPEAPAKDVTEEKAVIPAPAPAAEEEKPPADDSKALVVVEKVADEPVAEKPTDEKAAHGGSNDRDLALARVESEKRNSLIKAWEENEKTKAENKAAKKASAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 6418 - protein, 214 aa, Secale cereale
MAAEEPKKVEVEAAPEPEAAPVAVPAAEPEAPAKDVTEEKAVIPAPPPAAEDEKTPVDDSKALVAVEKVADEPVAEKPTDEKAAHGGSNDRDLALARVESEKRNSLIKAWEENEKTKAENKAAKKVSAILSWENTKKANIEAQLKKIEEQLEKKKAEYAEKMKNKAAMIHKEAEEKRAMVEAKKGEELLKAEEMAAKYRATGNSPKKVMGCFGA

SEQ ID NO: 6419 - protein, 214 aa, Triticum aestivum
MAAEEPKKVEVEAAPEPEAAQPAVPAAEPEAPAKDVTEEKAVIPAPEPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 6420 - protein, 210 aa, Triticum aestivum
MAAEEPKKVEVEAAPEPEAVPAAEPEAPAKDVTEEKAVIPAPEPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGNSPKKVMGCFGA

SEQ ID NO: 6421 - protein, 213 aa, Triticum aestivum
MAAEEPKKVEVEAAPEPEAAPPAVPAAEPEAPAKDVTEEKAVIPAPAPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFG

SEQ ID NO: 6422 - protein, 211 aa, Hordeum vulgare
MAAEEPKKVEVEAAPEPEPAPPAAEPEAPAKDVTEEKAVIPAPAPAADEEKPPVDDSKALVVVEKVADEPVAEKLTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGNSPKKVMGCFGA

SEQ ID NO: 6423 - protein, 53 aa, Leymus cinereus x Leymus triticoides
MKNKAAMIHKEAEEKRAMVEAKKGEELLKAEEMAAKYRATGHSPKKVMGCFGA

SEQ ID NO: 6424 - protein, 216 aa, Secale cereale
MAAEEPKKVEVEAAPEPETAPVAVPAAEPEAPAKDVTEEKAVIPAPPPPPAAEDEKTPVDDSKALVAVEKVADEPVAEKPTDEKAAHGGSNDRDLALARVESEKRNSLIKAWEENEKTKAENKAAKKVSAILSWENTKKANIEAQLKKIEEQLEKKKAEYAEKMKNKAAMIHKEAEEKRAMVEAKKGEELLKAEEMAAKYRATGNSPKKVMGCFGA

SEQ ID NO: 6425 - protein, 209 aa, Festuca arundinacea
  misc_feature (19)..(19): Xaa can be any naturally occurring amino acid
  misc_feature (26)..(26): Xaa can be any naturally occurring amino acid
MAAEEAKKVEVEAAPEPEXAPPAVPXAEPEAPAKDVTEEKAVVPVEEEKAAVDDSKALVPVEKVADEPAAEKPADEKPAHGGSNDRDIALTRVETEKRNSLIKAWEENEKTKAENKAAKKVSAILSWENTKKANIEAQLKKIEEQLEKKKAEYAEKMKNKAALIHKEAEEKRAMVEAKRGEELLKAEETAAKYRATGNSPKKAMGCFGA

SEQ ID NO: 6426 - protein, 209 aa, Avena sativa
MAAEDPKKVEVEAAPEPEVAAPVPAAEPEAPAKDVTEEKAVVPAEEAKPPVDDDSKALVVVEKVADEPVAEKPADEKTPQGGSNDRDIALTRVETEKRNSLIKAWEENEKTKAENKAAKKVSAILSWENTKKANIEAQLRKIEEQLEKKKAEYAEKMKNKAALIHKEAEEKRAMVEAKRGEEILKAEETAAKYRATGNSPKKAMGCFGA

SEQ ID NO: 6427 - protein, 206 aa, Oryza sativa
MAEEEAKKVEVEVTEAPPAAAAAAETEPAAKDVAEEKAVIPAPAPPAEEEKPPVDDSKALAIVEKVADEPPAEKPAQGGSNDRDVALARVETEKRNSLIKAWEENEKTKAENKASKKLSAILSWENTKKANIEAQLKKIEEQLEKKKAEYAEKMKNKVAIVHKEAEEKRAMVEAKRGEEVLKAEEMAAKYRATGHAPKKLIGCFGA

SEQ ID NO: 6428 - protein, 212 aa, Sorghum bicolor
MAEEAAKKVEVEVTKDKEPEAAPAEAVPEAAAKEDVAEEKAVIPATEPPAAEEKPPADDSKALAIVEKVADEPAPEKPAAEKQGGSNDRDLALARVETEKRNSLIKAWEENEKTKAENKAAKKVSAILSWENTKKANIEAQLKKIEEQLEKKKAEYAEKMKNKVAMIHKEAEEKRAMVEAKRGEEVLKAEEMAAKYRATGHAPKKLIGCFGA

SEQ ID NO: 6429 - protein, 213 aa, Saccharum officinarum
MAEEEAKKVEVEVTKDKEPEAAPAEAEPEAAKEDVAEEKAVIPATEPPADEEKPPAPADDSKALAIVEKVADEPAPEKPAAEKQGGSNDRDLALARVETEKRNSLIKAWEENEKTKAENKAAKKVSAILSWENTKKANIEAQLKKIEEQLEKKKAEYAEKMKNKVAMIHKEAEEKRAMVEAKRGEEVLKAEEMAAKYRATGHAPKKLIGCFGA

SEQ ID NO: 6430 - protein, 206 aa, Pennisetum glaucum
MAEEAAKKVEVEVAKEPEAAPAAAEAPKEDVAEEKAVIPASEPPAAEEKPADDSKALAIVEKVADEPAAEKPAAEKQGSSNDRDLALARVETEKRNSLIKAWEENEKTKAENKAAKKISAILSWENTKKANIEAELKKIEEQLEKKKAEYAEKMKNKVAIIHKEAEEKRAMVEAKRGEEVLKAEEMAAKYRATGHAPKKVIGCFGA

SEQ ID NO: 6431 - protein, 68 aa, Brachypodium distachyon
MEKEQMKMAILRQEQTFRHQVNELHRVYQVQKQLMTEVHVVKMNWAQAGGDTQAEAMVETNHLQCYSN

SEQ ID NO: 6432 - protein, 157 aa, Brachypodium distachyon
MEKEQMKMAILRQGQTFRHQVNVLHRVYQVQKQLMTEVHVVKMNWAQAGGDTQAEAMVETNHLQCYSNSGEKKPPPVEDFDLELTLATGSDRRKQEMGSNSDSGATVSSSTSAESELRQRFPESNVNGFKVRARGMMISTCSTHAVSLALCLSLTMA

SEQ ID NO: 6433 - protein, 260 aa, Brachypodium distachyon
MAAAGALHASGRILLPMRRTPSTPWSHVRSHLHCTKPPPSPLPPPPPPPPPSSPGLFSRFTPAFAPTTRRSGPIGSGLVAWYLGSIEARPVLTKSITAATIFTVADLTSQMITLDSDGSLDLIRTLRMASYGMLISGPSLHFWFNFISRAVPKKDLVNTFKKMFLGQAVYGPIINCVFFSYNAGLQGETVPEIIARLKRDLIPTIKSGLIYWPLCDFITFKFIPVHLQPLVSNSFSFLWTIYITYMASLKKPELEVIASS

SEQ ID NO: 6434 - protein, 1271 aa, Secale cereale
MEMALRAQSPLCSRSHPVLVVRPASAALAQSIVKCSKFTRSRLVRCVVASSDYPKRNPRRSSAPKPKGTASRGYAPRPSAESWTSTKKIEHSSADEDGDLGRSNGTLGSDTTEQTSTSEEESEVEFAGNVSTSAELKGVIEAETEEEVDQKQSSTLASTSMDVESVNEATEQTSTADESSEVDFSGNVSSSVVLEGVNEVETEQEADQKQSSALASASMDVESIDRQLEEYRVRISALVGAASTQGQGHSIIGVHEHDKSVNSLSEQDISAIDFPEQSQSGVGVTREDPTEQTTSKQDVAASNNLVARKHSLSEDGVGASKVANEEPLIAGDELRVTEDEEQHEPEMQERVQKDVDLQALKRRLEELADGNYSIGNKCFVFPELVEADSVIDLYLNRSMSALASEPDILIKGAFNGWRWNHFTEKLHKSELTGDWWCCKLYIPKQAYRLDFVFFNGDTVYENNSYNDFVLHIESDIDEDSFEDFLLEEKQMELERLAAEEAERERQAEEERRKEEERAAMEADRAHAKAEVEMMRNKLQHVLGLASRYADNLWYIEPNTYKGGDMVQLYYNRSSGPLKNKNEIWLHGGYNNWTDGPSIVERLVKSEEKDGDWWYGNVTLPESALVLDWVFADGPPGNASKYDNNGKRDFHAAVSKSISEDLFWMEEEHRIFEGLQRERKEKEDAGRRKAEITARMKAEMKEKTMREFLLSQKHIVYTEPLEVRAGTTVDVLYNPSNTVLNGSPEVWFRCSFNRWTHPSGPLPPQRMVNAENRSHLQATVKVPLDAYMMDFVFSESEEGGIYDNRDGMDYHIPVSDSMAKEPPMHIVHIAVEMAPIAKVGGLGDVVTSLSRAIQDLGHKVEVIFPKYDCLNLSNVKDLHCRQSFTWGGTEIKVWFGKVEGISVYFLEPQNGMFWVGCVYGRNDESRFGFFCHSALEFLLQSGSSPDIIHCHDWSSAPVAWLYKQQYVHNGLPNGRVVFTIHNLEFGVHHIGKAMAHCDKATTVSYTYSKEVSGHGSIAPHYFKFHGIRNGIDSDIWDPYNDNFIPVHYTSENVVEGKSSAKRALQEKLGLHQTDSPLVGIISRLTAQKGIHLIKHAIYRTLERNGQVVLLGSAPDHRIQGDFSNLAAKLHGEFDGRVKLCLTYDEPLSHLIYAGADFILVPSIFEPCGLTQLTAMRYGSIPIVRKTGGLYDTVFDVDDDKDRAREQGLEPNGFSFEGADSNGVDYALDRAITTWYDARDWFHSLCKRVMEQDWSWNRPALDYMELYHSARKK

SEQ ID NO: 6435 - protein, 625 aa, Triticum aestivum
MEMALRAQSPLCSRSRPVLLVRPAVPGLAQSIVKCSRFTRSRLVRCMVASSYPKRNPRRSSAPKPKGTASREYAPRPSAESWTSTKKTEHSSADEDGDLGASNGTLSSDTAEQTSTAEEEYEVEFPGNVSSSVEPKGVNEEEVDQKQPPALTSTSMDAESVNEATEHTSTANESSEVDFSGNVSSSVVLEVVDESETEEEADQKQSSASSTSMDVESIDRELEGYRVRISALVGASTQGQDQSIIGVHEQDKSVITSDEQDISAVDVPEQSQSVVAVTREDTTDQTTSEQDITEAVVEEIASKNLVARKHSSSEDGVGARKHANEEPLVAGDGLRVTEDEEQHEPEMQEQVKMDVDPQALKRRLEELADKNYSIGNKCFVFPELVEADSVIDLYLNRSMSALANEPDILIKGAFNGWRWNHFTEKLHRSELTGDWWCCKLYLPKQAYRLDFVFFNGDTVYENNSYNDFVLHIESDRDEHSFEDFLLEEKQRELERLAAEEAERERQAEEERRKEEERAAMEADRAQAKAEVETTRNKLQHVLGLASRYVDNLWYIQPSTYKGGDRVRLYYNRSSRPLKHKNEIWLHGGYNNWTDGPSIVERLVKSEEQDGDWWYANVTLPESALV

SEQ ID NO: 6436 - protein, 1223 aa, Triticum aestivum
SSDYPKRNPRRSSAPKPKGTASRGYAPRPSAESWTSTKKTEHSSADEDGDLGTSNGTLSSETTEQTSTAEEEYEVEFSGNVSSSVELKGVNEEEVDQKQPPALSSTSMDAESVNEATEHTSTADESSEVDFSGNVSSSVVLEVVDESETEEEADQKQSSASSTSMDVESIDRELEGYRVRISALVGASTQGQDQSIIGVHEQDKSVITSDEQDISAVDVPEQSQSVVAVTREDTTEQTTSEQDITEAVVEEIASKNLVARKHSSSEDGVGARKHANEEPLVAGDELRVTEDEEQHEPEMQEQVKMDVDPQALKRRLEELADKNYSIGNKCFVFPELVEADSVIDLYLNRSMSALANEPDILIKGAFNGWRWNHFTEKLHRSELTGDWWCCKLYLPKQAYRLDFVFFNGDTVYENNSYNDFVLHIESDIDEHSFEDFLLEEKQRELERLAAEEAERERQAEEERRKEEERAAMEADRAQAKAEVETTRNKLQHVLGLASRYADNLWYIQPSTYKGGDRVRLYYNRSSRPLKHKNEIWLHGGYNNWTDGPSIVERLVKSEEKDGDWWYANVTLPESALVLDWVFADGSPGNASKYDNNGKQDFHAAVSKSISDDLFWVEEERRIFERLQRERKEKEDACRRKAEITARMKADMKEKTMREFLLSQKHIVYTEPLEVRAGTTVDVLYNPSNTVLNGSPEVWFRCSFNRWTHPSGPLPPQKMVNAENGSHLQATVRVPLDAYMMDFVFSESEEGGIYDNRDGMDYHIPVSDSMAKEPPMHIVHIAVEMAPIAKVGGLGDVVTSLSRAIQDLGHKVEVIFPKYDCLNLSNVKDLHCRQSFTWGGTEIKVWFGKVEGISVYFLEPQNGMFWVGCVYGKNDESRFGFFCHSALEFLLQSGSSPDIIHCHDWSSAPVAWLYKQQYVHNGLPNGRVVFTIHNLEFGVHHIGKAMAHCDKATTVSYTYSKEVSGHGSIAPHYFKFHGIRNGIDSDIWDPYNDNFIPVHYTSENVVEGKSSAKRALQEKLGLHQTDSPLVGIISRLTAQKGIHLIKHAIYRTLERNGQVVLLGSAPDHRIQGDFSNLAAKLHGEFDGRVKLCLTYDEPLSHLIYAGADFILVPSIFEPCGLTQLTAMRYGSIPIVRKTGGLYDTVFDVDDDKDRACEQGLEPNGFSFEGADSNGVDYALDRAITTWYDARDWFHSLCKRVMEQDWSWNRPALDYMELYHSARKN

SEQ ID NO: 6437 - protein, 1226 aa, Hordeum vulgare
YSDYPKRNPRRSSAPKPKGTASRGYAPRPSADSWTSTKKIEHGSADEDGDLGRSNGTLSGDATEQASTAEEESGVEFAGNVSSSAGLEGVAETEEEADQNQPPALSSTSMDVESVNEATEQTIIGDESSVVDFSGNVSGSVALEVVDESETEEEADQKQSSSLASTSMDSESIDRELEGYRARINALVGASTQEQDQSIIGVHDQDKSVISPNEQDISAVDVPEQGLSGVGVTREDPTKQTTSKQEITEAAVEEISSKNFVARKHSISGDGVEASKNANQQPLVDGDELKITEDEEQHEPEMQEYVRKDVDLQALKRRLEELADGNYSIGNKCFVFPELVKADSVIDLYLNRSMSALASEPDILIKGAFNGWRWNHFTERLHKSELSGDWWCCKLYIPKQAYRLDFVFFNGDTVYENNSYNDFVLHIESDIDEHSFEDFLLEEKQRELERLAAEEAERERQAEEERRKEEERAAMEADRAQAKAEVEMTRNNLQHVLGLASRYANNLWYIEPNTYKGGDRVRLYYNRSSGPLKHKNEIWLHGSYNNWTDGPSIVERLVKSDEQDGDWWYANVTLPESALVLDWVFADGPPGNARKYDNNGKRDFHAAVSKSISEDLFWVKEEHRIFERLQRERKEKEDAGRRKAEITARMKAEMKEKTMREFLLSQKHIVYTEPLEVRAGMTVDVLYNPSNTVLNGSPEVWFRCSFNRWTHPSGPLPPQKMVNAENGSHLQATVRVPLDAYMMDFVFSESEEGGMYDNRDGMDYHIPVSDSMAKEPPMHIVHIAVEMAPIAKVGGLGDVVTSLSRAIQDLGHKVEVVFPKYDCLNLSNVKDLHCRQSFTWGGTEIKVWFGKVEGISVYFLEPQNGMFWVGCVYGRNDESRFGFFCHSALEFLLQSGSSPDIIHCHDWSSAPVAWLYKQHYVHNGLPNGRVVFTIHNLEFGVHHIGKAMAHCDKATTVSYTYSKEVSGHGSIAPHYFKFHGIRNGIDSDIWDPYNDNFIPVHYTSENVVEGKSSAKRALQEKLGLHQTDSPLVGIISRLTAQKGIHLIKHAIYRTLERNGQVVLLGSAPDHRIQGDFSNLASKLHGEFDGRVKLCLTYDEPLSHLIYAGADFILVPSIFEPCGLTQLTAMRYGSIPIVRKTGGLYDTVFDVDDDKDRAREQGLEPNGFSFEGADSNGVDYALDRAITTWYDARGWFHSLCKRVMEQDWSWNRPALDYMELYHSARKN

SEQ ID NO: 6438 - protein, 162 aa, Avena sativa
MEALASSPRALFSRTASPTPSVAKWASSSATRPAAGRVRAAAAAEPAGEAQPAAASADGDAASAPAPKKILKKKPVYSMKKGQIVRVEKEKYLNSINYLSVGHPPFYKGLDYIYEDRGEVLDIRIFETGEYALIAWVGIPTPPAWLPTYMLIKSDKLNYERI

SEQ ID NO: 6439 - protein, 137 aa, Avena sativa
MGSSSATRPAAGRVRAAAAEPAGEEKPAAVAADGDAASAPAPKKILKKKPVYSMKKGQIVRVEKEKYLNSINYLSVGHPPFYKGLDYIYEDRGEVLDIRIFETGEYALIAWVGIPTPPAWLPTYMLIKSDKLNYERI

SEQ ID NO: 6440 - protein, 155 aa, Triticum aestivum
MEALASSPRALFARTASPTTAVATSARWMPSSSRLVKAAAAAEPAGEAKPAAAAASPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 6441 - protein, 155 aa, Triticum aestivum
MEALASSPRALFARTASPTTAVATSARWMPSSSRLVKAAAAAEPAGDAKPAAAAAAPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 6442 - protein, 155 aa, Triticum aestivum
MEALASSPRALFARTASPTTALATPARWTPSSTRRVKAAAAAEPAGEAKPAAAAASPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 6443 - protein, 155 aa, Hordeum vulgare
MEALASSPRALFAGTASPATALATPARWTPSSTRRVKAAAAAEPAGEAKPAAAAASPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 6444 - protein, 232 aa, Triticum aestivum
MADSAALSSSLPRSLASRRPLSSPLRGGGRPRSPRRCRPGSRLRARARKGEPEDLYGPYPWEQPLDLTTGFDIEWVQEDKITLFTSDGLVQIGGNMVPRRVTASEKRQQKGKGKLRRFQESSYMDPNQSLCLGALFNIAATNGLDMGRRLCIFGFCRSIEMLSDVVEDTVLEHGGEIVTAEKASSDGLQEKLTMSVAVPLLWGVPPASETLHVAVRSGGGIVDKIYWQWDLF

SEQ ID NO: 6445 - protein, 237 aa, Avena sativa
MADSAALSTASSSSLPRSLASRRPLSSPLHGGRPRSPRRCRFGSRLRARARKGDPEDIYGPYPWEQPLDLTTGFDIEWVQEDKITLFTSDGLVQIGGSMVPRRVTASEKRQQKAKGTNKIRRFQESSYMDPNQSLCLGALFNIAATNGLDMGRRLCIFGFCRSIEMLSDVVEDTVLEHGGEIVTAEKASSDGLQEKLTMSVAVPLLWGVPPASETLHVAVRSGGGIVDKIYWQWDLF

SEQ ID NO: 6446 - protein, 231 aa, Secale cereale
MADSAALSSSLPRSLASRRPLSSPLHGGRPRSPRRCRPGSRLRARARKGEPEDLYGPYPWEQPLDLTTGFDIEWVQEDKITLFTSDGLVQIGGNMVPRRVTASEKRQQKGKGKLRRFQESSYMDPNQSLCLGALFNIAATNGLDMGRRLCIFGFCRSIEMLSDVVEDTVLEHGGEIVTAEKASSDGLQEKLTMSVAVPLLWGVPPASETLHVAVRSGGGIVDKIYWQWDLF

SEQ ID NO: 6447 - protein, 237 aa, Hordeum vulgare
MADSAALSSSLPRSLASRRPLSSPPRGGGGGGSGRPRSPRRCRPGSRLRARARKGEPEDLYGPYPWEQPLDLTTGFDIEWVQEDKITLFTSDGLVQIGGNMVPRRVSASEKRQQKGKGKLRRFQESSYMDPNQSLCLGALFNIAATNGLDMGRRLCIFGFCRSIEMLSDVVEDTVLEHGGEIVIAEKASSDGLQEKLTMSVAVPLLWGVPPASETLHVAVRSGGGIVDKIYWQWDLF

SEQ ID NO: 6448 - protein, 231 aa, Pseudoroegneria spicata
MADSAALSSSLPRSLASRRPLSSPLHGGRPRSPRRCRPGSRLRARARKGEPEDLYGPYPWEQPLDLTTGFDIEWVQEDKITLFTSDGLVQIGGNMVPRRVTASEKRQQKGKGKLHRFQESSYMDPNQSLCLGALFNIAATNGLDMGRRLCIFGFCRSIEMLSDVVEDTVLEHGGEIVTAEKASSDGLQEKLTMSVAVPLLWGVPPASETLHVAVRSGGGIVDKIYWQWDLF

SEQ ID NO: 6449 - protein, 239 aa, Panicum virgatum
MADSAALSTASSSLPRSLASRRPLSSPLHARSRLLRRSRSGSRSLHRLRARAGKDDPEDLYGPYPWDQPLDLTSGFDIQWVPEDRVTLFTSDGLVQIGGSLVPRRVSSSEKRQQKLKSKQKLRRFQESSYMDPNQSLCLGALFNIAATNGLDMGRRLCIFGFCRSIEMLSDVVEDTVLEHGGEVVAAEKASNDGLQEKLTMSVAVPLLWGVPPASETLHVAVRSGGGIVDKIYWQWNLF

SEQ ID NO: 6450 - protein, 239 aa, Oryza sativa
MADSAAAASSSLPRSLASRRPLPSSPLRGGRPRSPRRCRFGSRSLHRLRARAGKDDPEDLYGPYPWDQSLDLTTGLDIQWVPEDRVTLFTSDGLVQIGGSLVPRRITPSEKRQRKVKGIQNIQRFQESSYMDPNQSLCLGALFNIAATNGLDMGRRLCIFGFCRSIEMLSDVVEDTVLEHGGEVVTAEKASKDGLQEKLTMSVAVPLLWGVPPASETLHVAVRSGGGIVEKIYWQWDLF

SEQ ID NO: 6451 - protein, 239 aa, Setaria italica
MADSAALSSASSSLPRSLASRRPLSSPLHARSRPLRRGRSGSRSLHRLRARAGKDDPEDLYGPYPWDQSLDLTTGFDIQWVPEDRVTLFTSDGLVQIGGSLVPRRVSSSEKRQRKLKSTPKLRRFQESSYMDPNQSLCLGALFNIAATNGLDMGRRLCIFGFCRSIEMLSDVVEDTVLEHGGEVVTAEKASNDGLQEKLTMSVAVPLLWGVPPASETLHVAVRSGGGIVDKIYWQWDLF

SEQ ID NO: 6452 - protein, 234 aa, Sorghum bicolor
MADSAALSTSLPRSLASRRPLSSPLHARARARSQLDSRSLHRLRARAGKDDPEDLYGPYPWDQPLDLTTGFDIQWVPEDRVTLFTSDGLIQIGGSLVPRRVSASEKRQRKLKSAQKLRRFQESSYMDPNQSLCLGALFNIAATNGLDMGRRLCIFGFCRSIEMLSDVVEDTVLEHGGEVVTAEKASNDGLQEKLIMSVAVPLLWGVPPASETLHVAVRSGGGIVDKIYWQWDLF

SEQ ID NO: 6453 - protein, 234 aa, Saccharum officinarum
MADSAALSTSLPRSLASRTPLSSPLHARARARSQLGSRSLHRLRARAGKDDPEDLYGPYPWDQPLDLTTGFDIQWVPEDRVTLFTSDGLIQIGGSLVPRRVSASEKRQRKMKSAQKLRRFQESSYMDPNQSLCLGALFNIAATNGLDMGRRLCIFGFCRSIEMLSDVVEDTVLEHGGEVVTAEKASNDGLQEKLTMSVAVPLLWGVPPASETLHVAVRSGGGIVDKIYWQWDLF

SEQ ID NO: 6454 - protein, 238 aa, Zea mays
MADSAALSTSLPRSLASRRPLSSPLHARARARSQRRCRLGSRSLHRLRARAGKDDPEDLYGPYPWDQPLDLTAGSDIQWVPEDRVTLFTSDGLIQIGGSLVPRRVSASEKRQRKLKSGQKLRRFQESSYMDPNQSLCLGALFNIAATNGLDMGRRLCIFGFCRSIEMLSDVVEDTVLEHGGEVVTAEKASSNGLQEKLTMSVAVPLLWGVPPASETLHVAVRSGGGIVDKIYWQWDLF

SEQ ID NO: 6455 - protein, 224 aa, Triticum aestivum
LSSPLRGGGRPRSPRRCRPGSRLRARARKGEPEDLYGPYPWEQPLDLTTGFDIEWVQEDKITLFTSDGLVQIGGNMVPRRVTASEKRQQKGKGKLRRFQESSYMDPNQSLCLGALFNIAATNGLDMGRRLCIFGFCRSIEMLSDVVEDTVLEHGGEIVTAEKASSDGLQEKLTMSVAVPVAVGRPSGIGDPPCRRAERRRHRGQDLLAVGPVLRAQSPQILVDK

SEQ ID NO: 6456 - protein, 277 aa, Secale cereale
MADPRLLLPRILCVVAAAAFCALLPAPVSAIRKDTGFAAPIICRRTVQGRHLISDDNGYVCSALSIDPWSRCCPQTGGRFSCQGCNLDSQCCNSYEYCVSCCLNPSRTKEADVLKLKVAKPVTAGTYTNIFDFCMGRCRHSSASVVHENAYLSDFHHCFLVQQNSSAGSTESNFGSRLDGINVILGRQGETCSSACRAKGQSCVPSRLSELNKCQILQKYMRCKNGCFPSLGPDQPAEVVDEAPKNLNPGACLYMQMDDRLTCDGSHQHTRRLCPCA

SEQ ID NO: 6457 - protein, 272 aa, Festuca arundinacea
GTRSLPAMANASLQSFLLQHNHSFLNNTVHDGSPTAALRLTTNASTSISFKLFTSSSSSVTTASTAAPTPVASAAATTSPPTPSLELLGQQLAEGDYRQADETTRALLIYLAGEPARRRGYVFFSEVQFISVEDLRAIDTLWMEHSNGKFGYSVQRRIWEKSVRDYTRLFIKIGWMKKLDSEVEQFNYRAFPDEFIWELNDDTPEGHLPLTNALRGTRLMENIFTHPAFDCPEEEAAEENNDTGSNAGQNKDDSKVRVRPKIMTDFKPDYSF

SEQ ID NO: 6458 - protein, 273 aa, Leymus cinereus x Leymus triticoides
  misc_feature (22)..(22): Xaa can be any naturally occurring amino acid
  misc_feature (25)..(25): Xaa can be any naturally occurring amino acid
  misc_feature (30)..(30): Xaa can be any naturally occurring amino acid
  misc_feature (40)..(40): Xaa can be any naturally occurring amino acid
  misc_feature (65)..(65): Xaa can be any naturally occurring amino acid
  misc_feature (67)..(67): Xaa can be any naturally occurring amino acid
  misc_feature (73)..(73): Xaa can be any naturally occurring amino acid
  misc_feature (111)..(111): Xaa can be any naturally occurring amino acid
  misc_feature (130)..(130): Xaa can be any naturally occurring amino acid
  misc_feature (217)..(217): Xaa can be any naturally occurring amino acid
  misc_feature (241)..(241): Xaa can be any naturally occurring amino acid
  misc_feature (255)..(255): Xaa can be any naturally occurring amino acid
MANASLQSFLPQHHHSFLNSTXHDXSPSAXLKLTTNASNXNSISFKLFASSSSSVTTAASTANSXAXTPVAAXAATTSPPTPSLELLGQQLAEGDYRQADETTRALLIILXGEAARRRGYVFFSEVQFIXAEDLRAVDALWLEHSNGRFGYSVQRRIWEKSLREFTRFFIKIGWMKKLDTEVEQFNYRAFPDEFIWELNDDTPEGHLPLTNALRGTXLLENIFTHPAFDCEEEEAAAEEEXDTGSATGQNNKDDXKGRGRPKILTDFKPDYSF

SEQ ID NO: 6459 - protein, 273 aa, Triticum aestivum
MANASLQSFLPQHHHSFPSSTTHDGSPPALLKLTANTTTNASNSISFKLFASSSSSVTTTANSPAPTPVAAAAATTSPPTPSLELLGQQLAEGDYWQADETTRALLIVLAGEAARRRGYVFFSEVQFISVEDLRAVDALWLEHSGGRFGYSVQRRIWEKSLREFTRFFIKIGWMKKLDTEVEQFNYRAFPDEFIWELNDDTPEGHLPLTNALRGTRLLENIFTHPAFDCEEEEAAGAEEEADKGSATDQNNKDDNKGRGRPKSLTDFKPDYSF

SEQ ID NO: 6460 - protein, 276 aa, Triticum aestivum
MANPRLLLPRILCVAAVAAFYACLPAPVSAIRKDIGFAAPIICRSTVQGRHLISDDNGYVCSALSIDPWSRCCPRTGGRFSCQGCNLDSQCCNSYEYCVSCCLNPSRTKEADVLKLKVAKPVTAGTYTNIFDFCMGRCRHSSASVVHENAYLSDFHHCFLVQQNSSGSTESNFGSRLDGINVILGRQGESCSSACRAKGQSCVPSRLAELNKCQILQKYMRCKNGCFPSLGPDQPAEVVDEAPKNLNPGACLYMQMDDRLTCDGSHRHTRRLCPCA

SEQ ID NO: 6461 - protein, 207 aa, Triticum aestivum
MVSLLPTNRRTLLLGCNLDSQCCNSYEYCVSCCLNPSRTKEADVLKLKVAKPVTAGTYTNIFDFCMGRCRHSSASVVHENAYLSDFHHCFLVQQNSSGSTESNFGSRLDGINVILGRQGESCSSACKAKGQSCVPSRLSELNKCQILQKYMRCKNGCFPSLGPDQPAEVVDEAPKNLNPGACLYMQMDDRLTCDGSHRHTRRLCPCA

SEQ ID NO: 6462 - protein, 307 aa, Triticum aestivum
MSSPPAPVFERLAGIRPLAESGRFKAWFLDQFGVLHDGKKPYPGAILALEKLAGNGAKMVIISNSSRRSSVTMEKLQSLGFDTSCFLGAITSGELTHQYLDKRDDPWFASLGRKCVHLTWGNRGAISLEGLGLQVVNNVDDAEFILAHGTEALGLPSGDPLSKSLEELEQILVLGIQKRLPMVVANPDYVTVEARNLRVMPGTLAAKYESLGGEVKWMGKPDKVIYTSAMSLAGVEAHECITVGDSLHHDIKGANGAGMASAFITGGIHAAELGLGEFGETAGDDAVSALCCKHSSYPSYVLPSFAW

SEQ ID NO: 6463 - protein, 307 aa, Secale cereale
MSSAPTPVFERLAGIRPLAESGRFKAWFLDQFGVLHDGKKPYPGAILALEKLAGNGAKMVIISNSSRRSSVTMEKLQSLGFDTSCFLGAITSGELTHQYLHKRDDPWFAALGRKCIHLTWGNRGAISLEGLDLQVVSNVDDAEFILAHGTEALGLPSGDPLSKSLEELEQILVLGIQKRLPMVVANPDYVTVEARNLRVMPGTLAAKYESLGGEVKWMGKPDKVIYTSAMSLAGVEAHECITVGDSLHHDIKGANGAGMASAFITGGIHAAELGLGEFGETAGDDAVGALCCKHSSYPSYVLPSFAW

SEQ ID NO: 6464 - protein, 307 aa, Hordeum vulgare
MSSAPAPVFERMAGIRPLAESGRFKAWFLDQFGVLHDGKKPYPGAILALEKLAGNGAKMVIISNSSRRSSVTMEKLQSLGFDTSCFLGAITSGELTHQYLHKRDDPWFAALGRKCVHLTWGNRGAISLEGLGLQVVSNVDDAEFILAHGTEALGLPSGDPLSKSLEELEQVLVLGIQKRLPMVVANPDYVTVEARDLRVMPGTLAAKYESLGGEVKWMGKPDKVIYTSAMCLAGVEAHECITVGDSLHHDIKGANGAGMASAFITGGIHAAELGLVEFRETAGDDAISALCCKHSSYPSYVLPSFAW

SEQ ID NO: 6465 - protein, 307 aa, Triticum aestivum
MSSAPTPVFERLAGIRPLAESGRFKAWFLDQFGVLHDGKKPYPGAILALEKLAGMGAKMVIISNSSRRSSVTMEKLQSLGFDTSCFLGAITSGELTQQYLHKRDDPWFASLGRKCIHLTWGNRGAISLEGLGLQVVNNVDDAEFILAHGTEALGLPSGDPLSKSLEELEQILVLGIQKRLPMVVANPDYVTVEARNLRVMPGTLAAKYECLGGEVKWMGKPDKVIYTSAMSLAGVEAHECITVGDSLHHDIKGASGAGMTSAFITGGIHAAELGLGEFGETAGDDAVSALCCKHSSYPSYVLPSFAW

SEQ ID NO: 6466 - protein, 307 aa, Triticum aestivum
MSSAPAPVFERLAGIRPLAESGRFKAWFLDQFGVLHDGKKPYPGAILALEKLAGNGAKMVIISNSSRRSSVTMEKLQSLGFDTSCFLGAITSGELTQQYLHKRDDPWFASLGRKCIHLTWGNRGAISLEGLGLQVVNNVDDAEFILAHGTEALGLPSGDPLSKSLEELEQILVLGIQKRLPMVVANPDYVTVEARNLRVMPGTLAAKYECLGGEVKWMGKPDKVIYTSAMSLAGVEAHECITVGDSLHHDIKGASGAGMTSAFITGGIHAAELGLGEFGETAGDDAVSALCCKHSSYPSYVLPSFAW

SEQ ID NO: 6467 - protein, 308 aa, Oryza sativa
MASAASAPAFERLAGIRALAESGRFKAWFLDQFGVLHDGKKPYPGAVLALEKLAEKGAKMVIISNSSRRSSVTMEKLESLGFDPSCFLRAITSGELTHQYLQKRDDPWFAALGRKCVHLTWGNRGAISLEGLGLQVVSNVEEAEFILAHGTEALGLPSGDPLPKSLEELEQVLMLCLEKRLPMVVANPDYVTVEARDLRVMPGTLAAKYESLGGEVKWMGKPDKVIYTSAMSLAGVNPHECITVGDSLHHDIKGANASRVASAFITGGIHATELGLNEIGEIAGEDAIDSLCRKHGSYPTYVLPSFTW

SEQ ID NO: 6468 - protein, 308 aa, Sorghum bicolor
MASAAAAPVFERVAGIRAIAESGRFKAWFLDQFGVLHDGKKPYPGAILALEKLAGNGAKMVIISNSSRRSSVTMEKLKSLGFDTSCFLATITSGELTHQHLQKRNDPWFAALGRKCIHITWGDRGAISLEGLGLQVVNNVDDAEFILAHGTEALGSPSGDPLPKSLEELEQVLMLGLEKQLPMVVANPDYVTVEARDLRVMPGTLAAKYESLGGEVKWMGKPDKMIYTSAMSLPGVDAHECIMVGDSLHHDIKGANVSGIASAFITGGIHADELGLGEFGETAGKDAINSLCSKHGSYPSYVLPSFTW

SEQ ID NO: 6469 - protein, 308 aa, Zea mays
MASTASPPVFERVAGIRAIAESGRFKAWLLDQFGVLHDGKKPYPGAILALEKLAENGAKMVIISNSSRRSSVTMKKLKSLGFDTSCFLATITSGELTHQHLQKRDDPWFAALGRKCIHITWDDRGAISLEGLGLQVVNNVDDAEFILAHGTEALGSPSGVPLPKSLEELEQVLMLGIEKRLPMVVANPDYVTVEARDLRVMPGTLAAKYESLGGEVKWMGKPDKVIYTSAMSLAGVDARECIMVGDSLHHDIKGANASGMASAFVTGGVHADELGLGEFGETAGEDAVSSLCSKHGSYPSYVLPSFAW

SEQ ID NO: 6470 - protein, 308 aa, Setaria italica
MASAPSAPVFERVAGIRAIAESGRFKAWFLDQFGVLHDGKKPYPGAILALEKLAGNGAKMVIISNSSRRSSVTIEKLQSLGFDTSCFLGTITSGELTHQHLLKRNDSWFATLGRKCIHITWGNRGAISLEGLGLQVVNNVDDAEFILAHGTEALGSPSGDPLPKSLEELEQVLMLGLEKRLPMVVANPDYVTVEARDLRVMPGTLAAKYESLGGEVKWMGKPDKVIYTSAMSLAGVDAHECIMVGDSLHHDIKGANATGIASAFITGGIHAAELGLTEFGETAGEDAINALCSKHGSYPSYVLPSFTW

SEQ ID NO: 6471 - protein, 308 aa, Pennisetum glaucum
MASAPSAPVFEMVAGIRTIAESGRFKAWFLDQFGVLHDGKKPYPGAILALEKLAGNGAKMVIISNSSRRSSVTIEKLQSLGFDTSCFLGTITSGELTHQHLLKRNDPWFAALGRKCIHITWGDRGAISLEGLGLQVVNNVDDAEFILAHGTEALGSPSGDPLSKSLEELEQVLMLGLEKRLPMVVANPDYVTVEARDLRVMPGTLAAKYESLGGEVKYMGKPDEVIYTSAMSLAGVDAHECIMVGDSLHHDIKGANASGIASAFITGGVHTDELGLTEFGETAGEDAINALCSKHGSYPSYVLPSFTW

SEQ ID NO: 6472 - protein, 594 aa, Festuca arundinacea
MKVIEKIQEAAANGRTAFSFEYFPPKTEEGVENLFERMDRMVAHGPNFCDITWGAGGSTADVTLDIANRMQNMVCVETMMHLTCTNMPVEKIDSALDAIKSNGIQNVLALRGDPPHGQDKFVQVAGGFSCALDLVQHIRAKYGDYFGITVAGYPEAHPEVILGEEGATEEAYSNDLAYLKRKVDAGADLIVTQLFYDTDIFLKFVNDCRQIGITCPIVPGIMPINNYKGFIRMTGFCKTKIPAEITAALEPIKDNEEAVKAYGIHLGTEMCKKILATGINTLHLYTLNMEKTALAILTNLGLIEESKLSRTLPWRPPTNVFRVKEDVRPIFWANRPKSYISRTIGWDQYPHGRWGDSRNPSYGALTDYQFTRPRGRGKKLQEEWAVPVKSVQDINERFMNFCQGKLTSSPWSELDGLQPETKIIDDQLVKINLKGFLTINSQPAVNAEKSDSPSVGWGGPGGYVYQKAYVEFFCAKEKLDQLIEKSKAFPSLTYIAVSKEGETFSNIPANAVNAVTWGVFPGKEIIQPTVVDSASFLVWKDEAFEIWSKGWACLFPEGDSSRELLEQVQKSYYLVSLVDNDYVQGDLFAAFKEI

SEQ ID NO: 6473 - protein, 594 aa, Avena sativa
MKVIEKIQEAAANGRTAFSFEYFPPKTEEGVENLFERMDRMVAHGPNFCDITWGAGGSTADVTLDIANRMQNMVCVETMMHLTCTNMPVEKIDSALDAIKTNGIQNVLALRGDPPHGQDKFVQVAGGFSCALDLVQHIKAKYGDYFGITVAGYPEAHPEVILGEEGATEEAYSNDLAYLKRKVDAGADLIVTQLFYDTDIFLKFVNDCRQIGITCPIVPGIMPINNYKGFIRMTGFCKTKIPAEITAALDPIKDNEEAVKAYGIHLGTEMCKKILASGINTLHLYTLNMEKTALAILTNLGLIEESKLSRTLPWRPPTNVFRVKEDVRPIFWANRPKSYISRTLGWDQYPQGRWGDSRNPSYGALTDYQFTRPRGRGKKLQEEWAVPLKSVQDINERFVSFCQGKLTSSPWSELDGLQPETKIIDDQLVNINLKGFLTINSQPAVNAEKSDSPSVGWGGPGGYVYQKAYAEFFCAKEKLDQLIEMCKAFPSITYIAVSKEGETFSNLPANAVNAVTWGVFPGKEIIQPTVVDSSSFLVWKDEAFEIWSKGWACLFPEGDSSRALLEQVQKSYYLVSLVDNDYIQGDLFAVFKGI

SEQ ID NO: 6474 - protein, 594 aa, Triticum aestivum
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKSNGIQNVLALRGDPPHGQDKFVQVAGGFSCALDLVEHIKAKYGDYFGITVAGYPEAHPEVILGEEGATEEAYSKDLAYLKRKVDAGADVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSESPSVGWGGPGGYVYQKAYVEFFCAKEKLGQLIEKSKAFPSLTYIAVNKEGESISNIPANAVNAVTWGVFPGKEIIQPTVVDSASFMVWKDEAFEIWSRGWACLFPEGDSSRELLEQIQKSYYLVSLVDNDYISGDLFAAFKEI

SEQ ID NO: 6475 - protein, 594 aa, Triticum aestivum
MKVIEKIQEAAANGRTAFSFEYFPPKTEEGVENLFERMDRMVAHGPNFCDITWGAGGSTADVTLDIANRMQNMVCVETMMHLTCTNMPVEKIDNALDTIKSNGIQNVLALRGDPPHGQDKFVQVAGGFSCALDLVEHIKAKYGDYFGITVAGYPEAHPEVILGEEGATEEAYSKDLAYLKRKVDAGADVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSDSPSVGWGGPGGYVYQKAYVEFFCAKEKLGQLIEKSKAFPSLTYIAVNKEGESISNIPANAVNAVTWGVFPGKEIIQPTVVDSASFMVWKDEAFEIWSRGWACLFPEGDSSRELLEQIQKSYYLVSLVDNDYISGDLFAAFKEI

SEQ ID NO: 6476 - protein, 591 aa, Leymus cinereus x Leymus triticoides
  misc_feature (98)..(98): Xaa can be any naturally occurring amino acid
  misc_feature (467)..(467): Xaa can be any naturally occurring amino acid
IEKIQEAAATGRTVFSFEYFPPKTEEGVENLFERMDRMVAHGPNFCDITWGAGGSTADVTLDIANRMQNMVCVETMMHLTCTNMPVEKIDNALDTIKXNGIQNVLALRGDPPHGQDKFVQVAGGFSCALDLVQHIRAKYGDYFGITVAGYPEAHPEVILGEEGATEEAYSKDLAYLKRKVDAGADVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSDSPSVGWGGPGGYVYQKAYXEFFCAKEKLDQLIEKSKAFPSLTYIAVNKEGESISNIPANAVNAVTWGVFPGKEIIQPTVVDSASFMVWKDEAFEIWSKGWACLFPEGDSSRELLEQVQKSYYLVSLVDNDYINGDLFAAFKEI

SEQ ID NO: 6477 - protein, 594 aa, Secale cereale
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKSNGIQNVLALRGDPPHGQDKFVQVAGGFSCALDLVQHIKAKYGDYFGITVAGYPEAHPEVILGEEGATEEAYSKDLAYLKRKVDAGAEVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPQGRWGDSRNPSYGALNDHQFTRPRGRGKKLQEEWAVPLKSVQDINERFVNFCEGKLKSSPWSELDGLQPETTIIDDQLVKINSEGFLTINSQPAVNAEKSDSPSVGWGGPGGYVYQKAYVEFFCAKEKLGQLIEKTKAFPSLTYIAVNKEGESISNIPVNAVNAVTWGVFPGKEIIQPTVVDSASFMVWKDEAFEIWSRGWACLFPEGDSSRELLEQIQKSYYLVSLVDNDYISGDLFAAFKGI

SEQ ID NO: 6478 - protein, 594 aa, Hordeum vulgare
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKNNGIQNVLALRGDPPHGQDKFVQVAGGFSCALDLVQHIRAKYGDYFGITVAGYPEAHPEVILGEDGATEEAYSKDLAYLKRKVDAGADVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPQGRWGDSRNPSYGALNDHQFTRPRGRGKKLQEEWAVPLKSVQDINERFVNFCEGKLKSSPWSELDGLQPETTIIDDQLVKMNSKGFLTINSQPAVNAEKSESPSVGWGGPGGYVYQKAYVEFFCAKEKLDQLIEKSKAFPSLTYIAVNKEGESISNIPANAVNAVTWGVFPGKEIIQPTVVDSASFMVWKDEAFEIWSRGWACLFPEGDSSRELLEQVQKTYCLVSLVDNDYISGDLFAAFKEI

SEQ ID NO: 6479 - protein, 594 aa, Oryza sativa
MKVIEKIQEAAADGRTVFSFEYFPPKTEEGLDNLFERMDRMVAHGPNFCDITWGAGGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPEAHPDAIQSTEGATPEAYSNDLAYLKQKVDAGADLIITQLFYDTDIFLKFVNDCRQIGITCPIVPGIMPINNYKGFLRMTGFCKTKIPAEITAALEPIKDNEEAVKAYGIHLGTEMCKKILATGIKTLHLYTLNMEKSALGILMNLGLIEESKISRSLPWRPPTNVFRVKEDVRPIFWANRPKSYISRTLGWDQYPHGRWGDSRNPSYGALTDYQFTRPRGRGKKLQEEWAVPVKSVEDINERFMNFCQGKLTSSPWSELDGLQPETKIIDDQLVKINQKGFLTINSQPAVNGERSDSTSVGWGGPGGYVYQKAYLEFFCSKEKLDQLIEKSKAFPSLTYIAVNKDGESFSNIPTNAVNAVTWGVFPGKEIVQPTVVDSASFMVWKDEAFEIWSKGWACLFPEGDSSREILDKVQKSYFLVSLVDNDYINGDLFAAFKEI

SEQ ID NO: 6480 - protein, 594 aa, Panicum virgatum
MKVIEKIQQAAADGRTAFSFEYFPPKTDEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYTNDLAYLKRKVDAGADLIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKSALAILMNLGLIEESKISRPLPWRPPTNVFRVKEDVRPIFWANRPKSYITRTLGWDQYPHGRWGDSRNPSYGALTDHQFTRPRGRGKKLQEEWAVPLKSVEDISERFTNFCEGKLTSSPWSELDGLQPETKIIDEQLMKINQKGFLTINSQPAVNGEKSDSPTVGWGGPGGYVYQKAYLELFCAKEKLDQLVEKIKAFPALTYIAVNKDGESFSNIPANAVNAVTWGVFPGKEIIQPTVVDSASFMVWKDEAFEIWTRGWGCLFPEGDSSRELLEKVQKSYYLVSLVDNDYIHGDLFAAFKEL

SEQ ID NO: 6481 - protein, 593 aa, Sorghum bicolor
MKVIEKIQEAAGNGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDCRQIGITCPIVPGIMPINNYKGFLRMTGFCKTKIPSEITAALDPIKDNEEAVKQYGIHLGTEMCKKILATGIKTLHLYTLNMDKSAIGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLVKINQKGFLTINSQPAVNGEKSDSPTVGWGGPGGYVYQKAYLEFFCAKEKLDQLIEKIKAFPSLTYIAVNKDGESFSNIAPNAVNAVTWGVFPGKEIIQPTVVDPASFMVWKDEAFEIWTRGWACLFPEGDSSRELLEKVQKSYYLVSLVDNDYVQGDLFAAFKI

SEQ ID NO: 6482 - protein, 593 aa, Saccharum officinarum
MKVIEKIQEAAGNGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEEGATLEAYSNDLAYLKRKVDAGADLIVTQLFYDTDIFLKFVNDCRQIGITCPIVPGIMPINNYKGFLRMTGFCKTKIPSEITAALDPIKDNEEAVKQYGIHLGTEMCKKILATGIKTLHLYTLNMDKSALGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLVKINQKGFLTINSQPAVNGEKSDSPTVGWGGPGGYVYQKAYLEFFCAKEKLDQLIEKIKSFPSLTYIAVNKDGESVSNIATNAVNAVTWGVFPGKEIIQPTVVDPASFMVWKDEAFEIWTRGWACLFPEGDSSRELLEKVQKSYYLVSLVDNDYVQGDLFAAFKI

SEQ ID NO: 6483 - protein, 593 aa, Zea mays
MKVIEKILEAAGDGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDCRQIGITCPIVPGIMPINNYKGFLRMTGFCKTKIPSEITAALDPIKDNEEAVRQYGIHLGTEMCKKILATGIKTLHLYTLNMDKSAIGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLVNINQKGFLTINSQPAVNGEKSDSPTVGWGGPGGYVYQKAYLEFFCAKEKLDQLIEKIKAFPSLTYIAVNKDGETFSNISPNAVNAVTWGVFPGKEIIQPTVVDHASFMVWKDEAFEIWTRGWGCMFPEGDSSRELLEKVQKTYYLVSLVDNDYVQGDLFAAFKI

SEQ ID NO: 6484 - protein, 387 aa, Setaria italica
MKVIEKIQQAAADGRTAFSFEYFPPKTEEGVENLFERMDRMVAHGPSFCDITWGAGGSTADLTLDIANRMQNMVCVESMMHLTCTNMPVEKIDHALETIKSNGIQNVLALRGDPPHGQDKFVQVEGGFACALDLVKHIRAKYGDYFGITVAGYPEAHPDAIQGEGGATPEAYNNDLAYLKRKVDAGADLIVTQLFYDTDIFLKFVDDCRQIGITCPIVPGIMPINNYKGFIRMTGFCKTKIPAEITDALEPIKENEEAVKEYGVHLGTEMCKKILASGIKTLHLYTLNMEKSAIEILKRLGLIEEFKVSRPLPWRPPTNVFRVKEDVRPIFWANRPKSYIRRTLGWDQYPHGRWGDSRNPSYGALTDHQFTRLVGVVKSSKRNGLFH

SEQ ID NO: 6485 - protein, 595 aa, Pennisetum glaucum
MKVIEKIQQAAENGRTAFSFEYFPPKTEEGVENLFERMDRMVAHGPSFCDITWGAGGSTADLTLDIANRMQNMVCVETMMHLTCTNMPVEKIDHALETIKSNGIQNVLALRGDPPHGQDKFVQVEGGFACALDLVEHIRAKYGDYFGITVAGYPEAHPDAILGEGGATPEAYSNDLAYLKKKVDAGADLIVTQLFYDTDIFLKFVDDCRQIGITCPIVPGIMPINNYKGFIRMTGFCKTKIPDEITNALEPIKENEEAVKEYGVHLGTEMCKKILASGIKTLHLYTLNMEKSAIEILKRLGLIEESKISRPLPWRPPTNVFRVKEDVRPIFWANRPKSYIRRTLGWEQYPHGRWGDSRNPSYGALTDHQFTRPRGRGKKLQEEWAVPLKSVEDISERFTSFCQGKLTSSPWSELDGLQPETKIIDDQLVKINQKGFLTINSQPAVNGEKSDSPTVGWGGPGGYVYQKAYLEFFCSKEKLDQLVDKIKAFPSLTFIAVNKYGVSASNIPANAVNAVTWGVFPGKEIIQPTVVDSASFTVWKDEAFEIWTAGWACLFPEDDSSSKELLKKVQDNYYLVSLVDNDYIHGDLFAAFKEI

SEQ ID NO: 6486 - protein, 595 aa, Musa acuminata
MKVIDKIRGAAEGDGRTVFSFEFFPPKTEEGVENLFERVDRMVAHNPNFCDITWGAGGSTADLTLDIANRMQNMICVETMMHLTCTNMPVEKIDHALDTIKANGIQNVLALRGDPPHGQDKFVQVAGGFACALDLVQHIRAKYGDYFGITVAGYPEAHPDMIQGDGGATQEAYNNDLAYLKRKVDAGADLIITQLFYDTDIFLKFVNDCRQIGITCPIVPGIMPINNYKGFLRMTGFCKTKIPPEITAALDPIKDNEDAVRAYGVHLGTEMCKKILSHGIKTLHLYTLNMEKSALAILMNLGLIEESKVSRSLPWRRPANVFRVKEDVRPIFWANRPKSYISRTVGWDQYPHGRWGDSNNPSYGALTDYQFMRPRSRDKKLQEEWATPLKSVDDINERFMKFCLGKLRSSPWSELDGLQPETKIINEQLSQVNLKGFLTINSQPPVNGEKSDSPAVGWGGPGGYVYQKAYLEFFCSKDKLISITENCKALPSLTYIAVNKEGEYVSNVVLNAVNAVTWGVFPGKEIIQPTVVDPASFMIWKDEAFEIWTRGWARLFPEGDPSRELLAQVQKSCFLVSLVDNDYIHGDIFAAFKGA

SEQ ID NO: 6487 - protein, 595 aa, Elaeis guineensis
MKVIEKIRAAVEGDGRTVFSFEYFPPKTEEGVENLFERMDRMVAHNPAFCDITWGAGGSTADLTLEIANRMQNMICVETMMHLTCTNMPVEKIDHALDTIKTNGIQNVLALRGDPPHGQDKFVQVAGGFACALDLVQHIRSKYGDYFGITVAGYPEAHPDMIQGEGGATLEAYSNDLAYLKRKVDAGADFIITQLFYDTDIFLKFVNDCRQIGITCPIVPGIMPINNYKGFLRMTGFCKTRIPPEITAALEPIKENEEAVKAYGIHLGTEMCKKILAHGIKTLHLYTLNMEKSALAILMNLGLIEESKISRSLPWRRPTNVFRAKEDVRPIFWANRPKSYIARTLGWEQYPHGRWGDSRNPSYGALTDYQFMRPRARDKKLQEEWAIPLKSLNDIKERFMNFCLGKLRSSPWSELDGLQPETKIIDEHLGEIILKGFLTINSQPAINGEKSDSPTVGWGGPGGYVYQKAYLEFFCSKEKLNLLIEKCKGFPSLTYVAVNREGECLSNIAPNAVNAVTWGVFPGKEIVQPTVVDPASFMVWKDEAFEIWTKGWACLFPDGDPSSELLEQVQRNYFLVSLVDNDYVHGDLFAAFKDI

SEQ ID NO: 6488 - protein, 595 aa, Musa acuminata
MKVIDKIRAATEGDGRTVFSFEFFPPKTEEGVENLFERMDRMVAHNPTFCDITWGAGGSTADLTLDIANRMQNMICVETMMHLTCTNMPVEKIDHALDTIKANGIQNVLALRGDPPHGQDKFVQVAGGFACALDLVQHIRAKYGDYFGITVAGYPEAHPDMIQGDGGATLEAYNSDLAYLKRKVDAGADLIITQLFYDTDNFLKFVNDCRQIGINCPIVPGIMPINNYKGFLRMTGFCKTKIPSEITAALEPIKDNEEAVRAYGIHLGTEMCRKILAHGIKTLHLYTLNMEKSALAILMNFGLIEESKVSRSLPWRRPANIFRVKEDVRPIFWANRPKSYISRTVGWDQYPHGRWGDSNNPSYGALTDYQFMRPRSRDKKFQEEWATPLKSAADINERFMKFCLGKLRSSPWSELDGLQPETKIIDEQLSQVNLKGFLTINSQPAVNGEKSDSSAVGWGGPGGYVYQKAYLEFFCSKDKLNLIIEKCKTLPSLTYIAVNKEGDSVSNVAPNAVNAVTWGIFPGKEIIQPTVVDPASFMIWKDEAFEIWSRGWARLFPEGDPSRELLEQAQRSYYLVSLVDNDYIHGDIFAAFKDI

SEQ ID NO: 6489 - protein, 528 aa, Pseudoroegneria spicata
ANRMQNMVCVETMMHLTCTNMPVEKIDNALDTIKSNGIQNVLALRGDPPHGQDKFVQVAGGFSCALDLVQHIKAKYGDYFGITVAGYPEAHPEVILGEEGATEEAYSKDLAYLKRKVDAGADVIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDISERFVNFCEGKLKSSPWSELDGLQPETTIIDDQLVKINSKGFLTINSQPAVNAEKSDSPSVGWGGPGGYVYQKAYVEFFCAKEKLDQLIEKSKAFPSLTYIAVNKEGESISNIPANAVNAVTWGVFPGKEIIQPTVVDSASFMVWKDEAFEVWSRGWACLFPEGDSSRELLEQVQKSYYLVSLVDNDYINGDLFAAFKEI

SEQ ID NO: 6490 - protein, 594 aa, Phalaenopsis aphrodite
MKVIEKIREAVDGEGRTVFSFEFFPPRTDEGVENLFERMDRMVAHNPTFCDITWGAGGSTADVTLEIANRMQNMISVETMMHLTCTNMPIEKIDNALDTIKNNGIQNVLALRGDPPHGQDKFVQVEGGFSCALDLVKHIRAKYGDYFGITVAGYPEAHPDMIQENGATLEAYSNDLAYLKKKVDAGADLIITQLFYDTDVFLKFVNDCRQIGISCPIVPGIMPINNYKGFLRMTGFCKTKIPSDITAALDPIKDNEEAVKAYGIHLGTEMCKKILSHGIKTLHLYTLNMEKSALAILMNLGLIEESKVTRSLPWRPPANVFRAKEDVRPIFWANRPRSYILRTSGWDQYPHGRWADSQNPSYGALTDHQFMRPRARDKKLQEEWATPIRSIEDVRERFMSYCLGKLKSSPWSDLDGLQPETKIIDEHLGQINLKGFLTINSQPAVNGVKSASPTVGWGGPGGYVYQKAYIEFFCSSEKLKQLIEKCEAVPSLTYIAVNKEGHSLSNVGTNAVNAVTWGVFPAKQIIQPTVVDPASFMVWKDEAFEIWTRGWAYLFPESDPSRALLEEIQRSYYLVSLVDNDFIHGDLFAAFKDI

SEQ ID NO: 6491 - protein, 594 aa, Eschscholzia californica
MKVIEKIQQAAADDRVVFSFEFFPPKTDDGVENLFERMDRMVAHNPSFCDITWGAGGSTADVTLDIANRMQNMICVETMMHLTCTNMPVEKIDHALTTIKSNGIQNVLALRGDPPHGQDKFVQVEGGLACALDLVKHIREKYGDYFGITVAGYPEAHPDMIQTDGLATPEGYEKDLAYLKKKVDAGADVIVTQLFYDTDNFLKFVNDCRQIGITCPIVPGIMPINNYKGFLRMTGFCKTKIPAEIMAALEPIKDNEEAVKAYGIHLGTEMCKKILAHGIKTLHLYTLNMDKSALAILLNLGLIEESKISRPLPWRRPTNVFRVKEDVRPIFWANRPKSYISRTIGWDQYPHGRWGDSRNPSYGALTDHQFMRPRSRDKKLQEEWGVPLKSVEDIQEKFSKLCLGKVKSSPWSELDGLQAETKIINELLGNINLKGYLTINSQPAVNGEKSDSTTVGWGGPGGYVYQKAYLEFFCSEERLKGLIEKSKGFPSLTYIAVNKEGKSLSNVGPADVNAVTWGVFPAKEIIQPTVVDPASFVVWKDEAFEIWTKVWARMYPEGDSTKSLLESVQNTYFLVSLVDNDYVNGDLFGVFKEL

SEQ ID NO: 6492 - protein, 594 aa, Papaver somniferum
MKVIEKIQEAALNDKVVFSFEFFPPKTDDGVENLFERMDRMVSHNPSFCDITWGAGGSTADLTLDIANRMQNQICVETMMHLTCTNMPVESIDQALNSIKGNGIQNVLALRGDPPHGQDKFVAVEGGFACALDLVRHIKKNYGDFFGITVAGYPEAHPEVIGEDGVASPEAYQKDLAYLKEKVDAGAEVIVTQLFYDTDNFLKFVNDCRQIGIACPIVPGIMPINNYKGFVRMTGFCKTRIPAEIMAALEPIKDNEEAVKAYGIHLGTEMCKKILASGIKTLHLYTLNMDKTALAILQNLGLIEESKISRTLPWKRPTNVFRVKEDVRPIFWANRPKSYISRTRGWEQYPQGRWGDSRSPAYGALTDHQFLRPRSKDKKLQEEWAVPLTSVEDINEKFSKLCLGKLKTSPWSELDGLQPETKIIGEQLGGINSKGFLTINSQPAVNGVKSDSPSVGWGGPGGYVYQKAYLEFFCSKDRLSSLVEKCKAFPSLTYIAVNKAGETLSNVSPADVNAVTWGVFPAKEIIQPTVVDPTSFVVWKDEAFEIWTRGWARMYPEGDSSRTVLESVQSNYFLVSLVDNDYINGDLFGVFKDL

SEQ ID NO: 6493 - protein, 593 aa, Quercus alba
MKVIEKIREAGEEKVVFSFEFFPPKTEDAVDNLFERMERMVAHNPTFCDITWGAGGSTADLTLDIANRMQNMICVESMMHLTCTNMPVEKIDHALQTIKVNGLQNVLALRGDPPKGQDKFVQIEGGFACALDLVKHIRAQYGDYFGITVAGYPEAHPDAIGENGLATLEAYHKDLAYLKQKVDAGADVIITQLFYDTDIYLKFVNDCRQIGITCPIVPGIMPINNYKGFIRMTGFCKTKIPAEIMAALEPIKDNEEAVKAYGIHLGTEMCKKILAHGIKTVHLYTLNMEKSALAILMNLGLIEETKISRSLPWRRPTNVFRVKEDVRPIFWANRPKSYISRTIGWDQYPHGRWGDSCNPSYGALSDYQFMRPRARDKKLLEEWATPLTNVDDIQEKFKKYCLGKLRSSPWSELDGLQPETRIINEQLGKINTKGFLTVNSQPAVNGEKSDSPSVGWGGPGGYVYQKAYVEFFCSREKLDALVAKSKAFPSLTYMAVNKEGNWISNVHQTAVNAVTWGVFPAKEIIQPTVVDPASFMVWKDEAFEIWSRGWASLFPEGDPSRKLLEEVQSSYYLVSLVDNDYIHGDLFAVFADF

SEQ ID NO: 6494 - protein, 593 aa, Aristolochia fimbriata
MKVIEKIRAAEAEGKTVFSFEYFPPKTEDGVENLFERMDRMVAHGPHFCDITWGAGGSTADLTLDIAKRMQNMVCVETMMHLTCTNMPVEKIDHALDTIKANGIQNVLALRGDPPHGQDKFVQVEGGFACALDLVQHIRSKYGDYFGITVAGYPEAHPDMIEGEGATLEAYSNDLAYLKRKVDAGADLIITQLFYDTDIFLKFVNDCRQIGITCPIVPGIMPINNYKGFLRMTGFCKTKVPADIMAALEPIKENEDAVKAYGVHLGTEMCKKILSHGIKTLHLYTLNMEKSALAILKNLGLVDETKISRPLPWRRPANVFRVKEDVRPIFWANRPKSYIARTLGWDQYPRGRWGDSCNPSYGALSDHQFMRPRARDKKLQEEWAVPLKSIEDIRDRFMNICLGKLKTSPWSELDGLQPETKIIDEKLGQINLNGFLTINSQPAVNGEKSDSPTVGWGGPGGYVYQKAYLEFFCSRDKLDSLVSKCSALPAHTFMAVSKEGQCMTNVGPDAVNAVTWGVFPAKEIIQPTVVDPASFVVWKDEAFEIWTKGWANLYPEDDPSRKLLEEVQRSYFLVSLVDNDYINGDIFAVFKDI

SEQ ID NO: 6495 - protein, 595 aa, Platanus occidentalis
MKVIEKIRAASEGEGRVVFSFEYFPPRTEDGVDNLFERMDRMVAHNPSFCDITWGAGGSTADLTLEIANKMQNTICVETMMHLTCTNMPVDKIDHALDTIKFNGIQNVLALRGDPPHGQDKFVQIKGGFACALDLVNHIRDKYGDYFGITVAGYPEAHPDVIQSDGVATLEGYQNDLAYLKRKVDAGADLIVTQLFYDTDIFLKFVNDCRQIGITCPIVPGIMPINNYKGFLRMTGFCKTRIPSEITAALESIKDNEEAVKAYGIHLGTEMCKKILAHGIKTLHLYTLNMEKSALAILMNLGLIEETKIWRSLPWRRPTNVFRVKEDVRPIFWANRPKSYVSRTIGWDQYPSGRWGDSCNPSYGALSDYQFMRPRSRDKKLHEEWAVPLKSVEDINERFINYCLGKLRSSPWSELDGLQPETKIINEQLRNINSKGFLTVNSQPAVNGEKSDSPLVGWGGPGGYVYQKAYLEFFCSQDKLNSLVEKCKAFPSLTYMAVNKEGKWIANIGSSHVNAVTWGVFPAKEITQPTIVDPASFVVWKDEAFEIWTRVWACLFPEGDPSRKLLEEVQNGYFLVSLVENDYIHGDLFAVFQDV

SEQ ID NO: 6496 - protein, 593 aa, Castanea mollissima
MKVIEKIREAGEEKVVFSFEFFPPKTEDAVDNLFERMERMVAHNPAFCDITWGAGGSTADLTLDIANRMQNMICVESMMHLTCTNMPVEKIDHALQTIKVNGLQNVLALRGDPPKGQDKFVQIQGGFACALDLVKHIRAQYGDYFGITVAGYPEAHPDAIGENGLATLEAYHKDLVYLKQKVDAGADVIITQLFYDTDIYLKFVNDCRQIGITCPIVPGIMPINNYKGFIRMTGFCKTKIPAEIMAALEPIKDNEEAVKAYGIHLGTEMCKKILAHGIKTVHLYTLNMEKSALAILMNLGLIEETKISRSLPWRRPTNVFRVKEDVRPIFWANRPKSYISRTIGWDQYPRGRWGDSCNPSYGALSDYQFMRPRARDKKLLEEWVTPLTNVDDIQEKFKKYCLGKLRSSPWSELDGLQPETRIINEQLGKIITKGFLTVNSQPAVNGEKSDSPSVGWGGPGGYVYQKAYVEFFCSREKLDALVDKSKAFPSLTYMAVNKEGKLISNVHQTAVNAVTWGVFPAKEIIQPTVVDPASFMVWKDEAFEIWSRGWASLFPEGDPSRKLLEEVQSSYYLVSLVDNDYIHGDLFAVFAEF

SEQ ID NO: 6497 - protein, 594 aa, Citrus sinensis
MKVIDKIQEKVASDKVVFSFEFFPPKTEDGVENLFERMDRMVAHNPAFCDITWGAGGSTADLTLDIANRMQNTICVETMMHLTCTNMPVEKIDHALQTIKSNGIQNVLALRGDPPHGQDKFVQIQGGFACALDLVKHIRSAYGDYFGITVAGYPEGHPDTIGPDGVASNESYQSDLLYLKKKVDAGADLIITQLFYDTDMFLKFVNDCRQIGITCPIVPGIMPINNYKGFLRMTGFCKTKIPAEITAALEPIKDNEEAVKAYGIHLGAEMCKKILAHGIKTLHLYTLNMEKSALAILLNLGLIEESKISRSLPWRPPTNVFRVKEDVRPIFWANRPKSYLSRTVGWDQYPRGRWGDSRNPSYGALSDHQFMRPRSRDKKLHEEWAVPLKSVEDIYEKFKNYCLGKLRSSPWSELDGLQPETKIINEQLGKINVKGFLTINSQPAVNGERSDSSSVGWGGPGGYVYQKAYLEFFCSPEKLTALVDKSKALPFITFMAVNKEGNWKANVNQTDVNAVTWGVFPAKEIIQPTVVDPASFKVWKDEAFEIWSRSWASLYPEGDSSRKLLEEVQSSYYLVSLVDNDYINGDLFAVFADL

SEQ ID NO: 6498 - protein, 595 aa, Orobanche aegyptiaca
MKVIEKIHEATAANDNRVVFSFEFFPPKTEDGVDNLFERMERMVAHNPTFCDITWGAGGSTADLTLEIANRMQNMVCVETMMHLTCTNMPVEKIDHALTTIKSNGIQNVLALRGDPPHGQDKFVQVEGGFACALDLVKHIRSQYGDYFGITVAGYPEGHPDVIQDGAAPPEAYQNDLAYLKRKVDAGADVIVTQLFYDTDIFLKFVNDCRQIGITCPIVPGIMPINNYKGFIRMTGFCKTKIPPEIMAALDPIKDNEEAVRAYGVHLGTEMCKKIMATGIKTLHLYTLNMEKSALAILMNLGLIEESKISRSLPWRKPANVFRVKEDVRPIFWANRPKSYISRTLGWDQYPQGRWGDSRNASYGALSDYQFMRPRSRDKKLREEWAVPLSNVEDIYENFMKFCLGKLRNSPWSDLDGLHPESKIINEQLGIINSKGFLTINSQPAVNGVKSDSPSVGWGGPGGYVYQKAYLEFFCSPEKLNALVDKCKVFPYLTYMAVNKKGSWISNVNKSDVNAVTWGVFPAKEIIQPTVVDPESFLVWKDEAFELWSRGWANLYPETDPSRKLLEQVESSYYLVSLVDNDYIHGDLFAVFKDI

SEQ ID NO: 6499 - protein, 99 aa, Citrus sinensis
MKVIDKIQEKVASDKVVFSFEFFPPKTEDGVENLFERMDRMVAHNPAFCDITLGGGWLHGRSDSRHREQDAEHDMRRDDDAFDVHEHARREDRSRSSDY

SEQ ID NO: 6500 - protein, 596 aa, Ocimum basilicum
MKVIEKIHEATSANDNRVVFSFEFFPPKTEDGVENLFERMERMVAHNPAFCDITWGAGGSTADLTLEIAKRMQNMVCVETMMHLTCTNMPVEKIDHALTTIKSNGIQNVLALRGDPPHGQDKFVQVEGGFACALDLVKHIRSQYGEYFGITVAGYPEGHPDVIENGVASEEAYQSDLAYLKRKVDAGADLIVTQLFYDTDIFLKFVNDCRQIGINCPIVPGIMPINNYKGFLRMTGFCKTKIPTEIMEALEPIKDNEEAVRAYGIHLGTEMCKKILASGIRTLHLYTLNMEKSALAILANLGLIEESKISRSLPWRRPTNALRVKEDVRPIFWANRPKSYISRTIGWDQYPHGRWGDSRNASYGALTDYQFMRPRSRDKKLQEEWAVPLKSVEDIYERFMSFCLGKLRSSPWTELDGLQPETKIINEQLGNINLKGFLTINSQPAVNGAKSDSPTVGWGGPGGYVYQKAYVEFFCSPERLNALVDKCKLFPYLTYLAVNKEGSLKSNVSNSDINAVTWGVFPAKEIIQPTVVDPASFLVWKDEAFEIWSRGWGNLYPETEVQSRKLIEEVQSKYYLVSLVDNDYIHGDLFAVFKDI

SEQ ID NO: 6501 - protein, 593 aa, Gossypium raimondii
MKVIEKIQSLQEGKVVFSFEFFPPKTEDGVDNLFERMDRMVAHNPSFCDITWGAGGSTADLTLDIANKMQNIICVETMMHLTCTNMPVEKIDHALQTIKSNGIQNVLALRGDPPHGQDKFVQVEGGFSCALDLVKHIRSKYGDYFGITVAGYPEAHPDAIGNDGVATPEAYQNDLAYLKRKVDAGADLIVTQLFYDTDIFLKFVNDCRQIGINCPIVPGIMPINNYKGFLRMTGFCKTKIPAEITAALEAIKDNEEAVKAYGVHLGTEMCRKILAHGVKTLHLYTLNMEKSALAILMNLGLIEESKISRSLPWRRPANVFRVKEDVRPIFWSNRPKSYITRTIGWDQYPYGRWGDSRNPSYGALTDHQFMRPRARDKKLQEEWATPLKSIDDIQEKFKSYCLGKLRSSPWSELDSLQPETKIIHEQLGKINLKGFLTINSQPAVNGERSDSPSVGWGGPGGYVYQKAYLEFFCSKEKLDALVNKCKPLSSITYIAVNKKGNLISNIGTTDVNAVTWGVFPAKEIVQPTVVDPASFMVWKDEAFEIWSRAWAALYPEGDPSKKLLEEVQSSYYLVSLVDNDYIGSDVFAVFGDL

SEQ ID NO: 6502 - protein, 595 aa, Rosa hybrid cultivar
MKVIDKIHEALADEKKVVFSFEFFPPKTEDGVENLLERMDRMVAHNPAFCDITWGAGGSTADLTLDIANKMQNMICVESMMHLTCTNMPVDKIDHALQTIKSNGLQNVLALRGDPPHGQDKFVQIQGGFACALDLVTHIRATYGDYFGITVAGYPEAHPDAIEADGLATPESYQSDLAYLKRKVDAGADLIVTQLFYDTDVFLKFVNDCRQIGITCPIVPGIMPINNYKGFIRMTGFCKTKIPAEVTAALEPIKDNEEAVRAYGIHLGTEMCKKILAHGIRTLHLYTLNMEKSALAILMNLGLIEEAKISRPLPWRRPANVFRVKEDVRPIFWANRPKSYISRTIGWDLYPHGRWGDSRNPSYGALTDYQFMRPRARDKKLVEEWVVPLKSVEDIHEKFEKFCLGKLRSSPWSELDGLQPETKIINEQLGKINTKGFLTINSQPAINGERSDSPSVGWGGPGGYVYQKAYVEFFCSKEKLGTLVDKCKALPSLTYMAVNREGSWISNISQTDVNAVTWGVFPAKEIIQPTVVDPASFMVWKDEAFEIWSRGWGRLYPESDSSRKLLEEVQNSYFLVSLVDNDYIHGDLFTVFANF

SEQ ID NO: 6503 - protein, 594 aa, Chelidonium majus
MKVIEKIQQAAADDRVVFSFEFFPPKTDDGVENLFERMDRMVAHNPSFCDITWGAGGSTAELTLDIAHRMQNMICVETMMHLTCTNMPVEKIDHALEKIKSSGIQNVLALRGDPPHGQDKFVQVEGGFGCALDLVQHMRAKYGDYFGITVAGYPEAHPDMIEANGLASPESYQNDLAYLKKKVDAGAEVIVTQLFYDTDNFFKFVDDCRQIGITIPIVPGIMPINNYKGFLRMTGFCKTKIPSEIMDALEPIKDNEEAVKAYGIHLGTEMCKKILAHGIKTLHLYTLNMDKSALAILLNLGLIEESKISRTLPWRRPTNIFRVKEDVRPIFWANRPKSYISRTIGWDQYPRGRWGDSGNPSYGALTDHQFMRPRSRDKKLNEEWAVPLKSVEDIYEKFSKLCLGKLKTSPWSELDGLQPETKIINEHLGSINLKGYLTINSQPAVNGEKSDSPVVGWGGPGGYVYQKAYLEFFCSGDRLASLVEKCKGFPSLTYIAVNKEGKILSNVGTSAVNAVTWGVFPAKEIIQPTVVDPASFMVWKDEAFEIWTKVWARMYPEGDSSRSVLESVQSSYYLVSLVDNDYIIGDLFGIFKDI

SEQ ID NO: 6504 - protein, 594 aa, Solanum phureja
MKVIEKIQEAAKTDKVIFSFEFFPPKTDDGVENLFERMERMVAHSPSFCDITWGAGGSTADLTLDIVNRMQNMVCVESMMHLTCTNMPVEKIDHALDTIKANGIQNVLALRGDPPHGQDKFVQVEGGFACALDLVKHMRAKYGDYFGITVAGYPEAHPDVIPANGIATKEIYENDLAYLKKKVDAGADVIVTQLFYDTDVFLKFVNDCRQIGINCPIVPGIMPINNYKGFLRMTGFCKTKIPEEIMAALEPIKDNEEAVKAYGIHLGTEMCKKILATGIKTLHLYTLNMEKSALAILMNLGLIEESKISRPLPWRRPANVFRVKEDVRPIFWANRPKSYISRTTGWDEYPHGRWSNAQNPSYGALTDYQFMRARSRDKKLQEEWAVALNSVEDIYEKFKDYCLGKLRSCPWSELDGLQPETKIINEKLGQVNTKGFLTINSQPAVNAEKSDSPSVGWGGPGGYVYQKAYLELFCSQEKLNALVEKCKSFPYLTYMAVNKEGNWISNVNQTDVNAVTWGVFPAKEIIQPTVVDPASFMVWKDEAFEIWSRGWAQLYPETDPSRKLLEQVQNSYFLVSLVDNDYINGDLFSIFKDI

SEQ ID NO: 6505 - protein, 594 aa, Vitis vinifera
MKVIEKIRDAATEEGKVVFSFEFFPPKTEDGVDNLFERMDRMVAHGPAFCDITWGAGGSTADLTLEISNKMQNMICVETMMHLTCTNMPVEKIDHALDTIKSNGIQNVLALRGDPPHGQDKFVQIQGGFACALDLVQHIRAKYGDYFGITVAGYPEAHPDVILNGVATSEAYQSDLAYLKRKVDAGADLIVTQLFYDTDIFLKFVNDCRQIGITCPIVPGIMPINNYKGFLRMTGFCKTKIPSEVTAALEPIKDNDEAVKAYGIHLGTEMCKKILAHGIKTVHLYTLNMEKSALAILMNLGLIEESKISRPFPWRRPTNVFRVKEDVRPIFWANRPRSYISRTIGWDQYPHGRWSDSCNPSYGGLTDYQFMRPRARDKKLQDEWVVPLKSIEDVQERFIKFCLGKLKSSPWSELDGLQPESKIINELLGNINSKGFLTINSQPAVNGEKSDSLSVGWGGPGGYVYQKAYLEFFCSREKLNALVDKCKGHTSLTYMAVNKEGTWMSNVGPGEVNAVTWGVFPAREIIQPTVVDPSSFMVWKDEAFEIWSRGWALLYPEDDPSRKLLEEVQNSHFLVSLVDNDYINGDLFAIFMEF

SEQ ID NO: 6506 - protein, 593 aa, Gossypium hirsutum
MKVIEKIQSLQEGKVVFSFEFFPPKTEDGVDNLFERMDRMVAHNPSFCDITWGAGGSTADLTLDIANKMQNIICVETMMHLTCTNMPVEKIDHALQTIKSNGIQNVLALRGDPPHGQDKFVQVEGGFSCALDLVKHIRSKYGDYFGITVAGYPEAHPDAIGNDGVATPEAYQNELAYLKRKVDAGADLIVTQLFYDTDIFLKFVNDCRQIGINCPIVPGIMPINNYKGFLRMTGFCKTKIPAEITAALEAIKDNEEAVKAYGVHLGTEMCRKILAHGVKTLHLYTLNMEKSALAILMNLGLIEESKISRSLPWRRPANVFRVKEDVRPIFWSNRPKSYITRTIGWDQYPYGRWGDSRNPSYGALTDHQFMRPRARDKKLQEEWASPLKSIDDIQEKFKSYCLGKLRSSPWSELDSLQPETKIIHEQLGKINLKGFLTINSQPAVNGERSDSPSVGWGGPGGYVYQKAYLEFFCSKEKLDALVNKCKPLSSITYIAVNKKGNLISNIGTTDVNAVTWGVFPAKEIVQPTVVDPASFMVWKDEAFEIWSRAWAALYPEGDPSKKLLEEVQSSYYLVSLVDNDYIGSDVFAVFGDL

SEQ ID NO: 6507 - protein, 579 aa, Olea europaea
MKVIEKIRDAAANDANRVVFSFEFFPPKTEDGVDNLFERMERMVVHNPSFCDITWGAGGSTADLTLEISNRMQNMVCVETMMHLTCTNMPVEKIDNALSTIKSKGIQNVLALRGDPPHGQDKFVKVEGGFACALDLVKHIRAQYGDYFGITVAGYPEGHPDVIQNGVVTEEAYENELAYLKKKVDAGGEVIITQLFYDTDIFLKFVNDCRQIGITCPIVPGIMPINNYKGFIRMTGFCKTKIPDEITAALDPIKDNEEAVKAYGIHLGTEMCKKILASGIKTLHLYTLNMEKSALAILMNLGLIEESKISRSLPWRRPTNIFRVKEDVRPIFWANRPKSYISRTIGWEQYPNGRWGDSRNASYGALTDYQFMRPRSRDKKLHEEWVVPLKNVTDIYEKFMKFCLGKLRSSPWSELDGLQPETKIINEQLGNINLKGFLTINSQPAVNGAKSDSPTVGWGGPGGYVYQKAYLEFFCSPQKLNALVEKCKSFPLLTYMAVNKDGTWFSNVNQTDVNAVTWGVFPAKEIIQPTIVDPASFIVWKDEAFETWSKGWAKLYPEGDPSAKLLEEVQRNLFFGQLG

SEQ ID NO: 6508 - protein, 595 aa, Malus domestica
MKVIEKIQESLVDEKKVVFSFEFFPPKTEDGVENLLERMDRMVAHGPAFCDITWGAGGSTADLTLDIANKMQNLICVESMMHLTCTNMPVDKIDHALQTIKSNGLQNVLALRGDPPHGQDKFVQIQGGFACALDLVTHIRAKYGDYFGVTVAGYPEAHPDAIAADGLASPEAYQSDLAYLKRKVDAGADFIVTQLFYDTDIFLKFVNDCRQIGITCPIVPGIMPINNYKGFIRMTGFCKTKIPAEVTAALEPIKDNEEAVRLYGIHLGTEMCKKILASGIRTLHLYTLNMEKSALAILQNLGLIEESKISRPLPWRRPANVFRVKEDVRPIFWANRPKSYISRTIGWELYPHGRWGDSGNPSYGALTDYQFMRPRARDKKLVEEWVVPLKSVEDICEKFKKFCLGKLKSSPWSELDGLQPETGIINESLGKINTKGFLTINSQPAVNGERSDSLSVGWGGPGGYVYQKAYLEFFCSKEKLDALVEKCKALPSLTYMAVNKDGSWVSNTGQTAVNAVTWGVFRAREIIQPTVVDPASFIVWKDEAFEIWSRGWARLYPEGDSSRKLLEEVQSSYYLVSLVDNDYIHGDVFAVFADV

SEQ ID NO: 6509 - protein, 594 aa, Citrus clementina
MKVIDKIQEKVASDKVVFSFEFFPPKTEDGVENLFERMDRMVAHNPAFCDITWGAGGSTADLTLDIANRMQNTICVETMMHLTCTNMPVEKIDHALQTIKSNGIQNVLALRGDPPHGQDKFVQIQGGFACALDLVKHIRSAYGDYFGITVAGYPEGHPDTIGPDGVASNESYQSDLLYLKKKVDAGADLIITQLFYDTDMFLKFVNDCRQIGITCPIVPGIMPINNYKGFLRMTGFCKTKIPAEITAALEPIKDNEEAVKAYGIHLGAEMCKKILAHGIKTVHLYTLNMEKSALAILLNLGLIEESKISRSLPWRPPTNVFRVKEDVRPIFWANRPKSYLSRTVGWDQYPRGRWGDSRNPSYGALSDHQFMRPRSRDKKLHEEWAVPLKSVEDIYEKFKNYCLGKLRSSPWSELDGLQPETKIINEQLGKINVKGFLTINSQPAVNGERSDSSSVGWGGPGGYVYQKAYLEFFCSPEKLTALVDKSKVLPFITFMAVNKEGNWKANVNQTDVNAVTWGVFPAKEIIQPTVVDPASFKVWKDEAFEIWSRSWASLYPEGDSSRKLLEEVQSSYYLVSLVDNDYINGDLFTVFADL

SEQ ID NO: 6510 - protein, 593 aa, Gossypium hirsutum
MKVIEKIQSLQEGKVVFSFEFFPPKTEDGVDNLFERMDRMVAHNPSFCDITWGAGGSTADLTLDIANKMQNIICVETMMHLTCTNMPVEKIDHALQTIKSNGIQNVLALRGDPPHGQDKFVQVEGGFSCALDLVKHIRSKYGDYFGITVAGYPEAHPDAIGNDGVATPEAYQNDLAYLKRKVDAGADLIVTQLFYDTDIFIKFVNDCRQIGINCPIVPGIMPINNYKGFLRMTGFCKTKIPAEITAALEAIKDNEEAVKAYGVHLGTEMCRKILAHGVKTLHLYTLNMEKSALAILMNLGLIEESKISRSLPWRRPANVFRVKEDVRPIFWSNRPKSYITRTIGWDQYPYGRWGDSRNPSYGALTDHQFMRPRARDKKLQEEWATPLKSIDDIQEKFKSFCLGKLRSSPWSELDSLQPETKIIHEQLGKINLKGFLTINSQPAVNGERSDSLSVGWGGPGGYVYQKAYLEFFCSKEKLDALVNKCKPLSSITYIAVNKKGNLISNIGTTDVNAVTWGVFPAKEIVQPTVVDPASFMVWKDEAFEIWSRAWAALYPEGDPSKKLLEEVQSSYYLVSLVDNDYIGSDVFAVFGDL

SEQ ID NO: 6511 - protein, 66 aa, Fagus grandifolia
MKVIEKIREADEGKVVFSFEFLPPKDRRCSRQPLRENGAHGCSQPFILRYHMGSWWLHCRSHSRHR

SEQ ID NO: 6512 - protein, 596 aa, Arachis hypogaea
MKVIEKIRAAAAADPDRVVFSFEFFPPKTEDGVDNLFERMDRMVAHNPSFCDITWGAGGSTADLTLEIANKMQNMVCVETMMHLTCTNMPVEKIDHALQTIKSNGLQNVLALRGDPPHGQDKFVQIEGGFACARDLVKHIRAKYGDYFGITVAGYPEAHPDVIGSDGLATPEGYQNDLAYLKSKVDAGADLIVTQLFYDTDIFLKFVNDCRQIGITCPIVPGIMPINNYKGFLRMTGFCKTKIPADIFAALEPIKDNEEAVKSYGIHLGTEMCKKILAHGIKTLHMYTLNMEKSALAILMNLGLIEETKINRSLPWRRPANVFRVREDVRPIFWANRPKSYISRTIGWDQYPHGRWGDSRNPSYGALTDYQFMRPRARDKKLVEEWVVPLRSIEDIYERFKQYCLGKLRSNPWSELDGLQPETRIINEQLEKINLKGFLTINSQPAVNGEKSDSPTVGWGGPGGYVYQKAYVEFFCSKEKLDALVEKCKNRSSLTFMAVNKEGSWRSNVGQTDVNAVTWGVFPAKEIIQPTIVDPVSFMVWKDEAFEIWSRGWACLYPEGDASRKLVEEVGNSYFLVSLVDNDYVNGDLFAVFADF

SEQ ID NO: 6513 - protein, 594 aa, Petunia hybrida
MKVIEKIQEAEKNDRIVFSFEFFPPKTEDGVDNLFERMERMVSYNPSFCDITWGAGGSTADLTLEIANRMQNMVCVETMMHLTCTNMQVDKIDHALQTIKSYGIQNVLALRGDPPHGQDKFVQVDGGFACALDLVKHMRAKYGDYFGITVAGYPEAHPDVIPANGIATQETYENDLDYLKRKVDAGADLIVTQLFYDTDIFLKFVNDCRQMGITVPIVPGIMPINNYKGFLRMTGFCKTKIPEEIMAALEPIKDNEEAVKAYGIHLGTEMCKKILASGIKTVHLYTLNMEKSALAILMNLGLIEESKISRPLPWRRPTNVFRVKEDVRPIFWANRPKSYISRTIGWDEYPHGRWGNAQNPSYGALSDYQFMRPRSRDKKLQEEWAVALNSVEDINEKFLNYCLGKLRSCPWSELDGLQPETKIINEQLGSINTKGFLTINSQPAVNAAKSDAPSIGWGGAGGYVYQKAYLEFFCSGEKLNTLVEKCKAYPYLTYMAVNKERNWISNVNQTDVNAVTWGVFPAKEIIQPTVVDPASFMVWKDEAFEIWSRGWAQLYPETDPSRKLLEQVQNSYFLVCLVDNDYVNGDLFSIFKDI

SEQ ID NO: 6514 - protein, 593 aa, Gossypium hirsutum
MKVIEKIQSLQEGKVVFSFEFFPPKTEDGVDNLFDRMDRMVAHNPSFCDITWGAGGSTADLTLDIANKMQNIICVETMMHLTCTNMPVEKIDHALQTIKSNGIQNVLALRGDPPHGQDKFVQVEGGFSCALDLVKHIRSKYGDYFGITVAGYPEAHPDAIGNDGVATPEAYQNDLAYLKRKVDAGADLIVTQLFYDTDIFIKFVNDCRQMGINCPIVPGIMPINNYKGFLRMTGFCKTKIPAEITAALEAIKDNEEAVKAYGVHLGTEMCRKILAHGIKTLHLYTLNMEKSALAILMNLGLIEESKISRSLPWRRPANVFRVKEDVRPIFWSNRPKSYITRTIGWDQFPHGRWGDSRNPSYGALTDHQFMRRRARDKKLQEEWATPLKSIDDIQEKFKSFCLGKLRSSPWSELDSLQPETKIIHEQLGKINLKGFLTINSQPAVNGERSDSLSVGWGGPGGYVYQKAYLEFFCSKEKLDALVNKCKPLSSITYIAVNKKGNLISNIGTTDVNAVTWGVFPAKEIIQPTVVDPASFMVWKDEAFEIWSRAWAALYPEGDLSKKLLEEVQSSYYLVSLVDNDYIGSDVFAVFGDL

SEQ ID NO: 6515 - protein, 595 aa, Prunus persica
MKVIEKIQEALLEEKKVLFSFEFFPPKTEDGVENLLERMERMVAHNPAFCDITWGAGGSTADLTLDIANKMQNIICVESMMHLTCTNMPVDKIDHALQTIKSNGLQNVLALRGDPPHGQDKFVQIQGGFACALDLVTHIRAKYGDYFGVTVAGYPEAHPDAIGTDGLASPEAYQSDLAYLKRKVDAGADLIITQLFYDTDVFLKFVHDCRQIGITCPIVPGIMPINNYKGFIRMTGFCKTKIPAEVTAALEPIKDNEEAVKSYGIHLGTEMCKKILAHGIRTLHLYTLNMEKSALAILMNLGLIEETKISRPLPWRRPANVFRVKEDVRPIFWANRPKSYISRTIGWDLYPHGRWGDSRNPSYGALTDYQFMRPRARDKKLVEEWVVPLRSVEDIHEKFKKFCLGKLRSSPWSELDGLQPETKIINELLGKINTKGFLTINSQPAVNGERSDSTSVGWGGPGGYVYQKAYLEFFCSKEKLNALVEKCKALPSLTYMAVNKDGRWISNIGQTDVNAVTWGVFPAREIIQPTVVDPASFMVWKDEAFEIWSRGWACLYPEGDSSRKLLEEVQNSYFLASLVDNDYIQGDVFAVFADF

SEQ ID NO: 6516 - protein, 595 aa, Glycine max
MKIIEKIRAASADPNRVVFSFEFFPPKTEDGVDNLFERMDRMVAHNPSFCDITWGAGGTTADLTLEIANKMQNIVCVETMMHLTCTNMPVEKIDHALHTIKSNGLQNVLALRGDPPHGQDKFVQVEGGFACARDLVQHIRAKYGDYFGITIAGYPEAHPDVIESDGLATPEGYRNDLAYLKSKVDAGADLIVTQLFYDTDIFLKFVNDCRQIGITCPIVPGIMPINNYKGFIRMTGFCKTKIPADIMAALEPIKDNEEAVKAYGIHLGTEMCKKILAHGIKTLHLYTLNMEKSALAILMNLGLIEESKVSRSLPWRRPANVFRVKEDVRPIFWANRPKSYISRTIGWDQYPHGRWGDSCNPSYGALSDYQFMRPRARDKKLVEEWAVPLKSVEDIYERFRLYCLGKLRSNPWSELDGLQPETKIINEQLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEDEASRKLVEEVGGSHFLVSLVDNDYINGDLFAVFADF

SEQ ID NO: 6517 - protein, 595 aa, Glycine max
MKIIEKIHAASADPNRVVFSFEFFPPKTEDGVDNLFERMDRMVVHNPSFCDITWGAGGTTADLTLEIANKMQNIVCVETMMHLTCTNMPVEKIDHALHTIKSNGLQNVLALRGDPPHGQDKFVQVEGGFACARDLVQHIRAKYGDYFGITVAGYPEAHPDVIESDGLATSEGYQNDLAYLKSKVDAGADLIVTQLFYDTDIFLKFVNDCRQIGITCPIVPGIMPINNYKGFIRMTGFCKTKIPADIMAALEPIKDNEEAVKAYGIHLGTEMCKKILAHGINTLHLYTLNMEKSALAILMNLGLIEETKVSRSLPWRRPANVFRVKEDVRPIFWANRPKSYISRTIGWDQYPHGRWGDSCNPSYGALSDYQFMRPRARDKKLVEEWAVPLKSIEDIYERFRLYCLGKLRSNPWSELDGLQPETKIINELLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEGDASRKLVEEVGGSYFLVSLVDNDYINGDLFTVFADF

SEQ ID NO: 6518 - protein, 594 aa, Solanum lycopersicum
MKVIEKIQEAAKTDKVIFSFEFFPPKTDDGVENLFERMERMVAHGPSFCDITWGAGGSTADLTLEIVNRMQNMVCVESMMHLTCTNMPVEKIDHALDTIKANGIQNVLALRGDPPHGQDKFVQVEGGFACALDLVKHMRAKYGDYFGITVAGYPEAHPDVIPANGIATKEIYENDLAYLKKKVDAGADVIVTQLFYDTDIFLKFVNDCRQIGINCPIVPGIMPINNYKGFLRMTGFCKTKIPDEIMAALEPIKDNEEAVKAYGIHLGTEMCKKILATGIKTLHLYTLNMEKSALAILMNLGLIEESKISRPLPWRRPANIFRVKEDVRPIFWANRPKSYISRTTGWDEYPHGRWSNAQNPSYGALTDYQFMRARSRDKKLQEEWAAALNSVEDIYEKFKDYCLGKLRSCPWSELDGLQPETKIINEKLGQVNTKGFLTINSQPAVNAEKSDSPSVGWGGPGGYVYQKAYLEFFCSQEKLNALVEKCKSFPYLTYMAVNKEGNWISNVNQTDINAVTWGVFPAKEIIQPTVVDPASFMIWKDEAFEIWSRGWAQLYPETDPSRKLLEQVQNSYFLVSLVDNDYINGDLFSIFKDI

SEQ ID NO: 6519 - protein, 595 aa, Zostera marina
MKVIEKIREAVEGNGQTVFSFEYFPPKTEEGVENLFERMDRMVKHNPTFCDITWGAGGSTADVTLEIANRMQNMVCVETMMHLTCTNMPVEKIDHALTTIKNNGIQNVLALRGDPPHGQDKFVQVEGGFACALDLVKHMRAQYGDYFGITVAGYPEAHPDQIQGECAAHDAYQNDLVYLKQKVDAGADVIVTQLFYDTDIFLKFVDDCRQIGITCPIVPGIMPINNYRGFIRMTGFCKTKIPAELTAALEPIKDNEEAVRAYGIHFGTEMCKKILASGIKTLHLYTLNMEKSALAILTNLGLIEESKITRSLPWRPPTNVFRVKEDVRPIFWANRPKSYISRTVGWEQYPRGRWSDSKNPSYGALTDHQFLRPRSRDKKLQKDWAVPLKCVEDIYERFANFCLGILSSSPWSDLEGLQPESKIIDAQLGMINQKGFLSINSQPSVNGEKSDSPSIGWGGSGGYVYQKAYLEFFCSEEKLKSLVEKCKSIPSLTFTAVNKDGKSITNIGDPSEVNAVTWGVFPGKEIIQPTVVDPDSFMVWKDEAFELWTKAWACLFPDGDLSKQLLEQVQKTYFLVSLVDNDYVHGDIFAVFKDL

SEQ ID NO: 6520 - protein, 594 aa, Capsicum annuum
MKVIEKIQEAIKNDKVIFSFEFFPPKTEDGVENLFERMERMVTHGPSFCDITWGAGGSTADLTLEIVKRMQNMVCVESMMHLTCTNMPVEKIDQALDTIKSDGIQNVLALRGDPPHGQDKFVQVEGGFACALDLVKHMRAKYGDYFGITVAGYPEAHPDVIPANGIATKEIYENDLAYLKKKVDAGADLIITQLFYDTDIFLKFVNDCRQIGINCPIVPGIMPINNYKGFLRMTGFCKTKIPEEIMAALEPIKDNEEAVKAYGIHLGTEMCKKILANGIKQLHLYTLNMEKSALAILMNLGLIEETKISRPLPWRRPANVFRVKEDVRPIFWANRPKSYISRTIGWDEYPHGRWSNAQNPSYGALTDYQFMRARSRDKKLQEEWAVALNSVEDIYERFKDYCLGKLRSCPWSELEGLQPETKIINEKLGHVNTKGFLTINSQPAVNAEKSDSPSVGWGGPGGYVYQKAYLEFFCSQEKLNALVEKCKSFPYLTYMAVNKEGNWISNVNQTDVNAVTWGVFPAKEIIQPTVVDPASFMVWKDEAFEIWSRGWAQLYPEADPSRKVLQQVQNSYFLVSLVDNDYINGDLFSIFKDI

SEQ ID NO: 6521 - protein, 595 aa, Cannabis sativa
MKVIDKIRCEANNDNVVFSFEFFPPKTEEGVENLFERMERMVAHNPAFCDITWGAGGSTADLTLDIANRMQNTVCVESMMHLTCTNMPLDKIDHALSTIKSNGLQNVLALRGDPPHGQDKFVQIQGGFACALDLVKHIRAKYGDYFGITVAGYPEAHPDAIGPDGLASPEAYQVDLAYLKSKVDAGADLIVTQLFYDTDIFLKFVNDCRQIGINCPIVPGIMPINNYKGFIRMTGFCKTRIPSEVTAALEPIKDNDEAVRAYGIHLGTEMCKKILGSGIKTLHLYTLNMEKSALAILTNLGLIEERKISRPLPWRRPANVFRVKEDVRPIFWANRPKSYISRTTGWDQYPQGRWGDSRNPAYGALTDYQFMRPRSRDKKLVEEWSIPLKSVEDIHEQFKKLCLGKLKSSPWSELDGLQPETKIINEQLVKINGKGFLTVNSQPAVNGERSDSPVVGWGGPGGYVYQKAYLEFFCTKDLLDALVEKCSRGFSSFTYMAVNKQGHWLANVDQTFVNAVTWGVFPGKEIIQPTVVDPASFTVWKDEAFEIWSRGWARLYPEVDPSRKVLEEVENSYFLVSLVDNDYIHGDLFAVFNEF

SEQ ID NO: 6522 - protein, 595 aa, Lippia dulcis
MKVIEKIQEAAAANDDRVVFSFEFFPPKTEDGVDNLFERMDRMVAHNPSFCDITWGAGGSTADLTLEIANRMQNMVCVETMMHLTCTNMPVEKIDHALETIKSNGIQNVLALRGDPPHGQDKFVQVEGGFACALDLVQHIRSQYNDYFGITVAGYPEAHPDVIQDGVAPPEAYASDLAYLKKKIDAGGEVIITQLFYDTDIFLKFVDDCRQIGITCPIVPGIMPINNYKGFLRMTGFCKTKIPAEIMAALDPIKDNEEAVRAYGIHLGTEMCKKIIASGIKTIHLYTLNMEKSALAILMNLGLIEESKISRPLPWRRPTNIFRVKEDVRPIFWANRPKSYISRTVGWEQYPRGRWGDSKTASYGALTDYQFMRPRSRSKKLNEEWATPLKSVDDIYEKFTSFCLGRLKTSPWSELDGLQPETRIINEQLGSINLKGFLTINSQPAVNGAKSDSPSVGWGGPGGYVYQKAYLEFFCSAEKLNALVEKSKLFPLLTYMAVNKEGSLVSNVSQTDVNAVTWGVFPAKEIIQPTVVDPASFVVWKDEAFEIWSRGWAKLYPESDPSRKLLEEVGSSYYLVSLVDNDYVQGDLFAVFKDL

SEQ ID NO: 6523 - protein, 605 aa, Populus trichocarpa
MKVIDKIRAAAAAGDSNGGDSSSNNKVVFSFEFFPPKTDDGVDNLFERMDRMVSHNPSFCDITWGAGGSTADLTLDIANKMQNIICVETMMHLTCTNMPVEKIDHALETIKSNGIQNVLALRGDPPHGQDKFVQIQGGLACALDLVKHIRSKYGDYFGITVAGYPEAHPDVIGSDGFATLEDYHKDLAYLKQKVDAGADLIVTQLFYDTDIFLKFVNDCRQIGINCPIVPGIMPINNYKGFIRMAGFCKTKIPAEVTAALEPIKDNEEAVRAYGIHLGTEMCKKILAHGIKTLHLYTLNMEKSALAILMNLGLIEESKITRPLPWRPPTNVFRVKEDVRPIFWANRPKSYLTRTIGWDQYPHGRWGDSRNPSYGALSDYQFMRPRARGKKLLEEWAAPLKSVEDIYEKFKVYCLGKLKSSPWSELDGLQPETKIINEQLGKINLKGFLTINSQPAVNGEKSDSPSVGWGGPGGYVYQKAYLEFFCSKDKLNALVDKCKSFPFVTYIAVNKGGSWISNVALTDVNAVTWGVFPGKEIIQPTVVDPTSFSVWKDEAFEIWSRGWASLYPEGDPSRTLLEEVQSSYFLVSLVDNDYIHGDIFAVFADL

SEQ ID NO: 6524 - protein, 595 aa, Fragaria vesca
MKVIDKILEASADEKKVVFSFEFFPPKTEDGVENLLERMDRMVAHNPAFCDITWGAGGSTADLTLDIANKMQNVICVESMMHLTCTNMPVDKIDHALQTIKSNGLQNVLALRGDPPHGQDKFVQIQGGFACALDLVTHIRATYGDYFGITVAGYPEAHPDAIEANGLATPESYQSDLAYLKRKVDAGADLIVTQLFYDTDVFLKFVNDCRQIGITCPIVPGIMPINNYKGFIRMTGFCKTRIPAEVTAALEPIKDNEEAVRAYGIHLGTEMCKKILAHGIRTLHLYTLNMEKSALAILMNLGLIEEAKISRPLPWRRPANVFRVKEDVRPIFWANRPKSYISRTIGWDLYPHGRWGDSRNPSYGALTDYQFMRPRARDKKLVEEWVVPLKNVEDIHEKFEKFCLGKLRSSPWSELDGLQPETKIINEKLGKINTKGFLTINSQPAINGERSDSPTVGWGGPGGYVYQKAYVEFFCSKEKLGTLVDKCKALPSLTYMAVNREGSWISNIGQTDVNAVTWGVFPAKEIIQPTVVDPASFMVWKDEAFEIWSRGWSRLYPEGDSSRKLLEEVQNSYFLVSLVDNDYINGDLFTVFADS

SEQ ID NO: 6525 - protein, 594 aa, Amborella trichopoda
MKVIEKIREAAKEDRTVFSFEFFPPKTEDGVENLFERMERMASHNPSFCDITWGAGGSTADLTLDISNKMQNMICVETMMHLTCTNMPVEKIDHALDTIKQNGIQNVLALRGDPPHGQDKFVQVAGGFACGLDLVAHIRAKYGDYFGITVAGYPEAHPDMISSEGGVTLENYLSDLAYLKRKVDAGADLIVTQLFYDTDIFLKFVHDCRQIGITCPIVPGIMPINNYKGFVRMTGFCKTKIPDEITKALEPIKDNEEAVRAYGVHLGTEMCKKILSHGIKTLHLYTLNMEKSALAILMNLGLIDESKISRPFPWRRPANVFRVKEDVRPIFWANRPKSYLSRTLGWEQYPHGRWGDSCNPSYGALTDYQFMRRRSRNKKILEEWAVPLKSVEDVKEKFTNYCLGKVKSHPWSELDGLQPETLMINEKLGQVNSKGFFTINSQPAVNGEKSDSPSVGWGGPGGYVYQKAYLEFFCSKEKLDALVENCKGLPSVTYIAVNKQGERVSNVGPIAVNAVTWGVFPAKEVLQPTVVDPVSFMVWKDEAFEIWNKGWGVLYPEGDPSKQILNEVQNSYFLVSLVDNDYVHGDLYAMFSDI

SEQ ID NO: 6526 - protein, 593 aa, Cajanus cajan
MKVIDKIHSADPNRVVFSFEFFPPKTEDGVDNLFERMERMVAHNPSFCDITWGAGGSTADLTLEIANKMQNIVCVETMMHLTCTNMPVEKIDHALHTIKSNGLQNVLALRGDPPHGQDKFVQVEGGFACARDLVKHIRAKYGDYFGITVAGYPEAHPDVIESNGLASPEGYQNDLAYLKSKVDAGADLIVTQLFYDTDIFLKFVNDCRQIGITCPIVPGIMPINNYKGFLRMTGFCKTKIPAEIMAALEPIKDNEEAVKSYGVHLGTEMCKKILAHGIKTVHLYTLNMEKSALAILMNLGLIEETKISRALPWRRPANVFRVKEDVRPIFWANRPKSYISRTIGWDQYPHGRWGYSCNPSYGALTDYQFMRPRSRDKKLIEEWAVPLKSVEDIYERFRLYCLGKLRSNPWSELDGLQPETKIINELLEKINMKGFLTINSQPAVNGEKSDSHTVGWGGPGGYVYQKAYVEFFCSKEKLDALVDKCKDRTSLTYMAVNKEGSWKSNAGQADVNAVTWGVFPAKEIIQPTIVDPVSFNVWKDEAFEIWSRGWACLYPEGDASRKLVEEVGGSYFLVSLVDNDYINGDLFAVFADF

SEQ ID NO: 6527 - protein, 596 aa, Euonymus alatus
MKVIDKIRAGTEGGEGKVVFSFEYFPPKTEDGVDNLFDRMDRMVAHNPTFCDITWGAGGSTADLTLDIANKMQNVICVETMMHLTCTNMPVDKIDHALTTIKSNGIQNVLALRGDPPHGQDKFVQIEGGFSCALDLVKHIRSAYGDYFGITVAGYPEAHPDAIGPDGVATLESYTNDLTYLKKKVDAGADLIVTQLFYDTDIFLKFVSDCRQIGITCPIVPGIMPINNYKGFLRMTGFCKTKIPAEVTAALEPIKDNEEAVKAYGIHLGTEMCKKILAHGIKTVHIYTLNMEKSALAILMNLGVIEESKVSRPLPWRPPTNVFRVKEDVRPIFWANRPKSYLSRTLGWDQYPHGRWGDSGNPSYGALTDYQFMRPRSRDKKLHEEWAVPLKSIDDIYEKFKQFCLGKLRSSPWTELDGLQPETKIINEQLGKINLKGFLTINSQPAVNGERSDSATVGWGGPGGYVYQKAYLEFFCSKEKLNLLVEKCKAFPSITFVAANKAGVWISNTSKSDVNAVTWGVFPAKEIIQPTVVDPASFMVWKDEAFEIWSRGWAIVYPEGDLSRKLLEEVQSSYFLVSLVDNDYINGDIFAAFADF

SEQ ID NO: 6528 - protein, 354 aa, Papaver somniferum
ALNDKVVFSFEFFPPKTDDGVENLFERMDRMVSHNPSFCDITWGAGGSTADLTLDIANRMQNQICVETMMHLTCTNMPVESIDQALNSIKGNGIQNVLALRGDPPHGQDKFVAVEGGFACALDLVRHIKKNYGDFFGITVAGYPEAHPEVIGEDGVASPEAYQKDLAYLKEKVDAGAEVIVTQLFYDTDNFLKFVNDCRQIGIACPIVPGIMPINNYKGFVRMTGFCKTRIPAEIMAALEPIKDNEEAVKAYGIHLGTEMCKKILASGIKTLHLYTLNMDKTALAILQNLGLIEESKISRTLPWKRPTNVFRVKEDVRPIFWANRPKSYISRTRGWEQYPQGRWGDSRSPLMVR

SEQ ID NO: 6529 - protein, 594 aa, Catharanthus roseus
MKVIEKINDAIAADKVVFSFEFFPPKTEDGVENLFERMDRMVAHNPSFCDITWGAGGSTADLTLEIANRMQNMVCVETMMHLTCTNMPVEKIDHALDSIKSNGIQNVLALRGDPPHGQDKFVQVEGGFACALDLVRHIRKKYGDYFGITVAGYPEAHPDVIPDNGVAPLDAYQSDLAYLKRKVDAGADLIVTQLFYDTDIFLKFVNDCRQIGIDCPIVPGIMPINNYKGFLRMTGFCKTKIPAEIMAALEPIKDNEEAVRNYGIHLGTEMCKRILASGIKTLHLYTLNMEKSALAILMNLGLIEESKVSRPLPWRRPTNVNRSKEDVRPIFWANRPKSYISRTLGWEQYPRGRWGDSRSAQYGALSDYQFMRPRARDKRLHEEWVVPLKNTEDIYEKFRQYCLGKLRSCPWSDLDGLQPETKIINEHLGNVNLKGFLTINSQPAVNGAKSDSPSVGWGGPGGYVYQKAYLEFFCSKEKLNAVVEKAKAYPSLTYMAVNKGGDWISNITSTDVNAVTWGVFPAKEIIQPTVVDPASFAVWKDEAFEIWSRGWAQLYPEADPSRKLLEEVQNSYYLVSLVDNDYVSGDIFAAFKDI

SEQ ID NO: 6530 - protein, 595 aa, Gossypium hirsutum
MKVIDKIQSFSQDQGKVVFSFEFFPPKTEDGVDNLFERMDRMVAHNPSFCDITWGAGGSTADLTLDIANKMQNMICVETMMHLTCTNMPVEKIDHALETIKSNGIQNVLALRGDPPHGQDKFVQVEGGFSCALDLVKHIRAKYGDFFGITVAGYPEAHPDAIGSNGVATPEAYQSDLAYLKKKVDAGADLIVTQLFYDTDIFLKFVNDCRQIGITCPIVPGIMPINNYKGFVRMTGFCKTKIPDEVTAALEPIKDNDEAVKSYGIHLGTEMCRKILAHGIKTLHLYTLNMEKSALAILMNLGLIEESKISRSLPWRRPANVFRVKEDVRPIFWANRPKSYLSRTIGWDQYPQGRWGDSRNPSYGALSDYQFMRPRARDKKLQEEWATPLKSIDDIQEKFKNHCLGKLRSSPWSELDGLQPETKIIHEQLGKINLKGFLTINSQPAVNGERSDSPSVGWGGPGGYVYQKAYLEFFCSLDKLDVLVKKCNSFSSLTYVAVNKKGNLLSNIGLTDVNAVTWGVFPAKEIIQPTVVDPASFVVWKDEAFEIWSRSWSTLYPDGDPSKNLLEEIQSSYYLVSLVDNNYMDGNIFGVFEDL

SEQ ID NO: 6531 - protein, 608 aa, Populus trichocarpa
MKVIDKIREAAGGGGDANGNGGDNSSSNKVVFSFEFFPPKTEDGVDNLFERMDRMVAHNPSFCDITWGAGGSTADLTLDIANKMQNIICVETMMHLTCTNMPVEKIDHALETIKSNGIQNVLALRGDPPHGQDKFVQIQGGFACALDLVKHIRSKYGDYFGITVAGYPEAHPDAIGSDGFATPEDYQKDLAYLKQKVDAGADLIVTQLFYDTDIFLKFVNDCRQIGITCPIVPGIMPINNYKGFLRMTGFCKTKIPAEVTAALEPIKDNEEAVRAYGIHLGTEMCKKILAHGIKTLHLYTLNMEKSALAILMNLGLIEESKITRALPWRPPTNVFRAKEDVRPIFWANRPKSYLSRTIGWDQYPHGRWGDSHNPSYGALSDYQFMRPRARGKKLFEEWASPLKSVEDIYEKFKVYCLGKLKSSPWSELEGLQPETKIINEQLGRINLKGFLTINSQPAVNAEKSDSPSVGWGGPGGYVYQKAYLEFFCSKEKLNALVERCKAFPLVTYMAVNRGGSWISNVALTDVNAVTWGVFPAKEIIQPTVVDPTSFSVWKDEAFEIWSRGWASLYPEGDPSRTLLEEVQNSYFLVSLVDNDYIHGDIFAVFAEL

SEQ ID NO: 6532 - protein, 594 aa, Tabernaemontana elegans
MKVIEKINDAIATDKVVFSFEFFPPKTEDGVENLFERMDRMVAHNPSFCDITWGAGGSTADLTLEIANRMQNMVCVETMMHLTCTNMPVEKIDHALDTIKSNGLQNVLALRGDPPHGQDKFVQVEGGFACALDLVRHIRKKYGDYFGITVAGYPEAHPDVIPNNGVASLEAYQSDLAYLKRKVDAGADLIVTQLFYDTDIFLKFVHDCRQMGINCPIVPGIMPINNYKGFLRMSGFCKTKIPAEIMAALEPIKDNEEAVRNFGIHLGTEMCKKILASGIKTLHLYTLNMEKSALAILMNLGLIEESKVLRSLPWRPPTNVNRTKEDVRPIFWANRPKSYISRTIGWEQYPHGRWGDSRSAEYGALSDYQFMRPRARGKKLHEEWVVPLKTVEDIYEKFRQYCLGKLRSCPWSELEGLQPETKIINEQLGNVNLKGFLTINSQPAVNGAKSDSPSVGWGGPGGYVYQKAYLEFFCSEERLNAIVEKAKAYPSLTYMAVNKEGDWVSNISSTDVNAVTWGVFPAKEIIQPTVVDPTSFAVWKDEAFEIWSRGWAQLYPEADPSRKILEEVQKSFYLVSLVDNDYIGGDLFAVFKDI

SEQ ID NO: 6533 - protein, 597 aa, Plantago ovata
MKVIEKILEATAANDANKVVFSFEFFPPKTDDGVENLFERMERMVAHNPTFCDITWGAGGTTADLTLEIANRMQNMVCVETMMHLTCTNMPVDKIDHALATIKSNGIQNVLALRGDPPHGQDKFVQVEGGFACALDLVNHMRSKYGDYFGITVAGYPEGHPEVILEDGLASAEAYQNELAYLKKKVDAGGEVIVTQLFYDTDIFLKFVNDCRQIGITCPIVPGIMPINNYKGFLRMTGFCKTKIPAEIMAALEPIKDNEEAVRAYGIHLGTEMCKKIMASGIRTIHLYTLNMEKSALAILANLGLIDDSKISRSLPWRRPANVFRVKEDVRPIFWANRPKSYISRTIGWDQYPHGRWGDSRNASYGALGDHQFMRPRSRNKKLQEEWVLPLTNVEDIYEKFMNFCLGKLKTSPWSELDGLQPETKIINELLVNINMKGFLTINSQPAVNGAKSDSPSVGWGGPGGYVYQKAYLEFFCSPQSLNTLVEKCKTFSYLTYMAVNKEGNLISNAKKTDINAVTWGVFPAKEVIQPTVVDPASFVVWKDEAFEIWSRGWAKLYPDADPSAKLLEEVQSSYYLVSLVDNDYIHGDLFAVFRDI

SEQ ID NO: 6534 - protein, 596 aa, Solanum phureja
MKVIEKIQESVKDDRVVFSFEFFPPKTEDGVDNLFERMERMVSHNPSFCDITWGAGGSTADLTLEISNRMQNMVCVETMMHLTCTNMPVEKIDHALETIKSNGIQNVLALRGDPPHGQDKFVQVEGGFACALDLVKHMRAKYGDYFGITVAGYPEAHPDVIPATGLATLETYENELAYLKQKVDAGADLIVTQLFYDTDNFLKFVSDCRQIGITCPIVPGIMPINNYKGFLRMTGFCKTRIPAEITAALEPIKDNEEAVKAYGIHLGTEMCKKIMASGIKTLHLYTLNMEKSALAILMNLGLIEESKISRPLPWRRPTNVFRIKEDVRPIFWANRPKSYISRTIGWDEFPHGRWGNAKNPSYGALSDYQFMRARSRDKKLQEEWAIALNSVEDIYERFMNYCLGKLRSCPWSELDGLQAETKIIDDHLGNINSKGFLTINSQPSVNGAKSDAPLVGWGGPGGFVYQKAYLEFFCSREKLNAVIEKCMAFPFLTYMAVNKKGNWMSNVNQVDVNAVTWGVFPAKEIVQPTVVDPASFMVWKDEAFEIWSRGWAQLYPENDPSRTLLEQVQNSYFLVSLVDNDYINGDLFAIFKDMIW

SEQ ID NO: 6535 - protein, 597 aa, Tripterygium wilfordii
MKVIDKIRAGTEGVGEGNVVFSFEYFPPKTEDGVDNLFERMDRMVAHNPTFCDITWGAGGSTADLTLDIANKMQNVICVETMMHLTCTNMPVDKIDHALTTIKSNGIQNVLALRGDPPHGQDKFVQIEGGFSCALDLVKHIRSEYGDYFGITVAGYPEAHPDAIGPDGVATPESYTNDLTYLKKKVDAGADLIVTQLFYDTDIFLKFVNDCRQIGITCPIVPGIMPINNYKGFLRMTGFCKTKIPAEVTAALEPIKDNEEAVKAYGIHLGTEMCKKILAHGIKTVHLYTLNMEKSALAILMNLGVIEESKVSRSLPWRPPTNIFRVKEDVRPIFWANRPKSYLSRTLGWDQYPHGRWGDSGNPSYGALSDYQFMRPRSRDKKLHEEWAVPLKNIDDIYEKFKQFCLGKLRSSPWTELDGLQPETKIINEHLGKINLKGFLTINSQPAVNGERSDSPTVGWGGPGGYVYQKAYLEFFCSKEKLNLLVEKCKAFPSISFVATNKVGVWISNVSKTDVNAVTWGVFPAKEIIQPTVVDPASFMVWKDEAFEIWSRGWANMYPEGDLSRKLIEEVQSSYFLVSLVDNDYIHGDIFAVFADF

SEQ ID NO: 6536 - protein, 595 aa, Gossypium hirsutum
MKVIDKIQSLSQDQGKVVFSFEFFPPKTEDGVDNLFERMDRMVAHNPSFCDITWGAGGSTADLTLDIANKMQNMICVETMMHLTCTNMPVEKIDHALETIKSNGIQNVLALRGDPPHGQDKFVQVEGGFSCALDLVKHIRAKYGDFFGITVAGYPEAHPDAIGSNGVATPEAYQSDLAYLKKKVDAGADLIVTQLFYDTDIFLKFVNDCRQIGITCPIVPGIMPINNYKGFVRMTGFCKTKIPDEVTAALEPIKDNDEAVKSYGIHLGTEMCRKILAHGIKTLHLYTLNMEKSALAILMNLGLIEESKISRSLPWRRPANVFRVKEDVRPIFWANRPKSYLSRTIGWDQYPQGRWGDSRNPSYGALSDYQFMRPRARDKKLQEEWATPLKSIDDIQEKFKNHCLGKLRSSPWSELDGLQPETKIIHEQLGKINLKGFLTINSQPAVNGERSDSPSVGWGGPGGYVYQKAYLEFFCSLDKLDALVKNCNSFSSLTYVAVNKKGNLLSNIGLTDVNAVTWGAFPAKEIIQPTVVDPASFVVWKDEAFEIWSRSWSTLYPDGDPSKNLLEEIQSSYYLVSLVDNNYMDGNIFGVFEDL

SEQ ID NO: 6537 - protein, 599 aa, Theobroma cacao
MKVIEKIRTLQEEQGKVVFSFEFFPPKTEDGVDNLFERMDRMVAHNPSFCDITWGAGGSTADLTLDIANKMQNIICVETMMHLTCTNMPVEKIDHALQTIKSNGIQNVLALRGDPPHGQDKFVQVEGGFACALDLVKHIRSKYGDYFGITVAGYPEAHPDAIGSDGVATPEAYQNDLEYLKRKVDAGADLIVTQLFYDTDIFLKFVNDCRQIGITCPIVPGIMPINNYKGFLRMTGFCKTKIPADITNALEPIKDNDEAVKSYGIHLGTEMCRKILAHGIKTLHLYTLNMEKSALAILMNLGLIEESKISRFLPWRRPANVFRVKEDVRPIFWANRPKSYISRTIGWDQYPHGRWGDSQNPSYGALTDYQFMRPRARGKKLHEEWATPLKSIDDIQEKFKSYCLGKLKSSPWSELDGLQPETKIIHEQLGKINLKGFLTINSQPAVNGERSDSTSVGWGGPGGYVYQKAYLEFFCSKEKLDALIAKCKALSFITYLAVNKNGDLISNIGVADVNAVTWGAFPAKETIQPTVVDPASFMVWKDEAFEIWSRTWASWYSDTDPEGVQSKKLLEEVQSKYYLVSLVDNDYISGNIFAVFEDI

SEQ ID NO: 6538 - protein, 595 aa, Mimulus guttatus
MKVIEKIQEAARANDDRVVFSFEFFPPKTEDGVDNLFERMERMVVHNPTFCDITWGAGGSTADLTLEIANRMQNMVCVETMMHLTCTNMPVEKIDHALASIKSNGIQNVLALRGDPPHGQDKFVQVEGGLACALDLVKHIRSEYGDYFGITVAGYPEGHPDVIQEGGASAEAYQSDLAYLKKKVDAGADVIVTQLFYDTDIFLKFVDDCRQIGITCPIVPGIMPINNYKGFLRMTGFCKTKIPAEIMAALEPIKDNEEAVRAYGIHQGTEMCKKIIASGIKTVHLYTLNMDKSALAILMNLGLIEESKISRSLPWRRPANYFRVKEDVRPIFWANRPKSYISRTIGWDQFPHGRWGDSRNASYGALTDYQFMKPRSRDKKLNEEWAVPLKNVEDIYEKFVKFCLGKLKSSPWSDLDGLQPETKVINEQLGSINLKGFLTINSQPAVNGARSDSPSVGWGGPGGYVYQKAYLEFFCSKDSLNALVNNCKLFPSLTYMAVNKEGNWISNANKTDVNAVTWGVFPAKEIVQPTVVDPASFMIWKDEAFAIWSRGWAKRYPEADPSKKLLEEVESSYYLVSLVDNDYVGGDLFAVFKNI

SEQ ID NO: 6539 - protein, 594 aa, Amsonia hubrichtii
MKVIEKINDAIATDKVVFSFEFFPPKTEDGVENLFERMDRMVAHNPTFCDITWGAGGSTADLTLEIANRMQNMVCVESMMHLTCTNMPVEKIDHALDTIKSNGLQNVLALRGDPPHGQDKFVQVEGGFACALDLVRHIRKKYGDYFGITVAGYPEAHPDVIPNNGVASLDAYQSDLAYLKRKVDAGADLIITQLFYDTDIFLKFVNDCRQIGINCPIVPGIMPINNYKGFLRMTGFCKTKVPAEIMAALEPIKDNEEAVRNYGIHLGTETCKKILASGIKTLHLYTLNMEKSALAILMNLGLIEESKVSRPLPWRRPTNVHRTKEDVRPIFWANRPKSYITRTIGWEQYPHGRWGDSRFAQYGALSDHQFMRPRARDKKLREEWAVPLKTVEDIYEKFKQYCLGKLRSCPWSELDGLQAETKIINEQLGNVNLKGILTINSQPAVNGAKSDSPSVGWGGPGGYVYQKAYLEFFCSKEKLNAIVEKAKAYPSLTYISVNKEGDWISNISSTDVNAVTWGVFPAKEIIQPTVVDPTSFAVWKDEAFEVWSRGWAQLYPEVDPSRKLLEEVQSSYYLVSLVDNDYINGDLFAIFKDI

SEQ ID NO: 6540 - protein, 594 aa, Vinca minor
MKVIEKINDAIVTDKVVFSFEFFPPKTEDGVENLFERMDRMVAHNPSFCDITWGAGGSTADLTLEIANRMQNMICVETMMHLTCTNMPVEKIDHALDTIKSNGIQNVLALRGDPPHGQDKFVQVEGGFACALDLVKHIRKKYGDYFGITVAGYPEAHPDVIPNNGMAPLDAYQSDLAYLKRKVDAGADLIVTQLFYDTDVFLKFVHDCRQIGINCPIVPGIMPINNYKGFLRMTGFCKTKIPAEIMAALEPIKDNEEAVRNYGIHLGTEMCKKIMTSGIKTVHLYTLNMEKSALAILMNLGLIEESKVSRPLPWRRPTNVNRSKEDVRPIFWANRPKSYISRTIGWEQYPRGRWGDSRSAQYGALSDYQFMRPRARDKRLHEEWVVALKNVEDIYEKFKQYCLGKLRSCPWSELDGLQPETKIINEQLGNVNLKGFLTINSQPAVNGAKSDSPSVGWGGSGGYVYQKAYLEFFCSKDKLNAIVEKAKAYPSLTYLAVNKEGDWISNVTSTDVNAVTWGVFPAKEIIQPTVVDPTSFAVWKDEAFEIWSRGWAQLYPAADPSRKLLEEVQNSYYLVSLVDNDYITGDLFAVFKDI

SEQ ID NO: 6541 - protein, 595 aa, Cicer arietinum
MKVIDKIRAASADPNRVVFSFEFFPPKTEDGVDNLFERMDRMVAHNPSFCDITWGAGGTTADLTLEIANKMQNIICVETMMHLTCTNMPVDKIDHALETIKSNGIQNVLALRGDPPHGQEKFVQAEGGFACARDLVEHIRSKYGDYFGITIAGYPEAHPDVIGSDGLAPVEGYQNDLAYLKSKVDAGADLIVTQLFYDTDIFLKFVSDCRQIGITCPIVPGIMPINNYKGFIRMTGFCKTKIPAEIMAALEPIKDNEEAVKAYGIHLGTEMCKKIMAHGIKTVHLYTLNMEKSALAILTSLGLIEESKISRSLPWRRPTNVFRVKEDVRPIFWANRPKSYISRTIGWDQYPHGRWSDSGNPSYGALTDYQFMRPRARDKKLIEEWAVPLRSVEDIYERFRLFCLGKLRTNPWSELDGLQPESKIINEQLEKINTKGFLTINSQPAVNGEKSDCPTVGWGGPNGYVYQKAYLEFFCSKEKLDALVEKSKARPSLTYMAVNKEGTAKSNVGPTDVNAVTWGVFPAKEIIQPTIVDPVSFNVWKDEAFEIWSRAWASLYPEADASRKLVEQVGGSYFLVSLVDNDYINGDLFGVFGDI

SEQ ID NO: 6542 - protein, 594 aa, Plantago ovata
MKVIEKIHEANGGSDRVVFSLEFFPPKTDDGVDNLFERMERMVAHNPTFCDITWGAGGSTADLTLEIANRMQNMICVETMMHLTCTNMPVDKIDHALETIKSNGIQNVLALRGDPPHGQDKFVQVDGGFACALDLVNHIRSKYGDYFGITVAGYPEGHPDVIQDGAASAEAYQNELAYLKKKVDAGGEVIVTQLFYDTDIFLKFVNDCRQIGITCPIVPGIMPINNYKGFIRMTGFCKTKIPDDIMAALEPIKDNEEAVRAYGIHLGTEMCKKIMASGIKTLHLYTLNMEKSALAILMSLGLIEESKISRSLPWRRPANIFRVKEDVRPIFWANRPKSYISRTIGWDQYPHGRWGDSRNASYGTLSDYQFMRPRSRSKKILEEWVVPLTNAEDIYEKFMNFCLGKLKTSPWSELDGLQPETKIINEQLGSINMKGFLTINSQPAVNGAKSDSPSVGWGGPGGYVYQKAYLEFFCSSELLKDLVEKSKLFPSLTYMAVNKEGNLISNVHSADVNAVTWGVFPAKEIIQPTVVDPSSFAIWKDEAFEIWSKGWATLYPESDPSRKILEEVQSSYYLVSLVDNDYIGGDLFAVFKDI

SEQ ID NO: 6543 - protein, 596 aa, Solanum lycopersicum
MKVIEKIQESVKDDRVVFSFEFFPPKTEDGVDNLFERMERMVSHNPSFCDITWGAGGSTADLTLEISNRMQNMVCVETMMHLTCTNMPVEKIDHALETIKSNGIQNVLALRGDPPHGQDKFVQVEGGFACALDLVKHMRAKYGDYFGITVAGYPEAHPDVIPANGLATLETYENELAYLKQKVDAGADLVVTQLFYDTDNFLKFVSDCRQIGITCPIVPGIMPINNYKGFLRMTGFCKTRIPAEITAALEPIKDNEEAVKAYGIHLGTEMCKKIMASGIKTLHLYTLNMEKSALAILMNLGLIEESKISRLLPWRRPTNVFRIKEDVRPIFWANRPKSYISRTIGWDEFPHGRWGNAKNPSYGALSDYQFMRARSRDKKLQEEWAIALNSVEDIYERFMYYCLGKLRSCPWSELDGLQAETKIIDDHLGNINSKGFLTINSQPSVNGAKSDAPLVGWGGPGGYVYQKAYLEFFCSREKLNAVIEKCTAYPFLTYMAVNKKGNWMSNFNQIDVNAVTWGVFPSKEIVQPTVVDPASFMVWKDEAFEIWSRGWAQLYPENDPSRTLLEQVQNSYFLVSLVDNDYINGDLFAIFKDIWN

SEQ ID NO: 6544 - protein, 595 aa, Triphysaria pusilla
MKVIEKIQQATAANDDRVVFSFEFFPPKTEDGVENLFERMERMVVHNPTFCDITWGAGGSTADLTLEIANRMQNMVCVETMMHLTCTNMPVEKIDHALTTIKSKGIQNVLALRGDPPHGQDKFVQVEGGFACALDLVKHIRSQYGDYFGITVAGYPEGHPDVIQDGGASAEAYQNDLAYLKKKVDAGADVIVTQLFYDTDIFLKFVNDCRQIGITIPIVPGIMPINNYKGFIRMTGFCKTKIPDEIMAALEPIKDNEEAVRAYGIHLGVEMCKKIMASGIKTLHLYTLNMEKSALAILTNLGLIEESKISRSLPWRRPANVFRVKENVRPIFWANRPKSYISRTLGWDQYPQGRWGDSHSASYGALSDYQFMRPRARDKKLREEWAVSLNNIEDIYEKFSKFCLGKLKSSPWSDVDGLQAETKIINEQLGSINLKGFLTINSQPAVNGVQSDSPSVGWGGPGGYVYQKAYLEFFCSTEKLKALVDKSKHFPHLTYMAVNKQGSWQSNANKTDVNAVTWGVFPAKEIIQPTVVDPESFLVWKDEAFEIWSRGWAKLYPDTDPSKKLLEEVESSYYLVSLVDNDYINGDLFAAFKDI

SEQ ID NO: 6545 - protein, 589 aa, Secale cereale
PHWRASYRGPSVRLALAPPSLPAPPRRGAPQLHATPPAPPCGGVHGLSALLAGVHTHPRALPLSAAFRGIPRWHTRLPKGAARAGGGEARAAAGPCAPAPPKESEIELCARISVEDDLPDDIEVLNVIEIMKLNVPMAMKIALDGLLEYNYKTRDTSISDVGKYEKVEVSVLLCNDNFIQNLNKEWRGEDCATDMLSVSQFIPDLDVPTLMLGDIVISVETAARQAEAKGHTLLDELRTLVVRGLLCLLGFDRQISDEAAMEMEKEELLILKSLRWKGKGLAKNAPDLSKPHTETLDGQVANSLKKAGSLRFYRPKFKYIFCDMDGTLLNSKSQVTARNAEALKEARSRGVNIVIATGKTRPAAIDALNMVDLSGRNGIVSESSPGVFLQGLLVYGLEGREIYRNTLNQEVCREAFMYSLEHKVPLVAFSQDRCFSMFEDPLVDSLHDVYHEPKAEIVSSIDQLLGTAEIQKLVFIGTSEGISSTLRPYWTKAIEERASVLQAQPDMLELVPPATSKGTGVKILLDHLCISPDEVMAIGDGENDIEMLQLASLGVALANGAEKTKAVANVIGATNDEDGVAQAIYEYAF

SEQ ID NO: 6546 - protein, 593 aa, Oryza sativa
MARIVSRALPFASRSPQLGAALIRSAPMRCPPLPAAAPTASLLSWRGFTPSSEPSRSAPPPPPLPMPPFAGFLAGIRSFRRGRRGQSAARRAQPQDPIPSPPPAPKESEIELYARIGIDDDTPEDPEVLNIVEILKLNVPMAMKIALDGLLDSNYKTRDTSISDVGRYDKVEVSVLLCNDNFIQNLNKEWRGEDSCIEMLSMSQYIPDLDVPILMLGDIVISVETAARQAEERGHTLLDEVRILAVRGILRLLGFDHQTSHESAVEMEKEEQLILKSLRWKGKNLAKSVLDSGKRHTETSDGQVTSGLKRAGSLRFYRPKFKYIFCDMDGTLLNSKSQVTARNAEALREARSRGVNIVIATGKARPAVIDALNMVDLSGRTGIVSESSPGIFLQGLLVYGLQGREIYKRNLDQEVCREALLYSLEQKVPLVAFSQDRCFSMYDDPLVDSLHYVYHEPKAEIVSSIDQLLGTAEIQKVLFLETPEGISSALRPFWEKAIEGRARVVQAQPDMLELVPPATSKGNGVKILLDHLCISPDEVMAIGDGENDIEMLQLASLGVALANGSEKTKAVANIIGATNDEDGVAQAIYDYAF

SEQ ID NO: 6547 - protein, 389 aa, Panicum virgatum
METPLSNRRITRSLAAAAAAAASAQKGAAAAADSTALSSRAKNADAGEPQARAALHDISNDSPIVGLAPGGLHGSDKTPASTAAKTRRRAPRRTPGSGEALLRGQVQALLHKVEEEQGCAPAALVRPARIQALLAVSRSPAQLLAPTPANTPQIGPVSAAMEGLLMPDVPVVPCVLEEEELLLPKLQVMAASLPLPQPKENLGECQLNRALVFDDSPEKSDVSNGSAVSFQESSTGSCIDKSSSSSPEDDSSSAWSVQVHASSEKGDEEELGVEEEDLGEYTEEGEDLGEYTEEGKEWEENSDDDCFDDLCEEMSRMTVVDEEEERKAGLPQFEGKHTRFIYNSDDEIEREEVADAAEARAELGALMLRGLPVPEGRHLRFHEDDEDEE

SEQ ID NO: 6548 - protein, 381 aa, Zea mays
METPLSSRRITRSLAAASAQKSAAAGPDSAALFSRAKNAAAGETQPRAALHDITNDSPIVGLAAGALHATDTTPASTAAKTRRRAPRRTPGSGEALLRGQVKALLHKVEEEQGCAAAAIVRPARIQALLGVSRSPAQLLAPTPANTPQIEPVPTPREGLLLLDGATVVPCVLDEEELLIPKLQVIAASLPPPHQAEEKLGDCQLNRALVFDDSPEKCEESSGSAVSSTFSLQESSTGSYVDKSSSPEDDSSSAWSIQVHASSEKGDEEELGVEELAAEYTDEEEEEEEEDWDEDSDDDCYDDLCEEMSRMTVLEEEEKKKTVLPQFEGKHTRFIYNSDDEIERVEEADAAEATAELRALMLRGLLVPEGRHLRFHDEDADE

SEQ ID NO: 6549 - protein, 394 aa, Sorghum bicolor
METPLSTRRITRSLAAAAAASAQKSAAAAGSDSAALFSRAKKTAAVETQAQTRAALHDISNDSPIVGLAAGGLHATDTTPASTAAKTRRRAPRSTPGSGEALLRGQVKALLHKVDEDQGCAAAAALVRPARIQALLGVSRSPAQLLAPTPANTPQIGPVSAPREGLLQLDGAAAVTCVLDEEEPLIPKLKVIAASLPPPQAEEKLGECQLNRALVFDDSPEKSDESNGSAVSSSVSLQESSAGSYMDKSSSPDDDSSSAWSIQVHASSEKGDEEELSVEELAAAEYTEEEEEEEEEYTEEEDWEEDSDDDCYDDLCEEMSRMTVLDEEEKKAAGLPQFEGKHTRFIYNSDDEIEREEVADAAEATAELGALMLRGLPVPKGRHLLFHDEEDDEE

SEQ ID NO: 6550 - protein, 365 aa, Sorghum bicolor
MDVEARKDAPPPARGNKAMHRFLVALNCGMLALGAIGGPLLSRLYFSKGGHRQWLSAWLETGGWPLLLVPVALSFVARRARDRAAPVLLTPPRILLAAVALGVATGVDDFIYAYGLAYLPVSTSAILISTQLAFTVFFAFLVVRQRLTAASVNAVALLTVGAVVLGLHVSSDRPPGVTRGQYWLGFTLTLGAAALYGLVLPLVELAYKRAAAGGGRAVSYALVVEMQLVMGFFATAFCTVGMIVNKDFQAIPREARQYELGEARYYTVLVWSAVLWQCFFLGAVGVIFCVHTLLAGILIAVFIPVTEVAAVIFLHEKFSSEKGVALVLSLWGLASYSYGEWSQARKAKKKREHAAAVEAQQPAAP

SEQ ID NO: 6551 - protein, 361 aa, Zea mays
MDVEARKDAAPARGKAVRRFLVALNCGMLALGAIGGPLLSRLYFSKGGHRQWLSAWLETGGWPLLLVPVAASFGARRARDRGAPVLLTPPRILLAAAGLGVATGVDDFVYAYGLAYLPVSTSAILISTQLAFTVFFAFLVVRQRLTAASVNAVALLTVGAVVLGLHVSSDRPPGVTRGRYWLGFSLTLCAAALYGLVLPLVELAYRRAAGGGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEEDDGEVAQAVP

SEQ ID NO: 6552 - protein, 367 aa, Zea mays
MDVEARKSDAPPARGKAMHRFLVALNCGMLAVGAIGGPLLSRLYFSKGGHRQWLSAWLETGGWPLLVIPVAASFVARRARDRGAPVLLAPPRILLAAAGLGVATGADDFIYAFGLAYLPVSTSAILISTQLAFTVFFAFLVVRQRLTAASVNAVALLTVGAVVLGLHVSSDRPPGVTRGQYWLGFVLTLGAAALYGLVLPLVELAYRRAAGAGGRAVTYALVVEMQLVMGFFATAFCTVGMVVNKDFQAIPREARRYKLGEARYYAVLAWSAVLWQCFFLGAVGVIFCVHTLLAGILIAVFIPVTEVAAVIFLRERFSSEKGVALVLSLWGLASYSYGEWSEARAKKRKTRTEEGAAAAEALQQANP

SEQ ID NO: 6553 - protein, 361 aa, Secale cereale
MDVEAAKDDDQRPAAPAARGKAMQRLLVALNCGMLTLGTTGGPLLSRLYFSKGGHRKWLSAWLETGGWPLLLLPVAASYLSRRAHDPSAPVVLTPPRILLAAAGLGLATGADDFLYAYGLSFVPVSTSAILISTQLAFTVLFAFLIVRQRLTALSVNAVALLTVGAVVLGLHVSSDRPAGVTKGQYWLGFLLTLGAAALYGLVLPLIELTYKRAAGGGRVVTYALVMEMQLVMGFFATAFCTVGMVVNNDFQAIAREARAFQLGEARYYTVLVWSAILWQFFFLGAVGVIFCVHTLFAGILIAVFIPVTEVLAVIFLHEKFSSEKGVALVLSLWGLASYSYGEYSDAKAAKKKAALDAQAS

SEQ ID NO: 6554 - protein, 360 aa, Hordeum vulgare
MDVEAPKDDEQRPAPPARGKAMQRLLVALNCGMLTLGTTGGPLLSRLYFSKGGHRKWLSAWLETGGWPLLLLPVAASYLRRRAQDPSAPVVLAPPRILVAAAGLGLATGADDFLYAYGLSFVPVSTSAILISTQLAFTVLFAFLIVRQRLTALSVNAVALLTVGAVVLGLHVSSDRPAGVTRGQYWLGFLLTLGSAALYGLVLPLIELTYKRAAGGGRVVTYALVMEMQLVMGFFATAFCTVGMIVNNDFQAMAREARAFELGEARYYTVLVWSAILWQFFFLGAVGVIFCVHTLFAGILIAVFIPVTEVLAVIFLHEKFSSEKGVALVLSLWGLASYSYGEYSDAKAAKKKAALDAQAS

SEQ ID NO: 6555 - protein, 360 aa, Triticum aestivum
MDVEAPKDDDQRPAPPARGKAMQRFLVALNCGMLTLGTTGGPLLSRLYFSKGGHRKWLSAWLETGGWPLLLLPVAASYLSRRAHDPSAPVVLTPPRILLAAAGLGLATGADDFLYAYGLSFVPVSTSAILISTQLAFTVFFAFLIVRQRLTALSVNAVALLTVGAVVLGLHVSSDRPAGVTKGQYWLGFLLTLAAAALYGLVLPLIELTYKRAAGGGRVVTYALVMEMQLVMGFFATAFCTVGMIVNNDFQAISREAQAFELGEARYYTVLVWSAILWQFFFLGAVGVIFCVHTLFAGILIAVFIPVTEVLAVIFLHEKFTSEKGVALALSLWGLASYSYGEYSDAKAAKKKAALDAQAS

SEQ ID NO: 6556 - protein, 360 aa, Triticum aestivum
MDVEAPKDDDQRPAPPAHGKAMQRFLVALNCGMLTLGTTGGPLLSRLYFSKGGHRKWLSAWLETGGWPLLLLPVAASYLSRRAHDPSAPVVLTPPRILLAAAGLGLATGADDFLYAYGLSFVPVSTSAILISTQLAFTVFFAFLIVRQRLTALSVNAVALLTVGAVVLGLHVSSDRPAGVTKGQYWLGFLLTLAAAALYGLVLPLIELTYKRAAGGGRVVTYALVMEMQLVMGFFATAFCTVGMIVNNDFQAISREAQAFELGEARYYTVLVWSAILWQFFFLGAVGVIFCVHTLFAGILIAVFIPVTEVLAVIFLHEKFTSEKGVALALSLWGLASYSYGEYSDAKAAKKKAALDAQAS

SEQ ID NO: 6557 - protein, 361 aa, Oryza sativa
MDVEATKDVVHEQAAAPGRGRAARWLLVALNCGMLVVGTTGGPILSRLYFSKGGHRKWLSAWLETAGWPLLLVPVSASYHSRRARDRGAPLFLTPRRVLLAGAVLGVLTGADDFVYAYGLAYLPVSTSAILISTQLAFTVFFACLIVRQRLTAATLNAVALLTIGAVVLGLHASKDRPAGVTTGKYWMGFFLTLGAAALYGLILPLVELAYKHAAGGGRAVTYALVMEMQLVMGFFATAFCTVGVIVNKDFQAIPREAKQYELGEARYYVVLVFNAVLWEFFFVGAVGVIFCVHTLLAGIIIAVFIPITEVLGVIFLHEKFSSEKGVALVLSLWGLASYSYGEYADAKAKKKAALEAEEAS

SEQ ID NO: 6558 - protein, 361 aa, Oryza sativa
MDVEATKDVGHEQAAVPGRGRAARWLLVALNCGMLVVGTTGGPLISRLYFSKGGHRQWLSAWLQTAGWPLLLVPVAASYLSRRARDRRAPLFLTPTRVLLAGVGLGFLNGADDFIYAYGLAYLPVSTSAILISTQLAFTVFFACLIVRQRFTAATLNAVALLTIGAVVLGLHASKDRPAGVTSGKYWMGFFLTLGAAALYGLILPLVELAYKHAAGGGRAVTYALVMEMQLVMGFFATAFCTVGMVVNKDFQAIPREAKQYELGEARYYVVLVFNAVLWEFFFVGAVGVIFCVHTLLAGIIIAVFIPITEVLGVIFLHEKFSSEKGVALVLSLWGLASYSYGEYADAKAKKKAALEAEEAS

SEQ ID NO: 6559 - protein, 788 aa, Setaria italica
MFWRMTGLSAASPVDTILDKENFTLEELLDEDEIIQECKALNSRLINFLRDKAQVEQLLRYVVEEVPEDNEKKRSFKFPFIACEIFTCEIDVVLRTLVEDEELMDLLFSFVKPDHPHSTLLSGYFSKVVICLMLRKTAPLMNYVQGHPEIVVQLVDLIGITSIMEVLIRLIGADENIYSNYGDTLQWLENTDVLEMIADKFSSSDSPEVHANAAEILCAVTRCAPPSLAAKICSPSFVGRLFHHAFEESRPKSVLVHSLSVCISLLDPKRLASASYQAFRSNLSHGALVTASPETVDGMLESLGNLLMLLDTSAAENVLPTTYGCLRPPLGKHRLKIVEFISVLLTIGSETAEKELIRQSAIKRSIDLFFEYPYNNFLHHHVENIIVSCLEGKRTELVEHVLNECDIVGKILVAERLSSLSTESNGPTIPSEEKAPPRIGNVGHMTRIANKLIQLGNSNSTIQAHLQENTEWVEWQTNVLVKRNEVENVYHWACGRPTSLHDRGRDSDDDDFRDRDYDVAALANNLSQAFRYGIYSNDDIEEAQGSLERDDEDVYFDDESAEVVISSLRLGDDQDGSLFTNSNWFTFDGERGINDRISDSVPSSSPNSEEISLETEEADDGKVIGTEDEMETVCLGNGSTEEAKDVAECVEQLNCSTANEPLQNTDSLERHSDVSNGSTEVGTAAAAESSAPSVEIAAESSAPSVEIAAEKTADEPLMVERTVGEPAVSSDLDNSISEATPGANGSEPADPEVSSEQVGNDTDVQQPVKEVAGEDVDETKTDAVKASD

SEQ ID NO: 6560 - protein, 781 aa, Sorghum bicolor
MFWRMTGLSAASPVDTILDKENFTLEELLDEDEIIQECKALNSRLINFLRDKAQVEQLLRYVVEEVPEDAERKRSFKFPFIACEIFTCEIDVILRTLVEDEELMDLLFSFVKPDHPHSTLLSGYFSKVVICLMLRKTAPLMSYVQGHPEIVVQLVDLIGITSIMEVLIRLIGADEAIYSNYGDTLQWLENTDVLEMIADKFSSSDSPEVHANAAEILCAVTRCAPPSLAAKICSPSFVGRLFHHALEESRPKSVLVHSLSVCISLLDPKRLASASYQAFRSNLTHGALVTASPETVDGMLESLGNLLKLLDTSAAESVLPTTYGCLRPPLGKHRLKIVEFISVLLTIGSETAEKELIRQSAIKRSIDLFFEYPYNNFLHHHVENIIVSCLEGKRPEVVDHVLHECDIVGKILVSERLSSLSIESNGPTVPSEGKTPPRIGNVGHMTRIANKLIQLGNSNNTIQAHLWENNEWVEWQTNVLVKRNEVENVYHWACGRPTSLHDRGRDSDDDDFRDRDYDVAALANNLSQAFRYGIYSNDDIEEAQGSLERDDEDVYFDDESAEVVISSLRLGDDQDGSLFTNSNWFTFDGERGIDDRTSASVPSSSPNSEEISPETEEADDGKVIGTEDEMETVYLGNGSAEEVKDVAECTEQANCCTEDERLKNTEGMERHPDASNNDTDICTNEAASAAAESSAPSVEKAAEKTVDEPLEAERTVDEPAESSLDSSVSVALPAPVNGSEPANSEASSEQVAHDTDVQQPVKEAPAEDVDAKKTDGAKASE

SEQ ID NO: 6561 - protein, 831 aa, Brachypodium distachyon
MFWRMTGLSAASPVDTILDKENFTLEELLDEDEIIQECKALNTRLINFLRDKAQVEQLLRYIVEEVPEDVEKKRSFKFPFIACEIFTCEIDVILRTLVEDEELMELLFSFVKPDHPHSTLLSGYFSKVVICLMLRKTAPLMNYVQEHPEIVIQLVDLIGITSIMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNLSHGALVTASPETVEGMLESLGNLLKLLDTSAAENVLPTTYGCLRPPLGKHRLKIVEFISVLLTVGSETAEKELINQSAIKRSIDLFFEYPYNNFLHHHVENIIVSCLEGKRTELIEHVLNECDIVGKILAADKLSSLSTESNGPTLPSEGKTPSKIGNVGHMTRIANKLIQLGNSNSTIQTHLQDNSEWVEWQTDILVRRNEVENVYHWACGRPTSLHDRGRDSDDDDFRDRDYDVAALANNLSQAFRYGIYSNDDIEEAQGSLERDDEDVYFDDESAEVVISSLRLGEEQDGSLFTNSNWFTFDGERGINDRLAASVPSSSPNSEEVSPDAEETDDGEAIGTEDQMETLCLGNGPTEAEDVAECTKQTNFSTEDEQLGSPEGIERHPDASNGDTEVSTDEAASAAVESSAPAAEEQTERTVDKATGSSGLDNLVSEALPDPDVNVSDLADSAVSSEQAVCNEDVEPPIETDAVVDVEAKTDAVVDVEAKTDVVMDVEAKTDAVVDVEAKTDAVVDVEAKTDAVMDLPVKEVSALDVEAKTGVVEANE

SEQ ID NO: 6562 - protein, 808 aa, Triticum aestivum
MFWRMTGLSAASPVDTILDKENFTLEELLDEDEIIQECKALNTRLINFLRDKAQVEQLLRYVVEEVPDDAEKKRSFKFPFIACEIFTCEIDVILRTLVEDEELMDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNVSHGALVTASPETVDGMLESLGNLLNLLDTSAAENVLPTTYGCLRPPLGKHRLKIVEFISVLLTVGSETAEQELISQSAIKRSIDLFFEYPYNNFLHHHVENIIVSCLEGKRTELVEHVLNECDIVGKILAADKLSSLATESNGPTVPSEGKTPSKIGNVGHMTRIANKLIQLGNSNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASPDTKEADDGEAIGTEDQMETLGLGNGPAKEAEDAAECTKQTNLSTENEQLESAEGTERHLDVSFHGTEASTDEAASEAAESSVSATETQAERTVDKPAGSSDLDNPISEASPDPDVNGSDLAGSALSSEQAVRNEDVEVPTKTDAVVDTEMKTDTVVETDAVGDVGVKADAVVEVPSKEVSAVDVEAKTGAAEAKE

SEQ ID NO: 6563 - protein, 772 aa, Oryza sativa
MFWRMTGLSAASPVDTILDKENFTLEELLDEDEIIQECKALNTRLINFLRDRAQVEQLLRYVVEEVPDDAEKKRSFKFPFIACEIFTCEIDVILRTLVEDEQLMELLFSFVKSDHPHSTLLSGYFSKVVICLMLRKTAPLMAYVQGHPEIVVQLVDLIGITSIMEVLIRLIGADETIYSNYGDTLQWLENTDVLEMIADKFSSSDSPEVHANAAEILCAVTRCAPPSLAAKICSPSFVGRLFRHALEESRPKSVLVHSLSVCISLLDPKRLASASYQAFRSNLSHGALVTASPETVDGMLESLGNLLKLLDTSDAENVLPTTYGCLRPPLGKHRLKIVEFISVLLTIGSETAEKELIRQSAIKRSVDLFFEYPYNNFLHHHVENIIVSCLEGKRTELVEHVLNDCDIVGKILAAEKLSSLSTESTGPTIPSDGKSIPKIGNIGHMTRITNKLIQLGSSNGTIQIHLQENSEWVDWQTDVLVKRNEVENVYHWACGRPTSLHDRGRDSDDDDFRDRDYDVAALANNLSQAFRYGIYSNDDMEENQGTLERDDEDVYFDDESAEVVISSLRLGDDQDGSLFTNSNWFTFDGERGITDRLAAVPSSSPNSEEISPDTEETDDGEVVIGTEDHMDTVNLGNGPIEEAEDAAEFTKHPATSTEDEQLQNAEGIERHLDVSNGDAEASTEAAEAAPVSSAPSSDEVQTERTADEPTGSSDSGNSVSEVLPDPEDSSIDPANTAVSSEQTVDNEDVELPTKEVPSVDVETKTDEIKANE

SEQ ID NO: 6564 - protein, 808 aa, Hordeum vulgare
MFWRMTGLSAASPVDTILDKENFTLEELLDEDEIIQECKALNTRLINFLRDKAQVEQLLRYVVEEVPDDAEKKRSFKFPFIACEIFTCEIDVILRTLVEDEELMDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNVSHGALVTASPETVDGMLESLGNLLNLLDTSAAENVLPTTYGCLRPPLGKHRLKIVEFISVLLTVGSETAEQELISQSAIKRSIDLFFEYPYNNFLHHHVENIIVSCLEGKRTELVEHVLNECDIVGKILAADKLSSLSTESNGPTVPSEGKTPSKIGNVGHMTRIANKLIQLGNSNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASTDIEEVDDGEAIGTEDQMETLGLGNGPAKEADDDAECTKQANLNSENEQLESAEGTKRQPDVSIDGTEVSTDEAASEAAASSAPATETQAERTVDKPAGSSDLDNPISEASPDPDVNVSNLAGSALSSQQAVLNEDVEVPIKTDAVVDTETKTDTVVETDAVGDVGVKADAVDEVPSKEVSAVDVEAKTGAAEANE

SEQ ID NO: 6565 - protein, 808 aa, Secale cereale
MFWRMTGLSAASPVDTILDKENFTLEELLDEDEIIQECKALNTRLINFLRDKAQVEQLLRYVVEEVPDDAEKKRSFKFPFIACEIFTCEIDVILRTLVEDEELMDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNVSHGALVTASPETVDGMLESLGNLLNLLDISAAENVLPTTYGCLRPPLGKHRLKIVEFISVLLTVGSETAEQELISQSAIKRSINLFFEYPYNNFLHHHVENIIVSCLEGKRTELVEHVLNECDIVGKILAADKLSSLSTESNGPTVPSEGKTPSKIGNVGHMTRIANKLIQLGNNNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASPDIEEADDGEAIGTEDQMETLGLGNGPAKEAEDDAECTKHTNLSTENEQLESAEGMERHPDVSVDGTEVSTDEAASGAAESSAPAAETEAERTVDKPAASSDLDNPISEASPDPDVNGSDLAGSALSSEQAVRNEDAEVAIKTDAVVGTETKTETVVETDAAGDVGVKADAVGEVPSKEVSAVDVEAKTGEAEANE

SEQ ID NO: 6566 - protein, 705 aa, Hordeum vulgare
MDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNVSHGALVTASPETVDGMLESLGNLLNLLDTSAAENVLPTTYGCLRPPLGKHRLKIVEFISVLLTVGSETAEQELISQSAIKRSIDLFFEYPYNNFLHHHVENIIVSCLEGKRTELVEHVLNECDIVGKILAADKLSSLSTESNGPTVPSEGKTPSKIGNVGHMTRIANKLIQLGNSNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASTDIEEVDDGEAIGTEDQMETLGLGNGPAKEADDDAECTKQANLNSENEQLESAEGTKRQPDVSIDGTEVSTDEAASEAAASSAPATETQAERTVDKPAGSSDLDNPISEASPDPDVNVSNLAGSALSSQQAVLNEDVEVPIKTDAVVDTETKTDTVVETDAVGDVGVKADAVDEVPSKEVSAVDVEAKTGAAEANE

SEQ ID NO: 6567 - protein, 795 aa, Triticum aestivum
VDTILDKENFTLEELLDEDEIIQECKALNTRLINFLRDKAQVEQLLRYVVEEVPDDAEKKRSFKFPFIACEIFTCEIDVILRTLVEDEELMDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLASKICSPSFVGRLFCHALEGSRPKSVLVHSLSVCISLLDPKRLASASYQAFRSNVSHGALVTASPETVDGMLESLGNLLNLLDTSAAENVLPTTYGCLRPPLGKHRLKIVEFISVLLTVGSETAEQELISQSAIKRSIDLFFEYPYNNFLHHHVENIIVSCLEGKRTELVEHVLNECDIVGKILAADKLSSLATESNGPTVPSEGKTPSKIGNVGHMTRIANKLIQLGNSNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASPDTKEADDGEAIGTEDQMETLGLGNGPAKEAEDAAECTKQTNLSTENEQLESAEGTERHLDVSFHGTEASTDEAASEAAESSVSATETQAERTVDKPAGSSDLDNPISEASPDPDVNGSDLAGSALSSEQAVRNEDVEVPTKTDAVVDTEMKTDTVVETDAVGDVGVKADAVVEVPSKEVSAVDVEAKTGAAEAKE

SEQ ID NO: 6568 - protein, 501 aa, Sorghum bicolor
MNGRGGGGGGGGEEEMEEDGGGPGCAQGAGNKERVVLMWGYLPGVSPQRSPLLGPVPVRLPPAAAAAAGDGWRDVCGGGCGFAMAISESGKLLTWGSADDMGQSYVTAGKHEETPEAFPLPSGVAIVRADAGWAHCVAITDEGDVYTWGWKECVPTGRVIGDQSSVGTMEKDERQMAMATDQVSPRSQVSRTSSGAASGPPESRGTDDSTKRRRLSSAKHGPESSTSSDESLSAPPCVVTFNTGVKIVSVAAGGRHTLALSDLGQVWGWGYGGEGQLGLGSRIRTVSSPHPVPCIESALYSKDRPSAMKGNKAAEGHVSKVLGNCVRAIACGGRHSAVVTDSGALLTFGWGLYGQCGQGNTDDVLSPTCVSSILGIKMQDVAAGLWHTVCTSVDGDVYSFGGNQFGQLGTGSDQAETVPKLVDATSLENKNARSVSCGARHSAIITDEGEVFCWGWNKYGQLGLGDSMDRNVPCSVPVDAYHPLNVSCGWWHTLVLAESPT

SEQ ID NO: 6569 - protein, 503 aa, Sorghum bicolor
MNGRGGGGGGGGEEEMEEDGGGPGCAQGAGNKERVVLMWGYLPGVSPQRSPLLGPVPVRLPPAAAAAAGDGWRDVCGGGCGFAMAISESGKLLTWGSADDMGQSYVTAGKHEETPEAFPLPSGVAIVRADAGWAHCVAITDEGDVYTWGWKECVPTGRVIGDQSSVGTMEKDERQMAMATDQVSPRSQVSRTSSGAASGPPESRGTDDSTKRRRLSSAKHGPESSTSSDESLSAPPCVVTFNTGVKIVSVAAGGRHTLALSASDLGQVWGWGYGGEGQLGLGSRIRTVSSPHPVPCIESALYSKDRPSAMKGNKAAEGHVSKVLGNCVRAIACGGRHSAVVTDSGALLTFGWGLYGQCGQGNTDDVLSPTCVSSILGIKMQDVAAGLWHTVCTSVDGDVYSFGGNQFGQLGTGSDQAETVPKLVDATSLENKNARSVSCGARHSAIITDEGEVFCWGWNKYGQLGLGDSMDRNVPCSVPVDAYHPLNVSCGWWHTLVLAESPT

SEQ ID NO: 6570 - protein, 502 aa, Zea mays
MNGRGTGGGGGGEDEMEEDSGPSCAQGEGAGNKERVVLMWGYLPGVSPQRSPLLGPVPVRLPPTAATAAGDGWRDVCGGGCGFAMAISESGKLLTWGSADDMGQSYVTAGKHEETPEAFPLPSSVVIVRADAGWAHCVAITDEYDVYTWGWKECVPTGRVIGDQSSVGTMEKDERQMAMATDQVSPRSQVSRTSSGAAAGSSESRGTDDSTKRRKLSLAKHGPESSTSSDESLSAPPCVVTFSTGVKIVAVAAGGRHTLALSDLGQVWGWGYGGEGQLGLGSRIRTVSSPHPVPCIESALYTKDRPSAMKGNKAAEGHVSKVLGNCVRAIACGGRHSAVVTDSGALLTFGWGLYGQCGQGNTDDVLSPTCVSSILGIKMQDVAAGLWHTVCTSVDGDVYSFGGNQFGQLGTGSDQAETLPKLVDATSLENKNARSVSCGARHSAIITDEGEVFCWGWNKYGQLGLGDSMDRNVPCSVRVDAYHPLNVSCGWWHTLVLAESPA

SEQ ID NO: 6571 - protein, 180 aa, Panicum virgatum
MGNCVRAIACGGRHSAVVTDSGALLTFGWGLYGQCGQGNTEDVLSPTCVSSILGIKMQDVAAGLWHTVCTSVDGDVYSFGGNQFGQLGTGSDQAETVPKLVDATSLENKNARSVSCGARHSAIITDEGEVFCWGWNKYGQLGLGDSMDRNVPCNVPVDTYHPLNVSCGWWHTLVLAESPT

SEQ ID NO: 6572 - protein, 507 aa, Oryza sativa
MNGRGGGGGGGVGVVGAGGEEQMEMEEDGAGLRARVSAGRKERVVLMWGYLPGVSPQRSPLLGPVPVRLPAAAGGDGWRDVCGGGCGFAMAISESGKLLTWGSADDMGQSYVTAGKHEETPEAFPLPSDVAIVRADAGWAHCVAITDEGDVYTWGWKECVPTGRVISDQSSGGTLEKDERQSAIAADQVSPRSQVSRTSSGAASGPSESRGTDDSTKRRRLSSTKHAPESSTSSDENLSAPPCVVTFNTGVKIMAVAAGGRHTLALSDLGQVWGWGYGGEGQLGLGSRIRTVSSPHPIPCIESALYSKDRPAAMKGNKSAEVQISKVMGNCVKAIACGGRHSAVVTDSGALLTFGWGLYGQCGQGNTDDVLSPTCVSSILGVKMQDIGAGLWHTVCTSVDGDVYSFGGNQFGQLGTGSDQAETVPKLVDASSLENKNARAVSCGARHSAIITDEGEVFCWGWNKYGQLGLGDSMDRNVPCSVPVDAYHPLNVSCGWWHTLVLAESPT

SEQ ID NO: 6573 - protein, 509 aa, Oryza sativa
MNGRGGGGGGGVGVVGAGGEEQMEMEEDGAGLRARVSAGRKERVVLMWGYLPGVSPQRSPLLGPVPVRLPAAAGGDGWRDVCGGGCGFAMAISESGKLLTWGSADDMGQSYVTAGKHEETPEAFPLPSDVAIVRADAGWAHCVAITDEGDVYTWGWKECVPTGRVISDQSSGGTLEKDERQSAIAADQVSPRSQVSRTSSGAASGPSESRGTDDSTKRRRLSSTKHAPESSTSSDENLSAPPCVVTFNTGVKIMAVAAGGRHTLALSASDLGQVWGWGYGGEGQLGLGSRIRTVSSPHPIPCIESALYSKDRPAAMKGNKSAEVQISKVMGNCVKAIACGGRHSAVVTDSGALLTFGWGLYGQCGQGNTDDVLSPTCVSSILGVKMQDIGAGLWHTVCTSVDGDVYSFGGNQFGQLGTGSDQAETVPKLVDASSLENKNARAVSCGARHSAIITDEGEVFCWGWNKYGQLGLGDSMDRNVPCSVPVDAYHPLNVSCGWWHTLVLAESPT

SEQ ID NO: 6574 - protein, 499 aa, Triticum aestivum
MNGGDGGGGEVGFVGGGGEEEEMDEDGAREAGKEQVVLMWGYLPGVSPQRSPLLGPVPVRLPPAAAGDAWRDVCGGGCGFAMAISESGKLLTWGSTDDMGQSYVTAGKHEETPEAFPLPSDVAIARADAGWAHCVAITDEGVVYTWGWKECVPTGRVIADQASVGTLEKDERQSAIANNQVSPRSQASRTSSGAASGPSESRGTEDSTKRRRLSSAKQGNDSSTSGDENLSAPPCVVTFNTGVKITAVAAGGRHTLALSDFGQVWGWGYGGEGQLGLGSRIRTVSSPHPIPCIESTSYGKDRLSAMKGNKNAEGQINKVTGNRVTAIACGGRHSVVVTDSGALLAFGWGLYGQCGQGNTDDVLSPTCVSAILGVKMQDVAAGLWHTVSISADGDVYSFGGNQFGQLGIGSDQAETIPKLVDAPSLENKNARSVSCGARHSAIITDEGEVFCWGWNKYGQLGLGDSMDRNVPCIVPVDEYHPLNVSCGWWHTLVLAESPT

SEQ ID NO: 6575 - protein, 418 aa, Avena sativa
MAISESGKLLTWGSTDDMGQSYVTAGKHEETPEAFPLPSDVAIVRADAGWAHCVAITDEGVVYTWGWKECVPTGRVVANQSSVGTLEKDERQSAVASDQVSPRSQVSRTSSGAASGPSESRGTEDSTKRRRLSSAKQGQDSSTSNDENLSAPPCIVTFNTGVKIAAVAAGGRHTLALSDFGQVWGWGYGGEGQLGLGSRIRTVSSPHPIPCIESASYGKDRSAATKGNRNTEGHINKVMGNRVKSIACGGRHSVVVTDSGALLAFGWGLYGQCGQGNTDDVLSPTCVSSILGVNMQDVAAGLWHTVCISEDGGVYSFGGNQFGQLGVGSDQAETIPKLVDAPSLDDKNARSVSCGARHSAIITDEGEVFCWGWNKYGQLGLGDSMDRNVPCIVPVDAYRPLNVSCGWWHTLVLAESPT

SEQ ID NO: 6576 - protein, 499 aa, Brachypodium distachyon
MNGGGGVEAGLGGGGEEEMDEDGVCPALGMGKEQVVLMWGYLPGVSPQRSPLLAPVPVRLPLAATGDAWRDVCGGGCGFAMAISESGKLLTWGSTDDMGQSYVTAGKHEETPEAFPLPSDVVIARADTGWAHCVAITEEGVVYTWGWKECVPTGTVIADQSSVGTLERDESQSASASNQVSPRSHVSSRTSSGAASGPSESRGAEESTKRRRLSSAKQGPDSSTSSDENLSAPPCIVTFNTGVKITAVAAGGRHTLALSDFGQVWGWGYGGEGQLGLGSRIRTVSSPHPIPCIESALYGKDRPAAMKGNKNAETQISKVMGNCVKAIACGGRHSVVVTDSGTLLTFGWGLYGQCGQGNTDDVLSPTCVSSILGVKMEGAAAGLWHTVCISVDGDVYSFGGNQFGQLGTGSDEAETVPKLVDASCLENKNARTVSCGARHSAIITDESEVFCWGWNKYGQLGLGDSMDRNVPCIVPMDAYRALNVSCGWWHTLVLAESPT

SEQ ID NO: 6577 - protein, 462 aa, Brachypodium distachyon
MWGYLPGVSPQRSPLLAPVPVRLPLAATGDAWRDVCGGGCGFAMAISESGKLLTWGSTDDMGQSYVTAGKHEETPEAFPLPSDVVIARADTGWAHCVAITEEGVVYTWGWKECVPTGTVIADQSSVGTLERDESQSASASNQVSPRSHVSSRTSSGAASGPSESRGAEESTKRRRLSSAKQGPDSSTSSDENLSAPPCIVTFNTGVKITAVAAGGRHTLALSDFGQVWGWGYGGEGQLGLGSRIRTVSSPHPIPCIESALYGKDRPAAMKGNKNAETQISKVMGNCVKAIACGGRHSVVVTDSGTLLTFGWGLYGQCGQGNTDDVLSPTCVSSILGVKMEGAAAGLWHTVCISVDGDVYSFGGNQFGQLGTGSDEAETVPKLVDASCLENKNARTVSCGARHSAIITDESEVFCWGWNKYGQLGLGDSMDRNVPCIVPMDAYRALNVSCGWWHTLVLAESPT

SEQ ID NO: 6578 - protein, 461 aa, Secale cereale
MWGYLPGVSPQRSPLLGPVPVRLPPAAAGDAWRDVCGGGCGFAMAISESGKLLTWGSTDDMGQSYVTAGKHEETPEAFPLPSDVAIARADAGWAHCVAITDEGVVYTWGWKECVPTGRVIADQASVGTLEKDERQSAIANNQVSPRSQASRTSSGAASGPSESRGTEDSTKRRRLSSAKQGNDSSTSGDENLSAPPCVVTFNTGVRITAVAAGGRHTLALSDFGQVWGWGYGGEGQLGLGSRIRTVSSPHPIPCIESTSYGKDRLSAMKGNKNAEGQINKVTGNRVTAIACGGRHSVVVTDSGALLAFGWGLYGQCGQGNTDDVLSPTCVSAILGVKMQDVAAGLWHTVSISADGDVYSFGGNQFGQLGIGSDQAETIPKLVDAPSLENKNARSVSCGARHSAIITDEGEVFCWGWNKYGQLGLGDSMDRNVPCIVPVDAYHPLNVSCGWWHTLVLAESPT

SEQ ID NO: 6579 - protein, 461 aa, Triticum aestivum
MWGYLPGVSPQRSPLLGPVPVRLPPAAAGDAWRDVCGGGCGFAMAISESGKLLTWGSTDDMGQSYVTAGKHEETPEAFPLPSDVTIARADAGWAHCVAITDEGVVYTWGWKECVPTGRVITDQASVGTLEKDERQSAIANNQVSPRSQASRTSSGAASGPSESRGTEDSTKRRRLSSAKQGNDSSTSGDENLSAPPCVVTFNTGVKITAVAAGGRHTLALSDFGQVWGWGYGGEGQLGLGSRIRTVSSPHPIPCIESTSYGKDRLSAMKGNKNAEGQINKVTGNRVTAIACGGRHSVVVTDSGALLAFGWGLYGQCGQGNTDDVLSPTCVSAILGVKMQDVAAGLWHTVSISADGDVYSFGGNQFGQLGIGSDQAETIPKLVDAPSLENKNARSVSCGARHSAIITDEGEVFCWGWNKYGQLGLGDSMDRNVPCIVPVDEYHPLNVSCGWWHTLVLAESPT

SEQ ID NO: 6580 - protein, 266 aa, Setaria italica
MAAQALLSGRQLLGRPVQAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGLIPPETALPWFKTGVIPPAGTYNYWADSYTLFVFNMALMGFAEHRRLQDWYNPGSMGKQYFLGLEKFLAGSGDPSYPGGPLFNPLGFGKTEKEMKELKLKEIKNGRLAMLAILGYFIQGLVTGVGPFQNLLDHLADPVNNNVLTSLKFH

SEQ ID NO: 6581 - protein, 266 aa, Pennisetum glaucum
MAAQALLSGRQLLGRPVQAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGLIPPETALPWFKTGVIPPAGTYNYWADSYTLFVFNMALMGFAEHRRLQDWYNPGSMGKQYFLGLEKFLGGSGDPSYPGGPLFNPLGFGKTEKEMNELKLKEIKNGRLAMLAILGYFIQGLVTGVGPFQNLLDHLSDPVNNNVLTSLKFH

SEQ ID NO: 6582 - protein, 268 aa, Panicum virgatum
MAAQALLSGRQLLGRPVQSAVSRSSSARKAPFVVRASSSPPAKQGADRQLWFASKQSLSYLDGTLPGDYGFDPLGLSDPEGTGGFIEPKWLAYGEVINGRFAMLGAAGAIAPEIFGKLGIIPAETALPWFKTGVIPPAGTYNYWADSYTLFVFNMALMGFAEHRRLQDWYNPGSMGKQYFLGLEKFLGGSGDPSYPGGPLFNPLGFGKTEKEMKELKLKEIKNGRLAMLAILGYFIQGLVTGVGPYQNLLDHLADPVNNNVLTSLKFH

SEQ ID NO: 6583 - protein, 268 aa, Panicum virgatum
MAAQALLSGRQLLGRPVQSAVSRSSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPAETALPWFKTGVIPPAGTYNYWADSYTLFVFNMALMGFAEHRRLQDWYNPGSMGKQYFLGLEKFLGGSGDPSYPGGPLFNPLGFGKTEKEMKELKLKEIKNGRLAMLAILGYFIQGLVTGVGPYQNLLDHLADPVNNNVLTSLKFH

SEQ ID NO: 6584 - protein, 262 aa, Sorghum bicolor
MAAQALLSRPAVQSAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPPETALPWFKTGVIPPAGTYNYWADSYTLFVFNMALMGFAEHRRLQDWYNPGSMGKQYFLGLEKFLAGSGDPSYPGGPLFNPLGFGKTEKEMNELKLKEIKNGRLAMLAILGYFIQGLVTGVGPFQNLLDHLSDPVNNNVLTSLKFH

SEQ ID NO: 6585 - protein, 267 aa, Cynodon dactylon
MATQALLSGRQLLGRPVQSAVSRASSSRKPFVVRASSSPPAKQGADRQLWFASKQSLTYLDGTLPGDFGFDPLGLSDPEGTGGFIEPKWLAYGEVINGRFAMLGAAGAIAPEIFGKLGLIPEETALPWFKTGVIPPAGTYNYWADPYTLFVFNMALMGFAEHRRLQDWYNPGSMGKQYFLGLEKFLAGSGDPAYPGGPIFNPLGFGKDEKSMKELKLKEIKNGRLAMLAILGYFIQGLVTGVGPYQNLLDHLSDPVNNNVLTSLKFH

SEQ ID NO: 6586 - protein, 243 aa, Saccharum officinarum
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPPETALPWFKTGVIPPAGTYNYWADSYTLFVFNMALMGFAEHRRLQDWYNPGSMGKQYFLGLEKFLAGSGDPFYPGGPLFNPLGFGKTEKEMNELKLKEIKNGTLAMLGILGYFIQGLVTGVG

SEQ ID NO: 6587 - protein, 276 aa, Phalaenopsis aphrodite
MTSAQALLSSMEAGRQLLGGRILQSSSSSKNIGSQRRPSFVVRASSSPPARQGADRQLWFASKQSLSYLDGSLPGDYGFDPLGLSDPEGTGGFIEPKWLAYGEVINGRYAMLGAVGAIAPEILGKLGLIPPETALPWFKTGVIPPAGTYDYWADPYTLFVFEMALMGFAEHRRFQDWANPGSMGKQYFLGLEKFLGGSGDPAYPGGPLFNPLGFGKDEKSFKELKLKEVKNGRLAMLAILGYFIQGLVTGVGPFQNLLDHLADPVNNNVLTSLKFH

SEQ ID NO: 6588 - protein, 276 aa, Phalaenopsis aphrodite
MTSAQALLSSMEAGRQLLGGRILQSSSSSKNIGSQRRPSFVIRASSSPPARQGADRQLWFASKQSLSYLDGSLPGDYGFDPLGLSDPEGTGGFIEPKWLAYGEVINGRYAMLGAVGAIAPEILGKLGLIPPETALPWFKTGVIPPAGTYDYWADPYTLFVFEMALMGFAEHRRFQDWANPGSMGKQYFLGLEKFLGGSGDPAYPGGPLFNPLGFGKDEKSFKELKLKEVKNGRLAMLAILGYFIQGLVTGVGPFQNLLDHLADPVNNNVLTSLKFH

SEQ ID NO: 6589 - protein, 275 aa, Manihot esculenta
MATQALVSSSLTSSVETARQILGARPSQSSFGSSRKSSFVVRASSTPPVKQGADRQLWFASKQSLSYLDGSLPGDYGFDPLGLSDPEGTGGFIEPKWLAYGEVINGRYAMLGAVGAIAPEILGKAGLIPAETALPWFKTGVIPPAGTYDYWADPYTLFVLEMALMGFAEHRRFQDWANPGSMGKQYFLGLEKYLGGSGDPAYPGGPLFNPLGFGKDEKSMKELKLKEVKNGRLAMLAILGYFIQGLVTGVGPYQNLLDHLADPVNNNVLTSLKFH

SEQ ID NO: 6590 - protein, 274 aa, Musa acuminata
MATQAFLSSVEAGRQLLGGRPLRSAPSRSLGSSRKASFAVRAASTPPVKQGADRQLWFASKQSLTYLDGSLPGDYGFDPLGLSDPEGTGGFIEPKWLAYGEVINGRYAMLGAVGAIAPEIFGKLGWIPPETALPWFKTGVFPPAGTYNYWADPYTLFVLEMALMGFAEHRRFQDWANPGSMGKQYFLGLEKWLGGSGNPIYPGGPLFNPLGFGKDEKSMNDLKLKEVKNGRLAMLAILGYFAQAALTGVGPFQNLLDHLADPVHNNILTSFKFH

SEQ ID NO: 6591 - protein, 274 aa, Elaeis guineensis
MATQTLLSSMEAGRQLLGGRPLQSTPSRSFGSPRKASFVVRAASTPPAKQGADRQLWFASKQSLTYLDGSLPGDYGFDPLGLSDPEGTGGFIEPKWLAYGEVINGRYAMLGAVGAIAPEILGQLGLIPAETALPWFKTGVIPPAGTYNYWADPYTLFVFEMALMGFAEHRRFQDWAKPGSMGKQYFLGLEKYLGGSGNPIYPGGPLFNPLGFGKDEKSMKDLKLKEVKNGRLAMLAIVGYFVQALATGVGPYQNLLDHLADPVNNNILTSLKFH

SEQ ID NO: 6592 - protein, 275 aa, Allium cepa
MTTQALLSSMEAGRQLLGGRPLTSSTVSRSFGTSRRGSFVVKAASTPPVKQGANRQLWFASKQSLSYLDGSLPGDFGFDPLGLSDPEGTGGFIEPKWLAYGEVINGRYAMLGAAGAIAPEILGKLGWIPPETALPWFQTGVIPPAGTYNYWADPFTLFVLEMALMGFAEHRRFQDWAKPGSMGKQYFLGFEKFLGGSGDPAYPGGPLFNPLGFGKTEKAMKELKLKEIKNGRLAMLAVLGYFIQGLVTGVGPYQNLLDHLADPVNNNILTSLKFH

SEQ ID NO: 6593 - protein, 216 aa, Allium cepa
MTTQALLSSMEAGRQLLGGRPLTSSTVSRSFGTSRRGSFVVKAASTPPVKQGANRQLWFASKQSLSYLDGSLPGDFGFDPLGLSDPEGTGGFIEPKWLAYGEVINGRYAMLGAAGAIAPEILGKLGWIPPETALPWFQTGVIPPAGTYNYWADPFTLFVLEMALMGFAEHRRFQDWAKPGSMGKQYFLGFEKFLWWVRRSSLPWWAPVQPVGLRQN

SEQ ID NO: 6594 - protein, 274 aa, Cucurbita pepo
MATQALVSSSSLTSSVGAARQRLGPKPSLGSSRKAASFVVRAEATPPVKQGANRQLWFASKQSLTYLDGSLPGDYGFDPLGLSDPEGTGGFIEPKWLAYGEVINGRFAMLGAAGAIAPEIFGSLGLIPPETALPWFKTGVIPPAGTYNYWADPYTLFVLEMALMGFAEHRRFQDWYNPGSMGKQYFLGLEKFLGGSGDPAYPGGPLFNPLGFGKDEKSMKELKLKEIKNGRLAMLAILGYFIQGLVTGVGPYQNLLDHLSDPVNNNVLTSLKFH

SEQ ID NO: 6595 - protein, 272 aa, Taraxacum officinale
MATQALVSSSSLTSSVESARQILAQRPVLHSSRKVNFVVKASSSPPVKQGDRQLWFASKQSLSYLDGSLPGDFGFDPLGLSDPEGTGGFIEPKWLAYGEVINGRFAMLGAAGAIAPEVFGKLGLIPPETALPWFQTGVIPPAGTYNYWADNYTLFVLEMALMGFAEHRRLQDWYNPGSMGKQYFLGLEKGFSGSGDPAYPGGPFFNPLGFGKDEKSMKELKLKEIKNGRLAMLAILGYFIQALVTGVGPFQNLLDHLADPVNNNLLTSLKFH

SEQ ID NO: 6596 - protein, 276 aa, Juglans hindsii x Juglans regia
MATQALVSSSSLTSSVVATRQILGPRSLQSPIGSSRKASFIVRAASTPPVKQGADRPLWFASKQSLSYLDGSLPGDYGFDPLGLSDPEGTGGFIEPKWLAYGEVINGRYAMLGAVGAIAPEILGKLGLIPPETALPWFKTGVIPPAGTYNYWADPYTLFVFEMALMGFAEHRRFQDWAKPGSMGKQYFLGFEKYLGGSGDPAYPGGPLFNPLGFGKDEKSLKDLKLKEVKNGRLAMLAILGYFIQGLVTGVGPFQNLLDHLADPVNNNVLTSLKFH

SEQ ID NO: 6597 - protein, 269 aa, Brachypodium distachyon
MAAQGLLSGRQLLGRPLQSSFSRSSSSRKSPFIVRAESSPPAKQNDNRQLWFASKQSLSYLDGTLPGDFGFDPLGLSDPEGTGGFIEPKWLAYGEVFNGRTAMMGVVGMIAPEALGKVGLVPPETAIPWFQAGAIPPAGTYQYWADPYTLFVFEMALIGFAEHRRLQDWYNPGSMGKQYFLGLEKFLGGSGDPAYPGGPIFNPLGFGTKSDKELAELKLKEIKNGRLAMLAFLGMSIQAIFTGVGPFQNLLDHLSDPVNNNILTSLKFH

SEQ ID NO: 6598 - protein, 269 aa, Oryza sativa
MAAQALLSGRQLLGRPLQSSVSRSSSSRKAPFMVRAEATPPAKQGADRQLWFASKQSLSYLDGTLPGDFGFDPLGLSDPEGTGGFIEPRWLAYGEVFNGRTAMMGVVGMVAPELLGKLGLVPAETAIPWFQTGVIPPAGTYTYWADPYTLFVFELALVGFAEHRRFQDWYTPGSMGKQYFLGLEKYLAGSGEPAYPGGPLFNPLGFGTKSEAEMKELKLKEIKNGRLAMLAFLGFSVQALFTGVGPVQNLLDHLADPVHNNILTSLKFH

SEQ ID NO: 6599 - protein, 204 aa, Arnica chamissonis
SSLISSVESARQMLGARPLHTPSRKISFLVKASSSPPVKQGANRQLWFASKQSLSYLDGSLPGDFGFDPLGLSDPEGTGGFIEPKWLAYGEVINGRFAMLGAAGAIAPEIFGKLGLIPAETALPWFKTGVIPPAGTYNYWADPFTLFVLEMALMGFAEHRRLQDWYNPGSMGKQYFWVWRKDFRVGRSSIPGRAVLQPIRVWKR

SEQ ID NO: 6600 - protein, 166 aa, Flaveria ramosissima
MLGAAGAIAPEILGKLGLIPAETALPWFKTGVIPPAGTYDYWADPFTLFVLEMALMGFAEHRRLQDWYNPGSMGKQYFLGLEKGFAGSGDPAYPGGPFFNPLGFGKDEKSMKELKLKEIKNGRLAMLAILGYFIQGLVTGVGPYQNLLDHLADPVNNNVLTSLKFH

SEQ ID NO: 6601 - protein, 273 aa, Amsonia hubrichtii
MATQALISSSSITASAEATRQILGARSVQSSTRKVSFVVRAASTPPAKQGADRQLWFASKQSLSYLDGSLPGDYGFDPLGLSDPEGTGGFIEPKWLAYGEVINGRYAMLGAVGAIAPEILGKAGLIPAETALPWFKTGVIPPAGTYDYWADPYTLFVFEMALMGFAEHRRFQDWAKPGSMGKQYFLGFEKYLGGSGDPAYPGGPIFNPLGFGKDEKSMKDLKLKEIKNGRLAMLAILGYFVQGLVTGVGPYQNLLDHLSDPVNNNVLTSLKFH

SEQ ID NO: 6602 - protein, 266 aa, Allium cepa
MEAGRQLLGGRPLTGGTVSRSFGTSRRASFVVKAASTPPVKQGANRQLWFASKQSLSYLDGSLPGDFGFDPLGLSDPEGTGGFIEPKWLAYGEVINGRFAMLGAAGAIAPEIFGKLGLIPAETALPWFQTGVIPPAGTYSYWADPFTLFVLEMALMGFAEHRRFQDWAKPGSMGKQYFLGFEKFLGGSGDPAYPGGPIFNPLGFGKTEKAMKELKLKEIKNGRLAMLAILGYFIQGLVTGVGPYQNLLDHLADPVNNNVLTSLKFH

SEQ ID NO: 6603 - protein, 269 aa, Unknown
  Sequence found in Organisms: Hordeum vulgare, Pseudoroegneria spicata
MAAQGLLSGRQLLGRPLQSSFSRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6604 - protein, 263 aa, Papaver somniferum
EAARQVFRGRPLQYATVNVGSSRKGSFVVRAAATPPVKQGANRQLWFASKQSLSYLDGSLPGDFGFDPLGLSDPEGTGGFIEPKWLAYGEIINGRFAMLGAAGAIAPEVFGKLGLIPPETALPWFQTGVIPPAGTYSYWADPFTLFVLEMALMGFAEHRRLQDWYNPGSMGKQYFLGLEKGLGGSGNPAYPGGPFFNPLGFGKDEKSMNELKLKEVKNGRLAMLAILGYFIQGLVTGVGPFQNLLDHLADPVNNNVLTSLKFH

SEQ ID NO: 6605 - protein, 269 aa, Secale cereale
MAAQGLLSGRQLLGRPLQSSISRSSSSRKSAFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLADPVNNNILTSLKFH

SEQ ID NO: 6606 - protein, 269 aa, Triticum aestivum
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6607 - protein, 274 aa, Tragopogon dubius
MAAQALVSSSSLSSSVESARQILAARPLITPPSRKVSFIVKAASTPPVKQGANRQLWFASKQSLSYLDGSLPGDFGFDPLGLSDPEGTGGFIEPKWLAYGEVINGRFAMLGAAGAIAPEIFGKLGLIPPETALPWFQTGVIPPAGTYNYWADPYTLFVLEMALMGFAEHRRLQDWYNPGSMGKQYFLGMEKGFAGSGDPAYPGGPFFNPLGFGKDEKSMKELKLKEIKNGRLAMLAILGYFIQGLVTGVGPFQNLLDHLADPVNNNLLTSLKFH

SEQ ID NO: 6608 - protein, 274 aa, Cichorium intybus
MATQALVSSSSLTSSVESARQILAARPLHSTSSRKVSFVVKAASTPPVKQGANRQLWFASKQSLSYLDGSLPGDFGFDPLGLSDPEGTGGFIEPKWLAYGEVINGRFAMLGAAGAIAPEIFGKLGLIPPETALPWFQTGVIPPAGQYNYWADPYTLFVLEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFQNLLDHLADPVNNNLLTSLKFH

SEQ ID NO: 6609 - protein, 273 aa, Cirsium arvense
MATQALVSSSSLTSSVESARQIFGARPLLSSSRKLSFLVKAASTPPVKQGANRQLWFASKQSLSYLDGSLPGDFGFDPLGLSDPEGTGGFIEPRWLAYGEVINGRFAMLGAAGAIAPEIFGKLGLIPPETALPWFQTGVIPPAGTYNYWADPYTLFVMEMAFMGFAEHRRFQDWYNPGSMGKQYFLGLEKGFSGSGDPAYPGGPFFNPLGFGKDEKSMKELKLKEIKNGRLAMLAILGYFIQGLVTGVGPFQNLLDHLADPVNNNVLTSLKFH

SEQ ID NO: 6610 - protein, 274 aa, Lactuca sativa
MATQALVSSSSLTSSVESARQILAARPLHTTSSRKVSFVVKAASTPPVKQGANRQLWFASKQSLSYLDGSLPGDFGFDPLGLSDPEGTGGFIEPKWLAYGEVINGRFAMLGAAGAIAPEIFGKLGLIPPETALPWFKTGVIPPAGTYNYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPFENLLDHLADPVNNNVLTSLKFH

SEQ ID NO: 6611 - protein, 273 aa, Cucumis melo
MATQALVSSSLTSSVGAARQRLGAKPSFGSSRKSASFVVRAGATPPVKQGADRQLWFASKQSLTYLDGSLPGDFGFDPLGLSDPEGTGGFIEPKWLAYGEVINGRFAMLGAAGAIAPEIFGSLGLIPPETALPWFKTGVIPPAGTYNYWADPYTLFVLEMALMGFAEHRRFQDWAKPGSMGKQYFLGLEKFLGGSGDPAYPGGPLFNPLGFGKDEKSMKELKLKEIKNGRLAMLAILGYFIQGLVTGVGPYQNLLDHLSDPVNNNILTSLKFH

SEQ ID NO: 6612 - protein, 95 aa, Flaveria ramosissima
MATQALASSSSLTSSVESARQIGEASHFTHQQERSLFLSKLLPPLLLSKELTDNCGLHPNSLFLTLMEVSQVTLDLTHLVFQTQKGPVGSSNPSG

SEQ ID NO: 6613 - protein, 272 aa, Lippia dulcis
MATQALVSSSSICSSAEATRRAFGGRSVRSSRKVSFVVKASSTPPVKQGADRQLWFASEQSLSYLDGSLPGDFGFDPLGLSDPEGPGGFIEPRWLAYGEIINGRYAMLGAVGAIAPEILGKAGLIPPETALPWFKTGVIPPAGTYDYWADPYTLFVLEMALMGFAEHRRFQDWYNPGSMGKQYFLGLEKGFAGSGDPAYPGGPFFNPLGFGKDEKSMKELKLKEVKNGRLAMLAILGYFIQGLVTGVGPFQNLLDHLADPVHNNVLTSLKFH

SEQ ID NO: 6614 - protein, 276 aa, Prunus persica
MATQALVSSSSLTASKEAARHLLGGKAVQSPFGSRKSASFVVRAASTPPVKQGADRQLWFASKQSLTYLDGSLPGDFGFDPLGLSDPEGTGGFIEPRWLAYGEVINGRYAMLGAVGAIAPEILGKLGLIPPETALPWFQTGVIPPAGTYNYWADPYTLFVFELALMGFAEHRRFQDWYNPGSMGKQYFLGLEKYLGGSGDPAYPGGPLFNPLGFGKDEKSLKDLKLKEVKNGRLAMLAILGYFIQGLVTGVGPFQNLLDHLADPVNNNVLTSLKFH

SEQ ID NO: 6615 - protein, 282 aa, Aristolochia fimbriata
MAAATQALVSVASSSSSMEAGRQLLGGRPLQTLPSRSVGSPRRSSFVVRAASTPPAKQGANRQLWFASKQSLSYLDGTLPGDYGFDPLGLSDPEGTGGFIEPKWLAYGEVINGRFAMLGAVGAIAPEIFGKLGLIPAETALPWFKTGVIPPAGTYNYWADPYTLFVFEMALMGFAEHRRFQDWANPGSMGKQYFLGLEKGLGGSGDPAYPGGPFFNPLGFGKDEKSMKDLKLKEIKNGRLAMLAILGYFIQGLVTGVGPFQNLLDHLSDPVNNNVLTSLKFH

SEQ ID NO: 6616 - protein, 272 aa, Linum usitatissimum
MAAQALLSSSLTSSVESARQILGPRTRFGSSRKGSFVVRAASTPPVKQGADRQLWFASKQSLSYLDGSLPGDFGFDPLGLSDPEGTGGFIEPKWLAYGEIINGRFAMLGAAGAIAPEILGKAGLIPAETALPWFQTGVIPPAGTYSYWADSYTLFVLEMALMGFAEHRRLQDWYNPGSMGKQYFLGFEKFLGGSGDPAYPGGPIFNPLGFGKDEKSLKELKLKEVKNGRLAMLAILGYFIQGLVTGVGPYQNLLDHLADPVNNNILTSLKFH

SEQ ID NO: 6617 - protein, 269 aa, Triticum aestivum
MAAQGLLSGRQLLGRPLQSSISRSSSSRKSAFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6618 - protein, 269 aa, Cucumis sativus
ALVSSSLTSSVGAARQRLGARPSFGSSRKSASFVVRAEATPPVKQGADRQLWFASKQSLSYLDGSLPGDFGFDPLGLSDPEGTGGFIEPRWLAYGEVINGRFAMLGAAGAIAPEIFGSLGLIPPETALPWFKTGVIPPAGTYNYWADPYTLFVFEMALMGFAEHRRFQDWAKPGSMGKQYFLGLEKFLGGSGDPAYPGGPLFNPLGFGKDEKSMKELKLKEIKNGRLAMLAILGYFIQGLVTGVGPYQNLLDHLSDPVNNNVLTSLKFH

SEQ ID NO: 6619 - protein, 272 aa, Helianthus annuus
MATQALVSSSLTSSVESARQILGARSLHTPSRKVSFVVKAASTPPVKQGANRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6620 - protein, 287 aa, Papaver somniferum
MATHTLVSSSLTSSSLTSSSSSSMEAARQVFRGRPLQYATVNVGSSRKGSFVVRAAATPPVKQGANRQLWFASKQSLSYLDGSLPGDFGFDPLGLSDPEGTGGFIEPKWLAYGEIINGRFAMLGAAGAIAPEVFGKLGLIPPETALPWFQTGVIPPAGTYSYWADPFTLFVLEMALMGFAEHRRLQDWYNPGSMGKQYFLGLEKGLGGSGNPAYPGGPFFNPLGFGKDEKSMKELKLKEVKNGRLAMLAILGYFIQGLVTGVGPFQNLLDHLADPVNNNVLTSLKFH

SEQ ID NO: 6621 - protein, 281 aa, Papaver somniferum
ATQTLVSSSLTSSSSSSMEAARQVFRGRPLQYATVNVGSSRKGSFVVRGAATPPVKQGANRQLWFASKQSLSYLDGSLPGDFGFDPLGLSDPEGTGGFIEPKWLAYGEIINGRFAMLGAAGAIAPEVFGKLGLIPPETALPWFQTGVIPPAGTYSYWADPFTLFVLEMALMGFAEHRRLQDWYNPGSMGKQYFLGLEKGLGGSGNPAYPGGPFFNPLGFGKDEKSMNELKLKEVKNGRLAMLAILGYFIQGLVTGVGPFQNLLDHLADPVNNNVLTSLKFH

SEQ ID NO: 6622 - protein, 166 aa, Flaveria ramosissima
MLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6623 - protein, 269 aa, Flaveria ramosissima
PCFIHSSLTSSVESARQILGARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6624 - protein, 212 aa, Ipomoea batatas
AQALISSSSIASSAEAARQVLGARPVQSSSRKVSFVVRAASTPPVKQGTDRQLWFASKQSPTYLDGSLPGDYGFDPLGLSDPEGPGGFIEPRWLAYGEVINGRYAMMGAVGAIAPEILGKLGLIPPETALPWFKTGVIPPAGTYNYWADPYTLFVFEMALMGFAEHRRFQDWANPGSMGKQYFLGLEKGLGGSGDPAYPGGPIFNPLGVWQR

SEQ ID NO: 6625 - protein, 214 aa, Ipomoea batatas
MAAQALISSSSITSSAEVARQVLGGRPLQSSRKVSFVVRASSSTPPVKQGADRPLWFASKQSLSYLDGSLPGDYGFDPLGLSDPEGTGGFIEPKWLAYGEIINGRFAMLGAVGAIAPEILGKAGLIPAETALPWFKTGVIPPAGTYNYWADPYTLFVLEMALMGFAEHRRFQDWAKPGSMGKQYFLGLEKGLGGSGDPAYPGWTSLQPPWIWKG

SEQ ID NO: 6626 - protein, 273 aa, Artemisia annua
MATQALVSSSSLTSSVEANRQILSGRTLQVSSRKVSFVVKAAATPPVKQNTNRQLWFASKQSLSYLDGSLPGDFGFDPLGLSDPEGTGGFIEPKWLAYGEVINGRFAMLGAAGAIAPEIFGKLGLIPAETALPWFKTGVIPPAGTYNYWADPFTLFVFEMALMGFAEHRRLQDWYNPGSMGKQYFLGLEKGFSGSGDPAYPGGPFFNPLGFGKDEKSMKELKLKEIKNGRLAMLAILGYFIQGLVTGVGPFQNLLDHLADPVNNNVLTSLKFH

SEQ ID NO: 6627 - protein, 263 aa, Flaveria ramosissima
SLTSSVESARQILGARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6628 - protein, 273 aa, Helianthus annuus
MATQALASSSSLSSSVESARQILGARPLHTSSRKVSFLVKAASTPPVKQGANRQLWFASKQSLSYLDGSLPGDYGFDPLGLSDPEGTGGFIEPKWLAYGEVINGRFAMLGAAGAIAPEIFGKLGLIPAETALPWFKTGVIPPAGTHDYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFENLLDHLADPVNNNVLTSLKFH

SEQ ID NO: 6629 - protein, 140 aa, Flaveria ramosissima
MVQDRCHPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6630 - protein, 270 aa, Vaccinium corymbosum
MATQALLSSSIASSVEATRKIVGGRPTQSPRRVSFVVRAASTPPVKQGDRPLWFASKQSLSYLDGSLPGDYGFDPLGLSDPEGTGGFIEPKWLAYGEVINGRYAMLGVVGCLAPEILGKLGLIPPETALPWFQTGVIPPAGTYNYWADPYTLFVLELALMGFAEHRRFQDWYNPGSMGKQYFLGLEKFLGGSGDPAYPGGPLFNPLGFGKDEKSMKELKLKEVKNGRLAMLAILGFFIQGLVTGVGPFQNLLDHLADPVNNNVLTSLKFH

SEQ ID NO: 6631 - protein, 273 aa, Beta vulgaris
MATQALVSSSLTSSVETARQILGARSGISPSSKKNSFVVRASATPPVKQGANRPLWFASKQSLSYLDGSLPGDFGFDPLGLSDPEGTGGFIEPRWLAYGEIINGRFAMLGAAGAIAPEILGKAGLIPAETALPWFQTGVIPPAGTYNYWADPYTLFVFEMALMGFAEHRRLQDWYNPGSMGKQYFLGLEKGFAGSGDPAYPGGPIFNPLGFGKDEKSMKELKLKEVKNGRLAMLAILGYFIQGLVTGVGPYQNLLDHLADPVNNNVLTSLKFH

SEQ ID NO: 6632 - protein, 270 aa, Gerbera hybrid cultivar
QALASSSSLTSSMEVARQLLGARPLHSSSRKISFLVKAASTPPVKQGADRQLWFASKQSLSYLDGSLPGDYGFDPLGLSDPEGTGGFIEPKWLAYGEVFNGRFAMLGAVGAIAPEIFGKLGLIPAETALPWFKTGVIPPAGTYDYWADPYTLFVFEMALMGFAEHRRFQDWYNPGSMGKQYFLGLEKGFAGSGDPAYPGGPFFNPLGFGKDEKSLKDLKLKEIKNGRLAMLAILGYFIQGLVTGVGPFQNLLDHLADPVNNNVLTSLKFH

SEQ ID NO: 6633 - protein, 102 aa, Triticum aestivum
MAAQGLLSGRQLLGRPLQSSISRSSSSRKSAFVVRASSSPLPSKMTTGSCGSRPSSPSPTWTARCPVTLASTPWGCPTRRAPAGSSSPGGWPTARSSTAGRR

SEQ ID NO: 6634 - protein, 277 aa, Malus domestica
MAAQALVSSSSLTASKEVARQIFGGTKAVQSPFGSRKSASFVVRAASTPPVKQGADRQLWFASKQSLSYLDGSLPGDFGFDPLGLSDPEGTGGFIEPRWLAYGEVINGRYAMLGAVGAIAPEILGKLGLIPAETALPWFQTGVIPPAGTYNYWADPYTLFVFELALMGFAEHRRFQDWYNPGSMSKQYFLGLEKYLGGSGNPAYPGGPLFNPLGFGKDEKSMNELKLKEVKNGRLAMLAILGYFIQGLVTGVGPYQNLLDHLADPVNNNILTSLKFH

SEQ ID NO: 6635 - protein, 268 aa, Unknown
  Sequence found in Organisms: Festuca arundinacea, Lolium multiflorum
MAAQGLLSGRQLLGRPLQSSISRSSSSRKSSFIVRASSSPPAKQGNRQLWFASKQSLTYLDGTLPGDFGFDPLGLSDPEGTGGFIEPRWLAYGEIFNGRTAMMGVVGMIAPEALGKVGLVPSETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6636 - protein, 273 aa, Actinidia deliciosa
MATQALVSSASLTSSVESARQILRGRSALTPARKVSFVVRAASTPPVKQGADRPLWFASKQSLSYLDGSLPGDYGFDPLGLSDPEGTGCFIEPKWLAYGEVFNGRCAMMGAVGAIAPEILGKLGLIPQETALPWFKTGVIPPAGTYTYWADNYTLFVFEMALVGFAEHRRFQDWYNPGSMGKQYFLGLEKYLGGSGDPAYPGGPIFNPLGFGKDEKSMRDLKLKEIKNGRLAMLAILGYFIQAPVTGVGPFQNLLDHLADPVNNNLLTSLKFH

SEQ ID NO: 6637 - protein, 269 aa, Leymus cinereus x Leymus triticoides
MAAQGLLSGRQLLGRPLQSSFSRSSSSRKSPFIVRAESSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6638 - protein, 269 aa, Avena sativa
MAAQGLLSGRQLLGRPLQSSISRSSSSRKSSFIVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6639 - protein, 115 aa, Triticum aestivum
MALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6640 - protein, 273 aa, Plantago ovata
MATQALVSSSSICSSADVARQTFGGIRPLHSSRKVCFVVKAASSPPVKSGADRPLWFASKQSLSYLDGSLPGDYGFDPLGLSDPEGTGGFIEPKWLAYGEVINGRFAMLGAAGAIAPEILGKAGLIPPETALAWFQTGVIPPAGTYNYWADGYTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6641 - protein, 273 aa, Citrullus lanatus
MATQALVSSSLTSSVGAARQRLGAKPSFGSSRKSASFVVRAQATPPVKQGADRQLWFASKQSLSYLDGSLPGDYGFDPLGLSDPEGTGGFIEPRWLAYGEVINGRFAMLGAAGAIAPEIFGSLGLIPPETALPWFKTGVIPPAGTYNYWADPYTLFVLEMALMGFAEHRRFQDWSKPGSMGKQYFLGLEKFLGGSGDPAYPGGPLFNPLGFGKDEKSLKDLKLKEVKNGRLAMLAILGYFVQGLVTGVGPYQNLLDHLSDPVNNNVLTSLKFH

SEQ ID NO: 6642 - protein, 273 aa, Ambrosia trifida
MATQALASSSSLTSSVESARQILGARPLHTSSRKVSFVVKAASTPPVKQGANRQLWFASKQSLSYLDGSLPGDYGFDPLGLSDPEGTGGFIEPKWLAYGEVINGRFAMLGAAGAIAPEIFGKLGLIPPETALPWFKTGVIPPAGTYEYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFQNLLDHLADPVNNNVLTSLKFH

SEQ ID NO: 6643 - protein, 273 aa, Castanea mollissima
MATQALVSSSSLTSSVEAARKVLGARSSIGSSRKASFSVRAATTPPVKQGADRPLWFASKQSLTYLDGSLPGDYGFDPLGLSDPEGTGGFIEPRWLAYGEVINGRYAMLGAVGAIAPEILGQLGLIPPETALPWFKTGVIPPAGTYDYWADPYTLFVFELALMGFAEHRRFQDWYNPGSMSKQYFLGLEKYLGGSDNPAYPGGPLFNPLGFGKDEKSLNDLKLKEIKNGRLAMLAILGYFVQGLVTGVGPYQNLLDHLADPVNNNVLTSLKFH

SEQ ID NO: 6644 - protein, 273 aa, Flaveria ramosissima
MATQALASSSSLTSSVESARQILGARPFQTPSRKISFLSKLLPPLLVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFAGSGDPAYPGGPFFNPLGFGKDEKSMKELKLKEIKNGRLAMLAILGYFIQGLVTGVGPYQNLLDHLADPVNNNVLTSLKFH

SEQ ID NO: 6645 - protein, 114 aa, Flaveria ramosissima
MALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6646 - protein, 207 aa, Flaveria ramosissima
MEVSQVTLDLDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6647 - protein, 135 aa, Vaccinium corymbosum
MATQALLSSSIASSVEATRKIVGGRPTQSPRRVSFVVRAASTPPVKQGDRPLWFASKQSLSYLDGSLPGDYGFDPLGLSDPEGTGGFIEPKWLAYGEVINGRYAMLGVVGCLAPEILGKLGLIPPETALPWFQTG

SEQ ID NO: 6648 - protein, 273 aa, Ricinus communis
MATQALVSSSLTSSVETARQILGARSSFGSSRKSSSFVVRASSTPPVKQGADRQLWFASKQSLTYLDGSLPGDFGFDPLGLSDPEGTGGFIEPKWLAYGEIINGRFAMLGAAGAIAPEILGKAGLIPPETALPWFQTGVIPPAGTYDYWADPYTLFVFEMALMGFAEHRRFQDWAKPGSMGKQYFLGLEKFLGGSGDPAYPGGPLFNPLGFGKDEKSMKELKLKEVKNGRLAMLAILGYFVQGLVTGVGPYQNLLDHLADPVNNNVLTSLKFH

SEQ ID NO: 6649 - protein, 275 aa, Carica papaya
MATQALVSSSLSSSVETARQILGARPAHSPTGCSRRGSFVVRAASTPPVKQGADRPLWFASKQSLSYLDGSLPGDYGFDPLGLSDPEGPGGFIEPKWLAYGEVINGRYAMLGAVGAIAPEILGKAGLIPPETALPWFKTGVIPPAGTYNYWADPYTLFVFEMALMGFAEHRRFQDWAKPGSMGKQYFLGFEKFLGGSGEPAYPGGPLFNPLGFGKDEKSLKDLKLKEVKNGRLAMLAILGYFVQGLVTGVGPYQNLLDHLADPFNNNVLTSLKFH

SEQ ID NO: 6650 - protein, 272 aa, Arachis hypogaea
MAAQALVSSSSLTFSGEAARQSFGSRPNGFSKRASFLVRASSTPPVKQGADRPLWFASKQSLSYLDGSLPGDYGFDPLGLSDPEGTGGFIEPRWLAYGEIINGRYAMLGAVGAIAPEILGKAGLIPEETALPWFKTGVIPPAGTYNYWADPYTLFVLEMALMGFAEHRRFQDWAKPGSMGKQYFLGLEKGLGGSGDPAYPGGPFFNPLGFGKDEKSLKDLKLKEVKNGRLAMLAILGYFVQGLVTGVGPYQNLLDHLADPVHNNVLTSLKFH

SEQ ID NO: 6651 - protein, 274 aa, Scabiosa columbaria
MATQALVSSSSIASSAEATRQLFARGTRPLHSSTKRVSFVVRAASTPPVKQGDRPLWFASKQSLSYLDGSLPGDYGFDPLGLSDPEGTGGFIEPKWLAYGEVINGRFAMLGASGAIAPEILGKLGLIPPETALPWFKTGVIPPAGTYNYWADGYTLFVLEMALMGFAEHRRLQDWYNPGSMGKQYFLGLEKGFSGSGDPAYPGGPFFNPLGFGKDEKSMKDLKLKEIKNGRLAMLAILGYFIQGLVTGVGPFQNLLDHLADPVNNNLLTSLKFH

SEQ ID NO: 6652 - protein, 273 aa, Solanum phureja
MATQALISSSSISTSAEAARQILGSRISQSVTRKASFVVRAASTPPVKQGANRQLWFASKQSLSYLDGSLPGDFGFDPLGLSDPEGTGGFIEPKWLAYGEVINGRFAMLGAVGSIAPEILGKAGLIPQETALAWFQTGVIPPAGTYNYWADNYTLFVLEMALMGFAEHRRFQDWAKPGSMGKQYFLGLEKGLGGSGDPAYPGGPLFNPLGFGKDEKSMKELKLKEIKNGRLAMLAILGYFIQALVTGVGPYQNLLDHLADPVNNNVLTSLKFH

SEQ ID NO: 6653 - protein, 266 aa, Papaver somniferum
SSMEAARQVFRGRPLQYATVNVGSSRKGSFVVRAAATPPVKHGANRQLWFASKQSLSYLDGSLPGDFGFDPLGLSDPEGTGGFIEPKWLAYGEIINGRFAMLGAAGAIAPEVFGKLGLIPAETALPWFQTGVIPPAGTYSYWADPFTLFVLEMALMGFAEHRRLQDWYNPGSMGKQYFLGLEKGLGGSGNPAYPGGPFFNPLGFGKDEKSMKELKLKEVKNGRLAMLAILGYFIQGLVTGVGPFQNLLDHLADPVNNNVLTSLKFH

SEQ ID NO: 6654 - protein, 273 aa, Unknown
  Sequence found in Organisms: Solanum lycopersicum, Triticum aestivum
MATQALISSSSISTSAEAARQIIGSRISQSVTRKASFVVRATSTPPVKQGANRQLWFASKQSLSYLDGSLPGDFGFDPLGLSDPEGTGGFIEPKWLAYGEVINGRFAMLGAAGAIAPEILGKAGLIPQETALAWFQTGVIPPAGTYNYWADNYTLFVLEMALMGFAEHRRFQDWAKPGSMGKQYFLGLEKGLGGSGDPAYPGGPLFNPLGFGKDEKSMKELKLKEIKNGRLAMLAVLGYFIQALVTGVGPYQNLLDHLADPVNNNVLTSLKFH

SEQ ID NO: 6655 - protein, 277 aa, Malus domestica
MAAQALVSSSSLTASKEVARQIFGGAKAVQSPFGSRKSASFVVRAASTPPVKQGADRQLWFASKQSLTYLDGSLPGDYGFDPLGLSDPEGTGGFIEPRWLAYGEVINGRYAMLGAVGAIAPEILGKLGLIPPETALPWFQTGVIPPAGTYNYWADPYTLFVFELALMGFAEHRRFQDWYNPGSMGKQYFLGFEKYLGGSGNPAYPGGPLFNPLGFGKDEKSLNELKLKEVKNGRLAMLAILGYFIQGLVTGVGPYQNLLDHLADPVHNNILTSLKFH

SEQ ID NO: 6656 - protein, 257 aa, Flaveria ramosissima
VESARQILELDHSDTFKKDLFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFAGSGDPAYPGGPFFNPLGFGKDEKSMKELKLKEIKNGRLAMLAILGYFIQGLVTGVGPYQNLLDHLADPVNNNVLTSLKFH

SEQ ID NO: 6657 - protein, 269 aa, Leymus cinereus x Leymus triticoides
MAAQGLLSGRQLLGRPLQSSFSRSSSSRKSPFIVRAASTPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 6658 - protein, 272 aa, Senecio madagascariensis
MATQALVSSSSLTSSVESARQILGARPLITSSRKVSFVVKAASTPPVKQGNRQLWFASKQSLSYLDGSLPGDFGFDPLGLSDPEGTGGFIEPKWLAYGEVINGRFAMLGAAGAIAPEVFGKLGLIPAETALPWFKTGVIPPAGTYNYWADPFTLFVLEMALMGFAEHRRLQDWYNPGSMGKQYFLGLEKGFSGSGDPAYPGGPFFNPLGFGKDEKSMKELKLKEIKNGRLAMLAVLGYFIQGLVTGVGPFENLLAHLADPVNNNVLTSLKFH

SEQ ID NO: 6659 - protein, 273 aa, Solanum melongena
MATQALISSSSISTSAEAARQILGGRNSQIVARKGSFVVRATSTPPAKQGANRQLWFASKQSLSYLDGSLPGDYGFDPLGLSDPEGTGGFIEPKWLAYGEVINGRFAMLGAAGAIAPEILGKAGLIPQETALAWFQTGVIPPAGTYNYWADNYTLFVLEMALMGFAEHRRFQDWAKPGSMGKQYFLGLEKGLGGSGDPAYPGGPLFNPLGFGKDEKSMKELKLKEIKNGRLAMLAILGYFIQALVTGVGPYQNLLDHLADPVNNNILTSLKFH

SEQ ID NO: 6660 - protein, 274 aa, Vitis vinifera
MAAQALVSSSLTSSVETARQILGSRPLQSPSRKSSSFVVRAASTPPVKQGADRPLWFASKQSLTYLDGSLPGDYGFDPLGLSDPEGTGGFIEPRWLAYGEVINGRYAMLGAVGAIAPEILGKLGLIPPETALPWFKTGVFPPAGTYNYWADPYTLFVFEMALMGFAEHRRFQDWANPGSMGKQYFLGLEKYLGGSGDPAYPGGPLFNPLGFGKDEKSLKDLKLKEVKNGRLAMLAILGYFAQGPVTGVGPLQNLLDHLADPVNNNIITSLKFHN

SEQ ID NO: 6661 - protein, 274 aa, Humulus lupulus
MATQALVSSSSLTSSVEATRQILGSRPTQPSTRRSASFVVRAAATPPVKQGADRPLWFASKQSLSYLDGSLPGDYGFDPLGLSDPEGTGGFIEPRWLAYGEVINGRFAMLGAAGAIAPEIFGKLGLIPEETALPWFKTGVIPPAGTYNYWADPYTLFVLEMALMGFAEHRRFQDWYNPGSMSKQYFLGLEKYLGGSDNPAYPGGPLFNPLGFGKDEKSMKDLKLKEIKNGRLAMLAILGYFIQGLVTGVGPYQNLLDHLSDPVNNNVLTSLKFH

SEQ ID NO: 6662 - protein, 273 aa, Ipomoea nil
MAAQALISSSSIASSAEAARQVLGARPVQSSSRKVSFVVRAASTPPVKQGTDRQLWFASKQSLTYLDGSLPGDYGFDPLGLSDPEGPGGFIEPRWLAYGEVINGRYAMMGAVGAIAPEILGQAGLIPPETALPWFKTGVIPPAGTYNYWADPYTLFVFEMALMGFAEHRRFQDWANPGSMGKQYFLGLEKGLGGSGDPAYPGGPIFNPLGFGKDEKSLKDLKLKEVKNGRLAMLAILGYFIQALVTGVGPYQNLLDHLADPVNNNILTNLKFH

SEQ ID NO: 6663 - protein, 272 aa, Olea europaea
MATQALLSSSSISSSAEVARQILGGRPVQSARKVSFVVKAASTPPVKQGADRPLWFASKQSLSYLDGSLPGDYGFDPLGLSDPEGTGGFIEPKWLAYGEIFNGRCAMVGAIGAIAPEILGKAGLIPAETALPWFKTGVIPPAGTYNYWADSYTLFVFELALVGFAEHRRFQDWANPGSMGKQYFLGLEKWLGGSGDPAYPGGPLFNPLGFGKDEKSMKELKVKEVKNGRLAMLAILGYFVQALVTGVGPYQNLLDHLADPVNNNVLTSLKFH

SEQ ID NO: 6664 - protein, 273 aa, Solanum tuberosum
MATQALISSSSISTSAEAARQILGSRISQSVTRKASFVVRAASTPPVKQGANRQLWFASKQSLSYLDGSLPGDFGFDPLGLSDPEGTGGFIEPKWLAYGEVINGRFAMLGAVGSIAPEILGKAGLIPQETALAWFQTGVIPPAGTYNYWADNYTLFVLEMALMGFAEHRRFQDWAKPGSMGKQYFLGLEKGLGGSGDPAYPGGPLFNPLGFGKDDKSMKELKLKEIKNGRLAMLAILGYFIQALVTGVGPYQNLLDHLADPVNNNVLTSLKFH

SEQ ID NO: 6665 - protein, 273 aa, Nicotiana tabacum
MATQALLSSSSITSSVENDRQILVGRPSQSSTKKASFVVRAASTPPVKQGANRPLWFASKQSLSYLDGSLPGDYGFDPLGLSDPEGTGGFIEPKWLAYGEIINGRFAMLGAVGAIAPEILGKAGLIPPETALPWFQTGVIPPAGTYNYWADSYTLFVLEMALMGFAEHRRFQDWAKPGSMGKQYFLGLEKGLGGSGDPAYPGGPFFNPLGFGKDEKSMKDLKLKEVKNGRLAMLAILGYFIQGLVTGVGPYQNLLDHLADPVNNNILTNFKFH

SEQ ID NO: 6666 - protein, 275 aa, Tripterygium wilfordii
MATQALVSSSLTSSVEAARQIFGAKPIQSPIGSSRRASFVVRAASTPPVKQGADRQLWFASKQSLTYLDGSLPGDFGFDPLGLSDPEGTGGFIEPRWLAYGEIINGRYAMLGAVGAIAPEIFGKLGLIPPETALPWFKTGVIPPAGTYNYWADPYTLFVFEMALMGFAEHRRFQDWYNPGSMGKQYFLGLEKGLGGSGNPAYPGGPFFNPLGFGKDEKSLKDLKLKEVKNGRLAMLAIVGYFIQALVTGVGPFQNLLDHLADPVNNNILTNLKFH

SEQ ID NO: 6667 - protein, 245 aa, Platanus occidentalis
MATQALVSSPLTSSMEAARQLLGGRPLQSPIGSSRKASFVVRAASTPPVKQGADRQLWFASKQSLSYLDGSLPGDYGFDPLGLSDPEGTGGFIEPNWLAYGEIINGRFAMLGAVGAIAPEILGKLGLIPPETALPWFKTGVIPPAGTYNYWADPYTLFVLEMALMGFAEHRRFQDWAKPGSMSKQYFLGLEKYLGGSDNPAYPGGPLFNPLGLGKDEKSMKDLKLKEVKNGRLAMLAILGYLCKL

SEQ ID NO: 6668 - protein, 266 aa, Flaveria ramosissima
FIIITHPSVESARQILGARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6669 - protein, 276 aa, Scabiosa columbaria
MAAQALLSSSSSIVASAEASRLLFASGNRAIHSSTSRGSFVVRAASTPPVKQGANRSLWFASKQSLSYLDGSLPGDYGFDPLGLSDPEGAGGFIEPKWLAYGEVINGRFAMLGAAGAIAPEIFGKLGLIPQETALPWFQTGVIPPAGTYNYWADGYTLFVLEMALMGFAEHRRLQDWYNPGSMGKQYFLGLEKGFSGSGDPAYPGGPFFNPLGFGKDEKSMKDLKLKEIKNGRLAMLAILGYFIQGLVTGVGPFQNLLDHLADPVNNNLLTSLKFH

SEQ ID NO: 6670 - protein, 264 aa, Flaveria ramosissima
SSLTSSVESARQIGEARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6671 - protein, 100 aa, Papaver somniferum
TLVSSSLTSSSSSSMEAARQVFRGRPLQYATVNVGSSRKGSFVVRAAATPPVKHGANRQLWFASKQSLSYLDGSLPGDFGFDPLGLSDPEGTGGFIEPNG

SEQ ID NO: 6672 - protein, 156 aa, Secale cereale
MAAQGLLSGRQLLGRPLQSSISRSSSSRKSAFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAAPTSTGPTPTRSSCSRWR

SEQ ID NO: 6673 - protein, 226 aa, Musa acuminata
MATQAFLSSVDAGRQLLGGRPLRSAPSRSLGSSRKASFAVRAASTPPVKQGADRQLWFASKQSLTYLDGSLPGDYGFDPLGLSDPEGTGGFIEPKWLAYGEVINGRYAMLGAVGAIAPEIFGKLGWIPPETALPWFKTGVFPPAGTYNYWADPYTLFVLEMALMGFAEHRRFQDWANPGSMGKQYFLGLEKWLGGSGNPIYPGGPLFNPLGFGKDEKSMNDLKLKE

SEQ ID NO: 6674 - protein, 271 aa, Brassica juncea
MAAQSLVSSSLTSSVQTARQIFSTKPAVYVRKTSFIVKATSTPPVKQGANRPLWFASSQSLSYLDGSLPGDYGFDPLGLSDPEGTGGFIEPKWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPSYPGGPFFNPLGFGKDEKSMKELKLKEVKNGRLAMLAILGYFVQGLVTGVGPYQNLLDHLADPVNNNVLTSLKFH

SEQ ID NO: 6675 - protein, 276 aa, Rosa hybrid cultivar
MAAQALVSSSSLTASKEVARNLLGGRSAQSPFGVRKSASFVVKAASTPPVKQGADRQLWFASKQSLSYLDGSLPGDYGFDPLGLSDPEGTGGFIDPRWLAYGEVINGRYAMLGAIGAIAPEILGKLGLIPAETALPWFQTGVIPPAGTYNYWADPYTLFVFELALMGFAEHRRFQDWYNPGSMSKQYFLGLEKYLGGSDNPAYPGGPLFNPLGFGKDEKSLNELKLKEVKNGRLAMLAILGYFIQALVTGVGPYQNLLDHLADPVNNNILTSLKFH

SEQ ID NO: 6676 - protein, 273 aa, Helianthus annuus
MATQALASSSSLTSSVESARQILGARPVHTSSRKVSFLVKAASTPPVKQGANRQLWFASKQSLSYLDGSLPGDYGFDPLGLSDPEGTGGFIEPKWLAYGEVINGRFAMLGAAGAIAPEIFGKLGLIPAETALPWFKTGVIPPAGTYDYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFQNLLDHLADPVNNNVLTSLKVH

SEQ ID NO: 6677 - protein, 276 aa, Phaseolus coccineus
MAAQALLPSSSLVFSSESARQSLGPRSLQSPIGFSRKQSFIVKAASTPPVKQGADRPLWFASKQSLSYLDGSLPGDYGFDPLGLSDPEGTGGFIEPKWLAYGEVINGRFAMLGAVGSIAPEILGKAGLIPEETALPWFRTGVVPPAGTYNYWADSYTLFVFEMALMGFAEHRRFQDWAKPGSMGKQYFLGLEKGLGGSGEPAYPGGPLFNPLGFGKDEKSLKDLKLKEVKNGRLAMLAILGYFIQALVTGVGPYQNLLDHLADPVNNNVLTSLKFH

SEQ ID NO: 6678 - protein, 268 aa, Cirsium arvense
MATQSLVSSSLTSSIEAGRRPFQTSSRKPSFVVKAASSTPPVKQGANRQLWFASKQSLSYLDGSLPGDFGFDPLGLSDPEGTGGFIEPKWLAYGEVINGQFAMLGAAGAIAPEIFGKLGLIPSETALPWFQTGVIPPAGTYSYWADPYTLFVMEMALMGFAEHRRFQDWYNPGSMGKQYFLGLEKGFSGSGNPAYPGGPFFNPLGFGKDEKSMKELKLKEIKNGRLAMLAVLGYFIQGLVTGVGPYQNLLDHLADPVNNNVLTSLKFH

SEQ ID NO: 6679 - protein, 273 aa, Solanum tuberosum
MATQALISSSSIASSTEAARQILGGRPFQSPIKKASFVVRATASPPVKQGANRPLWFASKQSLSYLDGSLPGDYGFDPLGLSDPEGTGGFIEPKWLAYGEVINGRFAMLGVVGAIAPEILGKAGLIPAETALPWFQTGVIPPAGTYNYWADGYTLFVLEMALMGFAEHRRFQDWAKPGSMGKQYFLGLEKGLGGSGDPAYPGGPFFNPLGFGKDEKSMKDLKLKEIKNGRLAMLGILGYFIQGLVTGVGPYQNLLDHLADPVNNNVLTSLKFH

SEQ ID NO: 6680 - protein, 276 aa, Fragaria vesca
MAAQALVSSSSLTASKEVARNLLGGRSAQSPFGVRKSASFVVKAATTPPVKQGADRQLWFASKQSLSYLDGSLPGDFGFDPLGLSDPEGTGGFIEPRWLAYGEIINGRFAMLGAAGAIAPEIFGKLGLIPPETALPWFQTGVIPPAGTYNYWADNYTLFVLEMALMGFAEHRRFQDWYNPGSMSKQYFLGFEKYLGGSGNPAYPGGPLFNPLGFGKDEKSMNELKLKEVKNGRLAMLAILGYFIQALVTGVGPYQNLLDHLADPVNNNILTSLKFH

SEQ ID NO: 6681 - protein, 273 aa, Flaveria ramosissima
MATQALASSSSLTSSVESARQILGARPLHTPSRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6682 - protein, 273 aa, Flaveria ramosissima
MATQALASSSSLTSSVESARQILGARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6683 - protein, 272 aa, Plantago ovata
MATQALVSSSSICSSADVARQTFGGRAVHSSRKVCFVVKAASTPPVKSGANRPLWFASKQSLSYLDGSLPGDYGFDPLGLSDPEGTGGFIEPKWLAYGEVINGRFAMLGAAGAIAPEILGKAGLIPQETALAWFQTGVIPPAGTYNYWADGYTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6684 - protein, 272 aa, Helianthus annuus
MATQALASSSLSSSVESARQILGARPLHTSSRKVSFLVKAASTPPVKQGANRQLWFASKQSLSYLDGSLPGDYGFDPLGLSDPEGTGGFIEPKWLAYGEVINGRFAMLGAAGAIAPEIFGKLGLIPAETALPWFKTGVIPPAGTYDYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFENLLDHLADPVNNNVLTSLKFH

SEQ ID NO: 6685 - protein, 275 aa, Unknown
  Sequence found in Organisms: Citrus sinensis, Citrus clementina, Citrus sinensis
MATQALVSSSLTSSVETARQILGARSAQSPTGSSRKGSFVVRAASTPPVKQGADRPLWFASKQSLSYLDGSLPGDYGFDPLGLSDPEGTGGFIEPKWLAYGEVINGRYAMLGAVGAIAPEILGKAGLIPQETALAWFQTGVIPPAGTYNYWADPYTLFVLEMALMGFAEHRRFQDWANPGSMGRQYFLGFEKYLGGSGDPAYPGGPLFNPLGLGKDEKSMKDFKLKEVKNGRLAMLAILGYFVQGLVTGVGPYQNLLDHLADPVNNNVLTSLKFH

SEQ ID NO: 6686 - protein, 293 aa, Amborella trichopoda
MALVSSSLSLTATATAAAASSSSSTSTVDAGRQQFVMGGRPTQSSRSSSGSLRKSPFVVRAASTPPVKQGADRQLWFASKQSLSYLDGSLPGDYGFDPLGLSDPEGTGGFIEPKWLAYGEVINGRYAMLGAIGAIAPEILGKAGLIPPETALPWFKTGVIPPAGTYNYWADPFTLFVFEMALMGFAEHRRFQDWYNPGSMGKQYFLGLEKWLGGSGEPAYPGGPIFNPLGLANDEKSKKEMRLKEVKNGRLAMLAIVGYFVQGLVTGVGPYQNLLDHLSDPLNNNFLTSLKFH

SEQ ID NO: 6687 - protein, 281 aa, Eschscholzia californica
MASQTLLSSSLTSSSSSMDVGRQLFRGTPIRFLSVKVGSSRKGSFVVRAASTPPVKQGANRQLWFASKQSLSYLDGSLPGDFGFDPLGLSDPEGTGGFIEPKWLAYGEIINGRFAMLGAAGAIAPEVFGKLGLIPAETALPWFQTGVIPPAGTYNYWADSYTLFVLEMALMGFAEHRRLQDWYNPGSMGKQYFLGLEKGFSGSGDPSYPGGPFFNPLGFGKDEKSMKELKLKEVKNGRLAMLAVLGYFIQGLVTGVGPYQNLLDHLADPVNNNILTSLKFH

SEQ ID NO: 6688 - protein, 273 aa, Unknown
  Sequence found in Organisms: Brassica napus, Brassica rapa
MAAQALVSSSFTSSVQTARQIFGVKPAVSVSQRKVSLVVKAASTPPAKQGANRQLWFASSQSLSYLDGSLPGDFGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPAYPGGPFFNPLGFGKDEKSMKELKLKEVKNGRLAMLAILGYFVQGLVTGVGPYQNLLDHLADPVNNNVLTSLKFH

SEQ ID NO: 6689 - protein, 275 aa, Papaver somniferum
SSSLTSSSSSSMEAARQVFRGRPLQYATVNVGSSRKGSFVVRAAATPPVKQGANRQLWFASKQSLSYLDGSLPGDFGFDPLGLSDPEGTGGFIEPKWLAYGEIINGRFAMLGAAGAIAPEVFGKLGLIPPETALPWFQTGVIPPAGTYSYWADPFTLFVLEMALMGFAEHRRLQDWYNPGSMGKQYFLGLEKGLGGSGNPAYPGGPFFNPLGFGKDEKSMNELKLKEVKNGRLAMLAILGYFIQGLVTGVGPFQNLLDHLADPVNNNVLTSLKFH

SEQ ID NO: 6690 - protein, 273 aa, Raphanus sativus
MAAQALVSSSLTSSVQTARQIFGTKPAVSVSQRKASLVVKAASTPPAKQGANRQLWFASSQSLSYLDGSLPGDFGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGNPAYPGGPFFNPLGFGKDEKSMKELKLKEVKNGRLAMLAILGYFIQGLVTGVGPYQNLLDHLADPVNNNVLTSLKFH

SEQ ID NO: 6691 - protein, 276 aa, Scabiosa columbaria
MAAQALLSSSSSIVASAEASRRLFASGSRAIHSSSSRGSFVVRAAATPPVKQGANRSLWFASKQSLSYLDGSLPGDYGFDPLGLSDPEGAGGFIEPKWLAYGEVINGRFAILGAAGAIAPEIFGKLGLIPAETALPWFQTGVIPPAGTYNYWADGYTLFVLEMALMGFAEHRRLQDWYNPGSMGKQYFLGLEKGFSGSGDPAYPGGPFFNPLGFGKDEKSMKDLKLKEIKNGRLAMLAILGYFIQGLVTGVGPFQNLLDHLADPVNNNLLTSLKFH

SEQ ID NO: 6692 - protein, 273 aa, Ipomoea nil
MAAQALISSSSITSSAEVARQVLGGRPLQSSRKVSFVVRASSSTPPVKQGADRPLWFASKQSLSYLDGSLPGDYGFDPLGLSDPEGTGGFIEPKWLAYGEIINGRFAMLGAAGAIAPEVLGKAGLIPAETALPWFQTGVIPPAGTYNYWADSYTLFVLEMALMGFAEHRRFQDWAKPGSMGKQYFLGLEKGLGGSGDPAYPGGPIFNPLGFGKDEKSMKDLKLKEVKNGRLAMLAILGYFIQALVTGVGPYQNLLDHLADPVNNNILTNLKFH

SEQ ID NO: 6693 - protein, 277 aa, Flaveria ramosissima
IFLEIATQALASSSSLTSSVESARQILGARPLHTPTRKISFLVKAASTPPVKQGADRQLWFASKQSLSYLDGSLPGDFGFDPLGLSDPEGTGGFIEPKWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6694 - protein, 206 aa, Flaveria ramosissima
MEVSQVTLDLTHLVFQTQKGPWVHRTQWLAYGEVINGRFAMLGAAGAIAPEILGKLGLIPAETALPWFKTGVIPPAGTYDYWADPFTLFVLEMALMGFAEHRRLQDWYNPGSMGKQYFLGLEKGFSGSGDPAYPGGPFFNPLGFGKDEKSMKELKLKEIKNGRLAMLAILGYFIQGLVTGVGPYQNLLDHLADPVNNNVLTSLKFH

SEQ ID NO: 6695 - protein, 271 aa, Fraxinus spp
MATQALLSSSSISLSGEVARQILGRRPVQSSRKASFVVKAASTPPVKQGADRQLWFASKQSLSYLDGSLPGDYGFDPLGLSDPEGTGGFIEPRWLAYGEIFNGRCAMMGAIGAIAPEILGKAGLIPAETALPWFKTGVIPPAGTYNYWADNYTLFVFEMALVGFAEHRRFQDWANPGSMGKQYFWVWRRIGRVGDPAYPGGPFFNPLGFGKDEKSMFELKVKEVKNGRLAMLAILGYFIQALVTGVGPYQNLLDHLADPVNNNVLTSLKFH

SEQ ID NO: 6696 - protein, 267 aa, Vinca minor
LISSSSITASAEATRQILGARSLQSSSRKVSFVVRAASSPPVKQGDRQLWFASKQSLSYLDGSLPGDYGFDPLGLSDPEGTGGFIEPKWLAYGEIINGRYAMLGAVGAIAPEILGKAGLIPAETALPWFQTGVIPPAGTYSYWADNYTLFVLEMALMGFAEHRRFQDWAKPGCMSKQYFLGFEKYLGGSGNPAYPGGPIFNPLGFGKDEKSMKDLKLKEVKNGRLAMLAILGYFVQGLVTGVGPYQNLLDHLSDPVNNNILTSLKFH

SEQ ID NO: 6697 - protein, 273 aa, Helianthus annuus
MATQALASSSSLTSSVESARQILGARPLHTSSRKVSFLVKAASTPPVKQGANRQLWFASKQSLSYLDGSLPGDYGFDPLGLSDPEGTGGFIEPKWLAYGEVINGRFAMLGAAGAIAPEIFGKLGLIPAETALPWFKTGVIPPAGTYDYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFENLLDHLADPVNNNVLTSLKFH

SEQ ID NO: 6698 - protein, 273 aa, Helianthus annuus
MATQALASSSSLTSSVDSARQILGARPLHTSSRKVSFLVKAASTPPVKQGANRQLWFASKQSLSYLDGSLPGDYGFDPLGLSDPEGTGGFIEPKWLAYGEVINGRFAMLGAAGAIAPEIFGKLGLIPAETALPWFKTGVIPPAGTYDYWADPFTLFVFEMALMGFAEHRRLQDWYNPGSMGKQYFLGLEKGFAGSGDPAYPGGPFFNPLGFGKDEKSMKELKLKEIKNGRLAMLAILGYFIQGLVTGVGPFENLLDHLADPVNNNVLTSLKFH

SEQ ID NO: 6699 - protein, 267 aa, Curcuma longa
MATQALLSARQLLGGTPLHSAPSRSPRKATFVVRAAATPPVKQGADRQLWFASKQSLSYLDGSLPGDYGFDPLGLSDPEGTGGFIEPRWLAYGEIFNGRTAMMGVVGCLAPEILGKLGLIPPETALPWFRTGVIPPAGTYTYWADNYTLFVFEMALVGFAEHRRFQDWANPGSMGKQYFLGLEKGLGGSGDPAYPGGPFFNPLGLGKDEKSMRDLKVKEVKNGRLAMMAIVGFFIQAWVTGEGPFQNLLDHLADPFNNNILTNLKFH

SEQ ID NO: 6700 - protein, 271 aa, Eucalyptus grandis
MAAQALVSSSLTSSVESARHLLGARPAAPSRKASFVVRAASTPPVKQGSDRQLWFASKQSLTYLDGSLPGDFGFDPLGLSDPEGTGGFIEPRWLAYGEIINGRFAMLGAVGSIAPEILGKAGLIPPETALPWFRTGVIPPAGTYNYWADNYTLFVLEMALMGFAEHRRFQDWAKPGSMGKQYFLGLEKGLAGSGDPAYPGGPFFNPLGFGKDEKSMKDLKLKEVKNGRLAMLAIVGYFIQALVTGVGPYQNLLDHLADPVNNNILTNLKFH

SEQ ID NO: 6701 - protein, 273 aa, Cajanus cajan
MAAQALVSSSSLTFSAEAARQSLGARSPQGFSRKASFIVKAASTPPVKQGADRPLWFASKQSLSYLDGSLPGDYGFDPLGLSDPEGTGGFIEPKWLAYGEIINGRYAMLGAVGAIAPEILGKAGLIPQETALPWFKTGVIPPAGTYNYWADSYTLFVFELALMGFAEHRRFQDWAKPGSMGKQYFLGLEKGLGGSGEPAYPGGPFFNPLGFGKDEKSLKDLKLKEVKNGRLAMLAILGYFVQALVTGEGPYQNLLDHLADPVHNNVLTSLKFH

SEQ ID NO: 6702 - protein, 273 aa, Solanum phureja
MATQALISSSSIASSTEAARQILGGRPFQSPIKKASLVVRATATPPVKQGANRPLWFASKQSLSYLDGSLPGDYGFDPLGLSDPEGTGGFIEPKWLAYGEVINGRFAMLGVVGAIAPEILGKAGLIPAETALPWFQTGVIPPAGTYNYWADGYTLFVLEMALMGFAEHRRFQDWAKPGSMGKQYFLGLEKGLGGSGDPAYPGGPFFNPLGFGKDEKSMKELKLKEIKNGRLAMLGILGYFIQGLVTGVGPYQNLLDHLADPVNNNVLTSLKFH

SEQ ID NO: 6703 - protein, 273 aa, Tamarix hispida
MATQALVSSSSLTSSVETARQIVGSRPLQGSSSRKSSFVVRASSSPPVKQGDRQLWFASKQSLSYLDGSLPGDFGFDPLGLSDPEGTGGFIEPKWLAYGEIINGRFAMLGAAGAIAPEILGKAGLIPAETALPWFQTGVIPPAGTYNYWADPYTLFVLEMALMGFAEHRRFQDWAKPGSMGKQYFLGLEKYLGGSGDPAYPGGPFFNPLGFGKDEKSMKDLKLKEVKNGRLAMLAILGYFVQGLVTGVGPYQNLLDHLADPVNNNILTSLKFH

SEQ ID NO: 6704 - protein, 273 aa, Solanum lycopersicum
MATQALISSSSIASSTEAARQILGGRPFQSQIKKASFVVRATATPPVKQGANRPLWFASKQSLSYLDGSLPGDYGFDPLGLSDPEGTGGFIEPKWLAYGEVINGRFAMLGVVGAIAPEILGKAGLIPPETALPWFQTGVIPPAGTYNYWADGYTLFVLEMALMGFAEHRRFQDWAKPGSMGKQYFLGLEKGLGGSGDPAYPGGPFFNPLGFGKDEKSMKDLKLKEIKNGRLAMLGILGYFIQGLVTGVGPYQNLLDHLADPANNNVLTSLKFH

SEQ ID NO: 6705 - protein, 268 aa, Brassica juncea
LVSSSLTSSVQTARQIFGAKPAVSVSQRKVSLVVKAASTPPVKQGANRPLWFASSQSLSYLDGSLPGDYGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPSYPGGPFFNPLGFGKDEKSMKELKLKEVKNGRLAMLAILGYFVQGLVTGVGPYQNLLDHLADPVNNNVLTSLKFH

SEQ ID NO: 6706 - protein, 282 aa, Papaver somniferum
MATQTLVSSSLTSSSSSSMEAARQVFRGRPLQYATVNVGSSRKGSFVVRAAATPPVKQGANRQLWFASKQSLSYLDGSLPGDFGFDPLGLSDPEGTGGFIEPKWLAYGEIINGRFAMLGAAGAIAPEVFGKLGLIPPETALPWFQTGVIPPAGTYSYWADPFTLFVLEMALMGFAEHRRLQDWYNPGSMGKQYFLGLEKGLGGSGNPAYPGGPFFNPLGFGKDEKSMNELKLKEVKNGRLAMLAILGYFIQGLVTGVGPFQNLLDHLADPVNNNVLTSLKFH

SEQ ID NO: 6707 - protein, 273 aa, Unknown
  Sequence found in Organisms: Brassica napus, Brassica juncea
MAAQALVSSSLTSSVQTARQIFGAKPAVSVSQRKVSLVVKAASTPPAKQGANRQLWFASSQSLSYLDGSLPGDFGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPAYPGGPFFNPLGFGKDEKSMKELKLKEVKNGRLAMLAILGYFVQGLVTGVGPYQNLLDHLADPVNNNVLTSLKFH

SEQ ID NO: 6708 - protein, 271 aa, Brassica juncea
MAAQALVSSSLTSSVQTARQIFGTKPAVSVRKTSFVVKAASTPPVKQGANRPLWFASSQSLSYLDGSLPGDYGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPSYPGGPFFNPLGFGKDEKSMKELKLKEVKNGRLAMLAILGYFVQGLVTGVGPYQNLLDHLADPVNNNVLTSLKFH

SEQ ID NO: 6709 - protein, 276 aa, Tropaeolum majus
MATQALVSSSLSSSVETARQILAGRPFQSPIGSSSKKGSFVVRAASTPPVKQGANRPLWFASSQSLTYLDGSLPGDYGFDPLGLSDPEGTGGFIEPKWLAYGEVINGRFAMLGAFGAIAPEILGKAGLIPQETALAWFQTGVIPPAGTYSYWADNYTLFVLEMALMGFAEHRRLQDWAKPGSMGKQYFLGFEKFLGGSGDPAYPGGPLFNPLGFGKDEKSLKELKLKEIKNGRLAMLAILGYFVQGLVTGVGPYQNLLDHLADPVNNNILTSLKFH

SEQ ID NO: 6710 - protein, 273 aa, Arabidopsis lyrata
MAAQALVSSSLTSSVQTARQIFGSKPVASASQKKSSFVVKATATPPVKQGANRPLWFASSQSLSYLDGSLPGDYGFDPLGLSDPEGTGGFIEPRWLAYGEIINGRFAMLGAAGAIAPEILGKAGLIPPETALPWFQTGVIPPAGTYTYWADNYTLFVLEMALMGFAEHRRLQDWYNPGSMGKQYFLGLEKGLAGSGNPAYPGGPFFNPLGFGKDEKSLKELKLKEVKNGRLAMLAILGYFIQGLVTGVGPYQNLLDHLADPVNNNVLTSLKFH

SEQ ID NO: 6711 - protein, 268 aa, Fagopyrum esculentum
MALVSSAARQILGGRPLQPSVGPSSSFRKPSFVVRATSTPPVKQGGDRQLWFASKQSLSYLDGSLPGDFGFDPLGLSDPEGTGGFIEPRWLAYGEIINGRFAMLGAAGAIAPEIVGKAGLIPPETALPWFQTGVIPPAGTYSYWADPYTLFVLELALMGFAEHRRFQDWYNPGSMSKQYFLGLEKFLGGSDNPAYPGGPLFNPLGFGKDEKSLKELKLKEVKNGRLAMLAILGYFVQALVTGEGPYQNLLDHLADPVNNNILTSLKFH

SEQ ID NO: 6712 - protein, 274 aa, Populus trichocarpa
MAAQALVSSSLTSSVETARKVLGARPTQSPFVSSRKSSFVVRAASTPPVKQGNRQLWFASKQSLSYLDGSLPGDFGFDPLGLSDPEGTGGFIEPKWLAYGEIINGRYAMLGAVGAIAPEILGKAGLIPPETALPWFRTGVIPPAGTYSYWADPYTLFVFEMALMGFAEHRRLQDWAKPGSMGKQYFLGFEKYLGGSGEPAYPGGPLFNPLGFGKDEKSLKDLKLKEVKNGRLAMLAILGYFVQGLVTGVGPYQNLLDHLADPVHNNILTSLKFH

SEQ ID NO: 6713 - protein, 215 aa, Brassica napus
MAAQALVSSSLTSSVQTARQIFGTKPAVSVRKTSFVVKAASTPPVKQGANRPLWFASSQSLSYLDGSLPGDYGFDPLGLSDPEGTGGFIEPRWLAYGEIINGRFAMLGAAGAIAPEILGKAGLIPADTALPWFQTGVIPPAGTYSYWADPYTLFVLEMALMGFAEHRRLQDWYNPGSMGKQYFLGLEKGFAGSGDPSYPGGPSLTLLGLGKTRSQ

SEQ ID NO: 6714 - protein, 285 aa, Zea mays
MHIPAAGTRGGVITAWNPDVLHLTSYAVHHHALTVHLRLLASNSDIHITNVYAPSDHRDTPAFLDILLEIGASISGPWLIVGDFNLIRDAKDKNTGTVNQLLCNQFNDVIHNLSLAELPLLDCLYTWSNKRRSPILARLDRAFTNATFNNVFPSALLTSSVRITSDHKPIIATMSTTVPKSNSFRFENAWLKKPGFLPSILPAWRCLSGSTVAAGRLASCLKSTRSAVKVWARRNRAPPQILPNCKFIILMFDFLEEERWLSDAEMQVRELCRNRLQQHIKEMAA

SEQ ID NO: 6715 - protein, 94 aa, Sorghum bicolor
MGKGTGSFGKRRNKTHTLCIRCGRRSFHLQKSTCSSCGYPAARIRKYNWSIKAIRRKTTGTGRMRYMRHVPRRFKSNFREGTEAAPKKSAAAAN

SEQ ID NO: 6716 - protein, 94 aa, Unknown
  Sequence found in Organisms: Pennisetum glaucum, Cenchrus ciliaris, Setaria italica
MGKGTGSFGKRRNKTHTLCIRCGRRSFHLQKSTCSSCGYPAARIRKYNWSVKAIRRKTTGTGRMRYLRHVPRRFKSNFREGTEATPKKSAAAAN

SEQ ID NO: 6717 - protein, 94 aa, Zea mays
MGKGTGSFGKRRNKTHTLCIRCGRRSFHLQKSTCSSCGYPAARIRKYNWSVKAIRRKTTGTGRMRYMRHVPRRFKSNFREGTEAAPKKGVAAAN

SEQ ID NO: 6718 - protein, 94 aa, Saccharum officinarum
MGKGTGSFGKRRNKTHTLCIRCGRRSFHLQKSTCSSCGYPAARIRKYNWSIKAIRRKTTGTGRMRYMRHVPRRFKSNFREGTEAAPKKSAAASN

SEQ ID NO: 6719 - protein, 94 aa, Pennisetum glaucum
MGKGTGSFGKRRHKTHTLCIRCGRRSFHLQKSTCSSCGYPAARIRKYNWSVKAIRRKTTGTGRMRYLRHVPRRFKSNFREGTEATPKKSAAAAN

SEQ ID NO: 6720 - protein, 93 aa, Unknown
  Sequence found in Organisms: Festuca arundinacea, Lolium multiflorum
MTKGTGSFGKRRNKTHTLCIRCGRRSFHLQKSTCSSCGYPAARIRKYNWSVKAIRRKTTGTGRMRYMRHVPRRFKSNFREGTEAAPRKTAAAN

SEQ ID NO: 6721 - protein, 93 aa, Avena sativa
MTKGTGSFGKRRNKTHTLCIRCGRRSFHLQKSTCSSCGYPAARIRKYNWSVKAIRRKTTGTGRMRYMRHVPRRFKSNFREGTEAAPRKRAAAN

SEQ ID NO: 6722 - protein, 94 aa, Oryza sativa
MGKGTGSFGKRRNKTHTLCVRCGRRSFHLQKSTCSSCGYPAARIRKYNWSVKAIRRKTTGTGRMRYMRHVPRRFKSNFREGTEATPRKRAAAAN

SEQ ID NO: 6723 - protein, 94 aa, Panicum virgatum
MGKGTGSFGKRRNKTHTLCIRCGRRSFHLQKSTCSSCGYPAARIRKYNWSVKAIRRKTTGTGRMRYLRHVPRRFKSNFREGTEATPKKAAAASN

SEQ ID NO: 6724 - protein, 93 aa, Unknown
  Sequence found in Organisms: Hordeum vulgare, Secale cereale, Triticum aestivum
MTKGTGSFGKRRNKTHTLCIRCGRRSFHLQKSTCSSCGYPAARIRKYNWSVKAIRRKTTGTGRMRYMRHVPRRFKSNFREGTEAAPRNRAAAN

SEQ ID NO: 6725 - protein, 93 aa, Brachypodium distachyon
MTKGTGSFGKRRNKTHTLCIRCGRRSFHLQKSTCSSCGYPAARIRKYNWSVKAIRRKTTGTGRMRYMRNVPRRFKSNFREGTAAAPKKSTAAN

SEQ ID NO: 6726 - protein, 95 aa, Brachypodium distachyon
MGKGTGSFGKRRNKTHTLCIRCGRRSFHLQKSTCSSCGYPAARIRKYNWSVKAIRRKTTGTGRMRYMRHVPRRFKSNFREGTEAAPRNKGASAGN

SEQ ID NO: 6727 - protein, 93 aa, Cynodon dactylon
MGKGTGSFGKRRNKTHTLCIRCGRRSFHLQKSTCSSCGYPAARIRKYNWSVKAIRRKTTGTGRMRYLRHVPKRFKSNFREGTEATPKKKAAAN

SEQ ID NO: 6728 - protein, 94 aa, Oryza sativa
MGKGTGSFGKRRNKTHTLCVRCGRRSFHLQKSTCSSCGYPAARIRKYNWSVKAIRRKTTGTGRMRYMRHVPRRFKSNFREGTEATPRKRAAVAN

SEQ ID NO: 6729 - protein, 94 aa, Panicum virgatum
MGKGTGSFGKRRNKTHTLCIRCGRRSFHLQKSTCSSCGYPAARIRKYNWSVKAIRRKTTGTGRMRYLRHVPCRFKSNFREGTEATPKKAAAASN

SEQ ID NO: 6730 - protein, 95 aa, Oryza sativa
MGKGTGSFGKRRNKTHTLCVRCGRRSFHLQKSTCSSCGYPAARIRKYNWSVKAIRRKTTGTGRMRYLRHVPKRFKSNFREGTEAAPRKKGAAASN

SEQ ID NO: 6731 - protein, 92 aa, Secale cereale
TKGTGSFGKRRNKTHTLCIRCGRRSFHLQKSTCSSCGYPAARIRKYNWSVKAIRRKTTGTGRMRYMRHVPRRFKSNFREGTEAAPRNRAAAN

SEQ ID NO: 6732 - protein, 93 aa, Eragrostis curvula
MGKGTGSFGKRRNKTHTLCIRCGRRSFHLQKSTCSSCGYPAARIRKYNWSVKAIRRKTTGTGRMRYMRHVPKPFTSNFREGTEAHPKKRAAAN

SEQ ID NO: 6733 - protein, 93 aa, Avena sativa
MTKGTGSFGKRRNKTHTLCIRCGRRSFHLQKSTCSSCGYPAARIRKYNWSVKAIRRKTTGTGRMRYMRHVARRFKSNFREGTEAAPRKRAATN

SEQ ID NO: 6734 - protein, 95 aa, Musa acuminata
MGKGTGSFGKRRNKTHTLCVRCGRRSFHLQKSRCGSCGYPAARIRKYNWSVKAIRRKTTGTGRMRYLRHVPRRFRSNFREGTEATPRKKSASAAV

SEQ ID NO: 6735 - protein, 95 aa, Zingiber officinale
MGKGTGSFGKRRNKTHTLCVRCGRRSFHLQKSRCGSCGYPAARIRKYNWSVKAIRRKTTGTGRMRYLRHVPRRFKNNFREGTEAAPRKKAAAAAV

SEQ ID NO: 6736 - protein, 93 aa, Oryza sativa
GRVRAASASAGTRRTRSASAAAAAASTSRRAPAPPAATPPPASASVSWSVKAIRRKTTGTGRMRYMRHVPRRFKSNFREGAEATPRKRAAAAD

SEQ ID NO: 6737 - protein, 119 aa, Secale cereale
SLLPPLLFPRRRRRRRGGDSRRRNDEGNRELRQAPEQDPHAVHPLRPPQLPPAEEHLLLVRLPRARIRKYNWSVKAIRRKTTGTGRMRYMRHVPRRFKSNFREGTEAAPRSKGASSSGN

SEQ ID NO: 6738 - protein, 96 aa, Unknown
  Sequence found in Organisms: Hordeum vulgare, Secale cereale, Triticum aestivum
MTKGTGSFGKRRNKTHTLCIRCGRRSFHLQKSTCSSCGYPAARIRKYNWSVKAIRRKTTGTGRMRYMRHVPRRFKSNFREGTEAAPRSKGASSSGN

SEQ ID NO: 6739 - protein, 96 aa, Setaria italica
MGKGTGSFGKRRNKTHTLCVRCGRRSFHLQKSTCSSCGYPAARIRKYNWSVKAIRRKTTGTGRMRYLRHVPRRFKSNFREGTEAVSRKKGAAAGTN

SEQ ID NO: 6740 - protein, 96 aa, Lolium multiflorum
MTKGTGSFGKRRNKTHTLCIRCGRRSFHLQKSTCSSCGYPAARIRKYNWSVKAIRRKTTGTGRMRYMRHVPRRFKSNFREGTEAAPRNKGASSSGN

SEQ ID NO: 6741 - protein, 96 aa, Avena sativa
MTKGTGSFGKRRNKTHTLCIRCGRRSFHLQKSTCSSCGYPAARIRKYNWSVKAIRRKTTGTGRMRYMRHVPRRFKSNFREGTEAAPRTKGASSSGN

SEQ ID NO: 6742 - protein, 95 aa, Liriodendron tulipifera
MGKGTGSFGKRRNKTHTLCVRCGRRSFHLQKSRCAACGYPAARIRKYNWSVKAIRRKTTGTGRMRYLRHVARRFKSNFREGTEAAPRKKAAAASF

SEQ ID NO: 6743 - protein, 94 aa, Epimedium sagittatum
MGKGTGSFGKRRNKTHTLCVRCGRRSFHLQKSRCSACAYPAARIRKYNWSVKAIRRKTTGTGRMRYMRNVPRRFKSNFREGTQAAPKKIGAASS

SEQ ID NO: 6744 - protein, 96 aa, Catharanthus roseus
MGKGTGSFGKRRNKTHTLCVRCGRRSFHLQKSRCGSCGYPAARLRKYNWSVKAIRRKTTGTGRMRYLRHVPVRFKTNFREGTEAAPRKKGAAAASS

SEQ ID NO: 6745 - protein, 96 aa, Elaeis guineensis
MGKGTGSFGKRRNKTHTLCVRCGRRSFHLQKSRCASCGYPAARIRKYNWSVKAIRRKTTGTGRMRYLRHLPRRFKSNFREGTQATPRKKTAAAAAL

SEQ ID NO: 6746 - protein, 95 aa, Amborella trichopoda
MGKGTGSFGKRRNKTHTLCVRCGRRSFHLQKSRCSACAYPAARIRKYNWSVKAIRRKTTGTGRMRYLRHMPRRFKSNFREGTEAAPRKKIAAASF

SEQ ID NO: 6747 - protein, 95 aa, Musa acuminata
MGKGTGSFGKRRNKTHTLCVRCGRRSFHLQKSRCGSCGYPAARIRKYNWSVKAIRRRTAGTGRMRYLRHVPRRFRSNFREGTEATPRKKSASAAV

SEQ ID NO: 6748 - protein, 95 aa, Cicer arietinum
MGKGTGSFGKRRNKTHTLCIRCGRRSFHLQKSRCSACAYPAARVRKYNWSVKAIRRKTTGTGRMRYLRHVPRRFKSGFREGTEAAPRKKGAAASA

SEQ ID NO: 6749 - protein, 95 aa, Zingiber officinale
MGKGTGSFGKRRNKTHTLCVRCGRRSFHLQKSRCGSCGYPAARIRKYNWSVKAIRRKTTGTGRMRYLRHVPRRFKNNFREGTEAAPRKKTVAAAV

SEQ ID NO: 6750 - protein, 95 aa, Liriodendron tulipifera
MGKGTGSFGKRRNKTHTLCVRCGRRSFHLQKSRCAACGYPAARIRKYNWSVKAIRRKTTGTGRMRYLRHLPRRFKSNFREGTQAAPRKNAAAAAF

SEQ ID NO: 6751 - protein, 92 aa, Platanus occidentalis
KGTGSFGKRRNKTHTLCVRCGRRSFHLQKSRCAACGYPAARIRKYNWSVKAIRRKTTGTGRMRYLRHLPRRFKSNFREGTEAAPRKKGAAAA

SEQ ID NO: 6752 - protein, 95 aa, Vinca minor
MGKGTGSFGKRRNKTHTLCIRCGRRSFHLQKSRCSACAYPAARKRTYNWSVKAIRRKTTGTGRMRYLRHVPRRFKTNFREGTEAAPRKKAAAAST

SEQ ID NO: 6753 - protein, 93 aa, Zostera marina
MGKGTGSFGKRRNKTHTLCIRCGRRSFHLQKSTCSSCGYPAARIRKYNWSQKALRRKTTGTGRMRYLSNVPRRFKTNFREGTQAAPRKPIAAA

SEQ ID NO: 6754 - protein, 96 aa, Elaeis guineensis
MGKGTGSFGKRRNKTHTLCVRCGRRSFHLQKSRCASCGYPAARIRKYNWSVKAIRRKTTGTGRMRYLRHLPRRFKSNFREGTQATPRKKTAAVAAL

SEQ ID NO: 6755 - protein, 96 aa, Catharanthus roseus
MGKGTGSFGKRRNKTHTLCVRCGRRSFHLQKSRCGSCGYPAARLRKYNWSVKAIRRKTTGTGRMRYLRHVTVRFKTNFREGTEAAPRKKGAAAASS

SEQ ID NO: 6756 - protein, 93 aa, Secale cereale
GTGSFGKRRNKTHTLCIRCGRRSFHLQKSTCSSCGYPAARIRKYNWSVKAIRRKTTGTGRMRYMRHVPRRFKSNFREGTEAAPRSKGASSSGN

SEQ ID NO: 6757 - protein, 96 aa, Amsonia hubrichtii
MGKGTGSFGKRRNKTHTLCVRCGRRSFHLQKSRCGSCGYPAARVRKYNWSVKAIRRKTTGTGRMRYLRHVAVRFKSNFREGMEAAPRKKGAAAASS

SEQ ID NO: 6758 - protein, 96 aa, Aristolochia fimbriata
MGKGTGSFGKRRNKTHTLCVRCGRRSFHLQKSRCAACGYPSSRIRKYNWSVKAIRRKTTGTGRMRYLRHVPRRFKSNFREGTVAAPRKKGAAAASS

SEQ ID NO: 6759 - protein, 96 aa, Avena sativa
MTKGTGSFGKRRNKTHTLCIRCGRRSFHLQKSTCSSCGYPAARIRKYNWSVKAIRRKTTGSGRMRYMRHVPRRFKSNFREGTEAKPRNKGASSSGN

SEQ ID NO: 6760 - protein, 96 aa, Panicum virgatum
MGKGTGSFGKRRNKTHTLCVRCGRRSFHLQKSTCSSCGYPAARIRKYNWSIKAIRRKTTGTGRMRYLRHVPRRFKSNFREGTEAVSRKKGAASSAN

SEQ ID NO: 6761 - protein, 96 aa, Panicum virgatum
MGKGTGSFGKRRNKTHTLCVRCGRRSFHLQKSTCSSCGYPAARIRKYNWSIKAIRRKTTGTGRMRYLRHVPRRFKSNFREGTEAVSRKKGAASGAN

SEQ ID NO: 6762 - protein, 96 aa, Panicum virgatum
MGKGTGSFGKRRNKTHTLCVRCGRRSFHLQKSTCSSCGYPAARIRKYNWSVKAIRRKTTGTGRMRYLRHVPRRFKSNFTEGTEAVSRKKGASAGTN

SEQ ID NO: 6763 - protein, 94 aa, Musa acuminata
MGKGTGSFGKRRNKTHTLCVRCGRRSFHLQKSRCGACGYPSSRIRKYNWSVKAIRRKTTGTGRMRYLRHVPRRFKSNFCEGTQAAPRKKPAAAA

SEQ ID NO: 6764 - protein, 95 aa, Phaseolus coccineus
MGKGTGSFGKRRNKTHTLCVRCGRRSFHLQKSRCSACAFPAARTRKYNWSVKAIRRKTTGTGRMRYLRHVPRRFKSGFREGTEAAPRKRGAAANA

SEQ ID NO: 6765 - protein, 95 aa, Cicer arietinum
MGKGTGSFGKRRNKTHTLCIRCGRRSFHLQKSRCSACAYPAARVRKYNWSVKAIRRKTTGTGRMRYLRHVPRRFKSGFREGTEAAPRKKGGAATA

SEQ ID NO: 6766 - protein, 95 aa, Aristolochia fimbriata
MGKGTGSFGKRRNKTHTLCVRCGRRSFHLQKSRCASCGYPASRIRKYNWSVKAIRRKTTGTGRMRYLRHVPRRFKSGFREGTQAAPRKPAAASSN

SEQ ID NO: 6767 - protein, 94 aa, Musa acuminata
MGKGTGSFGKRRNKTHTLCVRCGRRSFHLQKSRCGACGYPSSRIRKYNWSVKAIRRKTTGTGRMRYLRHVPRRFKNNFREGTQAAPRKKSVAAA

SEQ ID NO: 6768 - protein, 95 aa, Cichorium intybus
MGKGTGSFGKRRNKTHTLCVRCGRRSFHLQKSRCSACAYPAARVRKYNWSVKAIRRKTTGTGRMRYLRHLPRRFKSNFREGTQAAPRKIAAAAST

SEQ ID NO: 6769 - protein, 95 aa, Cirsium arvense
MGKGTGSFGKRRNKTHTLCIRCGRRSFHLQKSRCSACAYPAARVRKYNWSVKAIRRKTTGTGRMRYLRNVPRRFKSNFREGTQAAPRKIAAASSA

SEQ ID NO: 6770 - protein, 95 aa, Unknown
  Sequence found in Organisms: Ipomoea batatas, Salvia sclarea
MGKGTGSFGKRRNKTHTLCVRCGRRSFHLQKSRCSACAYPAARKRTYNWSVKAIRRKTTGTGRMRYLRHVPRRFKTNFREGTEAAPRKKAAAASA

SEQ ID NO: 6771 - protein, 95 aa, Ipomoea nil
MGKGTGSFGKRRNKTHTLCVRCGRRSFHIQKSRCSACAYPAARIRKYNWSVKAIRRKTTGTGRMRYLRNVPRRFKTNFREGTEATPRKKGAAAAS

SEQ ID NO: 6772 - protein, 95 aa, Petunia hybrida
MGKGTGSFGKRRNKTHTLCVRCGRRSFHLQKSRCSACAYPAARLRKYNWSVKALRRKTTGTGRMRYLRNVPRRFKTNFREGTEAAPRKKGAAAAS

SEQ ID NO: 6773 - protein, 95 aa, Tabernaemontana elegans
MGKGTGSFGKRRNKTHTLCVRCGRRSFHLQKSRCAACGYPAARKRKYNWSVKAIRRKTTGTGRMRYLRHVPRRFKTNFREGTQAAPRKKAAAASA

SEQ ID NO: 6774 - protein, 101 aa, Fraxinus spp
SATGQQWGREQGALVRGGTRHTRLCVRCGRRSFHLQKSRCSACAYPAARKRTYNWSVKAIRRKTTGTGRMRYLRHVPRRFKTNFREGTQAAPRKKAAAASA

SEQ ID NO: 6775 - protein, 94 aa, Musa acuminata
MGKGTGSFGKRRNKTHTLCVRCGRRSFHLQKSRCGACGYPSSRIRKYNWSVKAIRRKTTGTGRMRYLRHVPRRFKSNFREGTQAAPRKKAVAAA

SEQ ID NO: 6776 - protein, 99 aa, Phalaenopsis aphrodite
MGKGTGSFGKRRNKTHTLCVRCGRRSFHLQKSTCSSCGYPAARIRKYNWSIKAIRRKTTGTGRMRYLRHLPRRFKSNFREGTQAAPRKRAAAAAASAAF

SEQ ID NO: 6777 - protein, 96 aa, Elaeis guineensis
MGKGTGSFGKRRNKTHTLCVRCGRRSFHLQKSRCAACGYPSARIRKYNWSVKAIRRKTTGTGRMRYLRHVPRRFKSNFREGTQAAPRKKAAASASF

SEQ ID NO: 6778 - protein, 96 aa, Elaeis guineensis
MGKGTGSFGKRRNKTHTLCVRCGRRSFHLQKSRCASCGYPSARIRKYNWSVKAIRRKTTGTGRMRYLRHVPRRFKSNFREGTQATPRNRAAAAASS

SEQ ID NO: 6779 - protein, 96 aa, Allium cepa
MGKGTGSFGKRRNKTHTLCVRCGRRSFHLQKSRCASCGFPAARTRKYNWSVKAIRRKTTGTGRMRYLRHVSRRFKSGFREGTEAAPRKKAAAAASS

SEQ ID NO: 6780 - protein, 96 aa, Ricinus communis
MGKGTGSFGKRRNKTHTLCVRCGRRSFHLQKSRCSACAYPAARKRSYNWSVKAIRRKTTGTGRMRYLRHLPRRFKSGFREGTEAAPRKKGAAAASA

SEQ ID NO: 6781 - protein, 96 aa, Unknown
  Sequence found in Organisms: Euphorbia peplus, Euphorbia esula
MGKGTGSFGKRRNKTHTLCVRCGRRSFHLQKSRCSACAFPAARVRKYNWSEKAIRRKTTGTGRMRYMRHVPRRFKSGFREGTQAAPRKKGAAAASA

SEQ ID NO: 6782 - protein, 95 aa, Musa acuminata
MGKGTGSFGKRRNKTHTLCLRCGRRSFHLQKSRCGSCGYPAARIRKYNWSVKAIRRKTTGTGRMRYLRHVPRRFKSNFREGTQATSRKKAASTEV

SEQ ID NO: 6783 - protein, 94 aa, Musa acuminata
MGKGTGSFGKRRNKTHTLCVRCGRRSFHLQKSRCGACGYPSSRIRKYNWSVKAIRRNTTGTGRMRYLRHVPRRFKNNFREGTQAAPRKKSVAAA

SEQ ID NO: 6784 - protein, 95 aa, Vaccinium corymbosum
MGKGTGSFGKRRNKTHTLCVRCGRRSFHLQKSRCSACAFPAARKRKYNWSVKAIRRKTTGTGRMRYLRNVPRRFKSGFREGTEAAPRKKAAAATA

SEQ ID NO: 6785 - protein, 95 aa, Amsonia hubrichtii
MGKGTGSFGKRRNKTHTLCVRCGRRSFHLQKSRCAACGYPAARKRKYNWSVKAIRRKTTGTGRMRYLRHVPRRFKTNFREGTQAAPRKKAAVASA

SEQ ID NO: 6786 - protein, 95 aa, Ocimum basilicum
MGKGTGSFGKRRNKTHTLCVRCGRRSFHLQKSRCSACAYPAARKRTYNWSVKAIRRKTTGTGRMRYLRHVPRRFKTNFREGTEAAPRKKAVAASA

SEQ ID NO: 6787 - protein, 95 aa, Unknown
  Sequence found in Organisms: Citrus clementina, Citrus sinensis
MGKGTGSFGKRRNKTHTLCVRCGRRSFHIQKSRCSACAYPAARVRKYNWSVKAIRRKTTGTGRMRYLRHVPRRFKSNFREGTEAAPRKKNVAASS

SEQ ID NO: 6788 - protein, 95 aa, Unknown
  Sequence found in Organisms: Cucurbita pepo, Momordica charantia
MGKGTGSFGKRRNKTHTLCVRCGRRSFHLQKSRCSACAFPAARKRKYNWSVKAIRRKTTGTGRMRYMRHVPRRFKSGFREGTEAAPRSKGAAASA

SEQ ID NO: 6789 - protein, 95 aa, Cucurbita pepo
MGKGTGSFGKRRNKTHTLCVRCGRRSFHLQKSRCSACAFPAARKRKYNWSVKAIRRKTTGTGRMRYMRHVPRRFKSGFREGTEAAPRNKGAAASA

SEQ ID NO: 6790 - protein, 95 aa, Cynara scolymus
MGKGTGSFGKRRNKTHTLCVRCGRRSFHLQKSRCSACAYPAARVRKYNWSVKAIRRKTTGTGRMRYLRHLPRRFKSNFREGTQAAPRKIAASAST

SEQ ID NO: 6791 - protein, 95 aa, Taraxacum officinale
MGKGTGSFGKRRNKTHTLCVRCGRRSFHLQKSRCSACAYPAARVRKYNWSVKAIRRKTTGTGRMRYLRNVPRRFKSNFREGTQAAPRKIAAASST

SEQ ID NO: 6792 - protein, 95 aa, Unknown
  Sequence found in Organisms: Solanum melongena, Capsicum annuum
MGKGTGSFGKRRNKTHTLCVRCGRRSFHLQKSRCSACAYPAARKRSYNWSVKAIRRKTTGTGRMRYLRNVPRRFKTNFREGTEAAPRKKAAAASA

SEQ ID NO: 6793 - protein, 94 aa, Fagopyrum esculentum
MGKGTGSFGKRRNKTHTLCVRCGRRSFHLQKSRCSACAYPAARLRKYNWSVKAIRRKTTGTGRMRYLRNVPRRFKTNFREGTQATPRKVSAAAA

SEQ ID NO: 6794 - protein, 95 aa, Unknown
  Sequence found in Organisms: Fraxinus spp, Olea europaea
MGKGTGSFGKRRNKTHTLCVRCGRRSFHLQKSRCSACAYPAARKRTYNWSVKAIRRKTTGTGRMRYLRHVPRRFKTNFREGTQAAPRKKAAAASA

SEQ ID NO: 6795 - protein, 95 aa, Unknown
  Sequence found in Organisms: Ipomoea batatas, Ipomoea nil, Salvia sclarea
MGKGTGSFGKRRNKTHTLCVRCGRRSFHLQKSRCSACAYPAARKRTYNWSVKAIRRKTTGTGRMRYLRNVPRRFKTNFREGTEAAPRKKAAAASA

SEQ ID NO: 6796 - protein, 95 aa, Lactuca sativa
MGKGTGSFGKRRNKTHTLCVRCGRRSFHLQKSRCSACAYPAARVRKYNWSVKAIRRKTTGTGRMRYLRNLPRRFKSNFREGTQAAPRKIAAAAST

SEQ ID NO: 6797 - protein, 95 aa, Glycyrrhiza uralensis
MGKGTGSFGKRRNKTHTLCVRCGRRSFHLQKSRCSACAFPAARTRKYNWSVKAIRRKTTGTGRMRYLRHVPRRFKSGFREGTEAAPRKKGAAASA

SEQ ID NO: 6798 - protein, 94 aa, Medicago truncatula
MGKGTGSFGKRRNKTHTLCVRCGRRSFHLQKSRCSACAYPAARVRKYNWSEKAIRRKTTGTGRMRYLRNVPRRFKSGFREGTEAAPRKKGAASA

SEQ ID NO: 6799 - protein, 95 aa, Unknown
  Sequence found in Organisms: Arachis hypogaea, Sarracenia psittacina
MGKGTGSFGKRRNKTHTLCVRCGRRSFHLQKSRCSACAFPAARKRKYNWSVKAIRRKTTGTGRMRYLRHVPRRFKSGFREGTEAAPRKKGAAASA

SEQ ID NO: 6800 - protein, 95 aa, Arachis hypogaea
MGKGTGSFGKRRNKTHTLCVRCGRRSFHLQKSRCSACAFPAARKRKYNWSVKAIRRKTTGTGRMRYLRHVPRRFKSGFREGTEAAPRKRGAAATA

SEQ ID NO: 6801 - protein, 95 aa, Glycine max
MGKGTGSFGKRRNKTHTLCVRCGRRSFHLQKSRCSACAYPAARTRKYNWSVKAIRRKTTGTGRMRYLRNVPRRFKSGFREGTEAAPRKRGAAASA

SEQ ID NO: 6802 - protein, 95 aa, Camellia sinensis
MGKGTGSFGKRRNKTHTLCVRCGRRSFHLQKSRCSACAFPAARKRTYNWSVKAIRRKTTGTGRMRYLRNVPRRFKSGFREGTEAAPRKKGAAAAS

SEQ ID NO: 6803 - protein, 94 aa, Trigonella foenum-graecum
MGKGTGSFGKRRNKTHTLCVRCGRRSFHLQKSRCSACAYPAARVRKYNWSEKAIRRKTTGTGRMRYLRNVPRRFKSGFREGTEAAPRKKGAATA

SEQ ID NO: 6804 - protein, 95 aa, Vinca minor
MGKGTGSFGKRRNKTHTLCIRCGRRSFHLQKSRCSACAYPAARKRTYNWSVKAIRRKTTGTGRMRYLRHVPRRFKTNFREGTQAAPRNKAAAASA

SEQ ID NO: 6805 - protein, 95 aa, Vinca minor
MGKGTGSFGKRRNKTHTLCIRCGRRSFHLQKSRCSACAYPAARKRTYNWSVKAIRRKTTGTGRMRYLRHVPRRFKTNFREGTQAAPRKKAAVASA

SEQ ID NO: 6806 - protein, 94 aa, Artemisia annua
MGKGTGSFGKRRNKTHTLCVRCGRRSFHLQKSRCSACAYPAARVRKYNWSEKAIRRKTTGTGRMRYMRNVPRRFKSGFREGTQAAPRKIAAASA

SEQ ID NO: 6807 - protein, 94 aa, Artemisia annua
MGKGTGSFGKRRNKTHTLCVRCGRRSFHLQKSRCSACAYPAARLRKYNWSEKAIRRKTTGTGRMRYMRNVPRRFKSGFREGTQAAPRKIAAASA

SEQ ID NO: 6808 - protein, 94 aa, Musa acuminata
MGKGTGSFGKRRNKTHTLCVRCGRRSFHLQKSRCGACGYPSSRIRKYNWSVKAIRRKTTGTGRMRYLRHVPRRFKSNFREGTQAAPRKKAVADA

SEQ ID NO: 6809 - protein, 94 aa, Unknown
  Sequence found in Organisms: Solanum melongena, Capsicum annuum
MGKGTGSFGKRRNKTHTLCVRCGRRSFHLQKSRCSACAYPAARKRTYNWSVKAIRRKTTGTGRMRYLRNVPRRFKTNFREGTEAAPRKKAAASA

SEQ ID NO: 6810 - protein, 94 aa, Vitis vinifera
MGKGTGSFGKRRNKTHTLCVRCGRRSFHLQKSRCAACGFPSSRIRKYNWSVKAIRRKTTGTGRMRYLRHVPCRFKSNFREGTEAAPRKKGAAAS

SEQ ID NO: 6811 - protein, 94 aa, Marchantia polymorpha
MGKGTGSFGKRRNKTHTLCRRCGRRSFHIQKSRCSACAYPAARIRKYNWSVKAIRRKTTGTGRMRHLRHLPRRFKNSFREGTEAAPKKPAAAGV

SEQ ID NO: 6812 - protein, 96 aa, Allium cepa
MGKGTGSFGKRRNKTHTLCVRCGRRSFHLQKSRCASCGFPAARTRKYNWSAKAIRRKTTGTGRMRYLRHLPRRFKSGFREGTEAAPRKKAAAAATS

SEQ ID NO: 6813 - protein, 96 aa, Euphorbia peplus
MGKGTGSFGKRRNKTHTLCVRCGRRSFHLQKSRCSACAFPAARTRKYNWSVKAIRRKTTGTGRMRYLRHVPRRFKSGFREGTQAAPRIKGAAAATA

SEQ ID NO: 6814 - protein, 96 aa, Unknown
  Sequence found in Organisms: Euphorbia peplus, Euphorbia esula
MGKGTGSFGKRRNKTHTLCVRCGRRSFHLQKSRCSACAFPAARVRKYNWSEKAIRRKTTGTGRMRYMRHVPRRFKSGFREGTQAAPRQKGAAAASA

SEQ ID NO: 6815 - protein, 95 aa, Fagus grandifolia
MGKGTGSFGKRRNKTHTLCVRCGRRSFHLQKSRCSACAYPAARKRTYNWSVKAIRRKTTGTGRMRYMRNVPRRFKSGFREGTQAAPRKKGAAATA

SEQ ID NO: 6816 - protein, 95 aa, Vaccinium corymbosum
MGKGTGSFGKRRNKTHTLCVRCGRRSFHLQKSRCSACAFPAARKRKYNWSMKAIRRKTTGTGRMRYLRNVPRRFKSGFREGTEAAPRKKAAAATA

SEQ ID NO: 6817 - protein, 95 aa, Unknown
  Sequence found in Organisms: Gossypium hirsutum, Gossypium raimondii
MGKGTGSFGKRRNKTHTLCVRCGRRSFHLQKSRCGACGYPASRIRKYNWSMKAIRRKTTGTGRMRYLRHVPRRFKTGFREGTEAAPRKKAAVAAS

SEQ ID NO: 6818 - protein, 95 aa, Phaseolus coccineus
MGKGTGSFGKRRNKTHTLCVRCGRRSFHLQKSRCSACAFPAARTRKYNWSVKAIRRKTTGTGRMRYLRHVPRRFKSGFREGTEAAPRKRGAASTA

SEQ ID NO: 6819 - protein, 95 aa, Phaseolus coccineus
MGKGTGSFGKRRNKTHTLCVRCGRRSFHLQKSRCSACAFPAARTRKYNWSVKAIRRKTTGTGRMRYLRHVPRRFKSGFREGTEAAPRKRGAVSNA

SEQ ID NO: 6820 - protein, 95 aa, Theobroma cacao
MGKGTGSFGKRRNKTHTLCVRCGRRSFHLQKSRCAACGFPAARKRKYNWSVKAIRRKTTGTGRMRYLRHVPRRFKSGFREGTQAAPRKKVAAASA

SEQ ID NO: 6821 - protein, 95 aa, Cephalotaxus harringtonia
MGKGTGSFGKRRNKTHTLCVRCGRRSFHIQKSRCSACAYPAARIRKYNWSVKAIRRKTTGTGRMRYLRHMPRRFKNNFREGTQATPRKKAAAASF

SEQ ID NO: 6822 - protein, 95 aa, Unknown
  Sequence found in Organisms: Castanea mollissima, Quercus alba
MGKGTGSFGKRRNKTHTLCVRCGRRSFHLQKSRCSACAYPAARKRTYNWSVKAIRRKTTGTGRMRYLRHVPRRFKSGFREGTQAAPRKKGAAATA

SEQ ID NO: 6823 - protein, 95 aa, Cirsium arvense
MGKGTGSFGKRRNKTHTLCVRCGRRSFHLQKSRCSACAYPAARVRKYNWSEKAIRRKTTGTGRMRYLRNVPRRFKSNFREGTQAAPRKIAASAST

SEQ ID NO: 6824 - protein, 95 aa, Cryptomeria japonica
MGKGTGSFGKRRNKTHTLCVRCGRRSFHIQKSRCSACAYPAARIRKYNWSVKAIRRKTTGTGRMRYLRHMPRRFKNNFREGTQAIPRKKAAAASF

SEQ ID NO: 6825 - protein, 95 aa, Cucurbita pepo
MGKGTGSFGKRRNKTHTLCVRCGRRSFHLQKSRCSACAFPAARKRKYNWSVKAIRRKTTGTGRMRYMRHVPRRFKSGFREGTEAAPRNKGSAASA

SEQ ID NO: 6826 - protein, 95 aa, Cynara scolymus
MGKGTGSFGKRRNKTHTLCVRCGRRSFHLQKSRCSACAYPAARVRKYNWSVKAIRRKTTGTGRMRYLRHLPRRFKSNFREGTQAAPRKIATASSA

SEQ ID NO: 6827 - protein, 94 aa, Fagopyrum esculentum
MTKGTGSFGKRRNKTHTLCVRCGRRSFHLQKSRCSACAYPAARLRKYNWSVKAIRRKTTGTGRMRYLRNVPRRFKTNFREGTQATPRKVSAAAA

SEQ ID NO: 6828 - protein, 95 aa, Fraxinus spp
MGKGTGSFGKRRNKTHTLCVRCGRRSFHIQKSRCSACAYPAARVRKYNWSVKAIRRKTTGTGRMRYLRHVAVRFKSNFREGTQAPPRKKGAAAAS

SEQ ID NO: 6829 - protein, 95 aa, Fraxinus spp
MGKGTGSFGKRRNKTHTLCVRCGRRSFHLQKSRCSACAYPAARKRTYNWSVKAIRRKTTGTGRMRYLRHVPRRFKTNFREGTQAAPRKKTAAASA

SEQ ID NO: 6830 - protein, 95 aa, Vitis vinifera
MGKGTGSFGKRRNKTHTLCVRCGRRSFHLQKSRCAACGFPAARIRKYNWSVKAIRRKTTGTGRMRYLRHVACRFKSNFREGTQAAPRKKGAAASA

SEQ ID NO: 6831 - protein, 95 aa, Ipomoea batatas
MGKGTGSFGKRRNKTHTLCVRCGRRSFHIQKSRCSACAYPAARTRKYNWSVKAIRRKTTGTGRMRYLRHVPRRFKTNFREGTEATPRKKGAAASS

SEQ ID NO: 6832 - protein, 95 aa, Lactuca sativa
MGKGTGSFGKRRNKTHTLCVRCGRRSFHLQKSRCSACAYPAARVRKYNWSVKAIRRKTTGTGRMRYLRNVPRRFKSNFREGTQAAPRKIGAASSA

SEQ ID NO: 6833 - protein, 95 aa, Glycyrrhiza uralensis
MGKGTGSFGKRRNKTHTLCVRCGRRSFHLQKSRCSACAFPAARTRKYNWSVKAIRRKTTGTGRMRYLRHVPRRFKSGFREGTEAAPRKKGGAATA

SEQ ID NO: 6834 - protein, 95 aa, Mimulus guttatus
MGKGTGSFGKRRNKTHTLCVRCGRRSFHLQKSRCSACAYPAARKRTYNWSVKAIRRKTTGTGRMRYLRNVPRRFKTNFREGTEAAPRKKAAVASA

SEQ ID NO: 6835 - protein, 95 aa, Mimulus guttatus
MGKGTGSFGKRRNKTHTLCVRCGRRSFHLQKSRCSACAYPAARKRTYNWSVKAIRRKTTGTGRMRYLRNVPRRFKTNFREGTEAAPRKKVAAASA

SEQ ID NO: 6836 - protein, 95 aa, Nuphar advena
MGKGTGSFGKRRNKTHTLCVRCGRRSFHLQKSRCGSCGYPSARIRKYNWSVKAIRRKTTGSGRMRYLRHMPRRFKSNFREGTQAVPRKRADAASS

SEQ ID NO: 6837 - protein, 95 aa, Orobanche aegyptiaca
MGKGTGSFGKRRNKTHTLCVRCGRRSFHLQKSRCSACAYPAARKRTYNWSVKAIRRKTTGTGRMRYLRHVPRRFKTNFREGTQAAPRKKAADASA

SEQ ID NO: 6838 - protein, 95 aa, Capsicum annuum
MGKGTGSFGKRRNKTHTLCVRCGRRSFHLQKSRCSACAYPAARKRSYNWSVKAIRRKTTGTGRMRYLRNVPRRFKTNFREGTEAAPRKKAAAVSA

SEQ ID NO: 6839 - protein, 95 aa, Petunia hybrida
MGKGTGSFGKRRNKTHTLCVRCGRRSFHLQKSRCSACAYPAARLRKYNWSVKALRRKTTGTGRMRYLRNVPRRFKTNFREGTEAAPRKKGAAASA

SEQ ID NO: 6840 - protein, 95 aa, Plantago ovata
MGKGTGSFGKRRNKTHTLCVRCGRRSFHLQKSRCSACAYPAARKRTYNWSVKAIRRKTTGTGRMRYLRNVPRRFKTNFREGTEAAPRKKSAAASA

SEQ ID NO: 6841 - protein, 94 aa, Unknown
  Sequence found in Organisms: Solanum lycopersicum, Solanum tuberosum, Solanum phureja
MGKGTGSFGKRRNKTHTLCVRCGRRSFHLQKSRCSACAYPAARKRTYNWSVKAIRRKTTGTGRMRYLRNVPRRFKTNFREGTEAAPRKKGVASA

SEQ ID NO: 6842 - protein, 95 aa, Prunus persica
MGKGTGSFGKRRNKTHTLCVRCGRRSFHLQKSRCSACAFPAARKRKYNWSVKAIRRKTTGTGRMRYLRNVPRRFKSGFREGTEAAPRKKGAAATA

SEQ ID NO: 6843 - protein, 95 aa, Sesamum indicum
MGKGTGSFGKRRNKTHTLCVRCGRRSFHLQKSRCAACAYPAARKRTYNWSVKAIRRKTTGTGRMRYLRHVPRRFKTNFREGTQAAPRKKAAAASA

SEQ ID NO: 6844 - protein, 95 aa, Unknown
  Sequence found in Organisms: Rosa hybrid cultivar, Fragaria vesca
MGKGTGSFGKRRNKTHTLCVRCGRRSFHLQKSRCSACAYPAARTRKFNWSVKAIRRKTTGTGRMRYLRNVPRRFKSGFREGTEAAPRKKGAAASA

SEQ ID NO: 6845 - protein, 95 aa, Helianthus annuus
MGKGTGSFGKRRNKTHTLCVRCGRRSFHLQKSRCSACAYPAARVRKYNWSEKAIRRKTTGTGRMRYLRNVPRRFKSGFREGTQAAPRKIAAAASS

SEQ ID NO: 6846 - protein, 95 aa, Helianthus annuus
MGKGTGSFGKRRNKTHTLCVRCGRRSFHLQKSRCSACAYPAARVRKYNWSEKAIRRKTTGTGRMRYLRNVPRRFKSGFREGTQAAPRKIAAAASA

SEQ ID NO: 6847 - protein, 95 aa, Solanum lycopersicum
MGKGTGSFGKRRNKTHTLCVRCGRRSFHIQKSRCSACAYPAARLRKYNWSVKALRRKTTGTGRMRYLRNVPRRFKTNFREGTEAAPRKKGTAAAS

SEQ ID NO: 6848 - protein, 95 aa, Tragopogon dubius
MGKGTGSFGKRRNKTHTLCVRCGRRSFHLQKSRCSACAYPAARVRKYNWSEKAIRRKTTGTGRMRYLRHLPRRFKSNFREGTQAAPKKIAATSSA

SEQ ID NO: 6849 - protein, 95 aa, Trigonella foenum-graecum
MGKGTGSFGKRRNKTHTLCVRCGRRSFHLQKSRCSACAYPAARVRKYNWSEKAIRRKTTGTGRMRYLRNVPRRFKSGFREGTEAAPRKKGAAASA

SEQ ID NO: 6850 - protein, 94 aa, Zostera marina
MGKGTGSFGKRRNKTHTLCVRCGRRSFHLQKSRCASCGYPAARIRKYNWSVKALRRKTTGTGRMRHLRHLPRRFKSGFREGSEAAPKNRSATVA

SEQ ID NO: 6851 - protein, 138 aa, Picea glauca
MGKGTGSFGKRRNKTHTLCIRCGRRSFHIQKSRCSACAYPSKRIRKYNWSVKAIRRKTTGTGRMRYLRHMPRRFKNNFREGTQATPRRRLLLPHFKLALRNGPEIFCRVLTFVVELARLDLFSYAVIDSFIFFHNSWF

SEQ ID NO: 6852 - protein, 73 aa, Citrullus lanatus
MLFMEFLMIVSRPLSPLVNLCLELYTSSSSHFRRFLLVDIVSLKARVESISKKFGCLDHLLMFELFLILGLKP

SEQ ID NO: 6853 - protein, 92 aa, Amborella trichopoda
MGKGTGSFGKRRNKTHTICIRCGRRSFHLQKSRCASCGYPAARIRKYNWSVKAIRRKTTGTGRMRYLRHMARRFKSGFREGTEAAPRRKTAT

SEQ ID NO: 6854 - protein, 94 aa, Musa acuminata
MGKGTGSFGKRRNKTHTLCVRCGRRSFHLQKSRCGACGYPSSRIRKYNWSVKAIRRKTTGTGRMRYLRHVPRRFKSNFREGTQAVPRKKAVADA

SEQ ID NO: 6855 - protein, 94 aa, Beta vulgaris
MGKGTGSFGKRRNKTHTLCVRCGRRSFHLQKSRCSACAYPAARVRKYNWSVKAIRRKTTGTGRMRYLRNVPRRFKTGFREGTQAAPRKHVAAAS

SEQ ID NO: 6856 - protein, 94 aa, Amorphophallus konjac
MGKGTGSFGKRRNKTHTLCVRCGRRSFHLQKSRCGSCGYPSARIRKYNWSVKALRRKTTGTGRMRYLRHVPRRFKTNFREGTQAKPRRAAAASA

SEQ ID NO: 6857 - protein, 94 aa, Antirrhinum majus
MGKGTGSFGKRRNKTHTLCVRCGRRSFHLQKSRCSACAYPAARKRTYNWSVKAIRRKTTGTGRMRYMRHVTRRFKTGFREGTQAAPRKVAAASA

SEQ ID NO: 6858 - protein, 94 aa, Beta vulgaris
MGKGTGSFGKRRNKTHTLCVRCGRRSFHLQKSRCSACAYPAARVRKYNWSVKAIRRKTTGTGRMRYLRNVPRRFKTGFREGTQAAPRKHAAASS

SEQ ID NO: 6859 - protein, 94 aa, Fagopyrum esculentum
MGKGTGSFGKRRNKTHTLCVRCGRRSFHLQKSRCSACAYPAARLRKYNWSVKAIRRKTTGTGRMRYLRNVPRRFKTNFREGTQAAPRKQVAASS

SEQ ID NO: 6860 - protein, 94 aa, Fagopyrum esculentum
MGKGTGSFGKRRNKTHTLCVRCGRRSFHLQKSRCSACAYPAARLRKYNWSVKAIRRKTTGTGRMRYLRNVPRRFKTNFREGTQAAPRKQVAASA

SEQ ID NO: 6861 - protein, 94 aa, Mesembryanthemum crystallinum
MGKGTGSFGKRRNKTHTLCVRCGRRSFHLQKSRCSACAFPAARVRKYNWSVKAIRRKTTGTGRMKYLRNVPRRFKSGFREGTEAAPRKKAAASS

SEQ ID NO: 6862 - protein, 94 aa, Carica papaya
MGKGTGSFGKRRNKTHTLCVRCGRRSFHLQKSRCAACGFPAARKRKYNWSVKAIRRKTTGTGRMRYLRHVPRRFKSGFREGTQATPRKAAAAST

SEQ ID NO: 6863 - protein, 94 aa, Platanus occidentalis
MGKGTGSFGKRRNKTHTLCVRCGRRSFHLQKSRCAACGYPSSRIRKYNWSVKAIRRKTTGTGRMRYLRHLPRRFKSNFREGTQAAPRNKGAAAV

SEQ ID NO: 6864 - protein, 94 aa, Tamarix hispida
MGKGTGSFGKRRNKTHTLCVRCGRRSFHLQKSRCSACAFPAARKRTYNWSVKAIRRKTTGTGRMRYLRHVPRRFKTNFREGTQAAPRKQAAASA

SEQ ID NO: 6865 - protein, 94 aa, Tamarix hispida
MGKGTGSFGKRRNKTHTLCVRCGRRSFHLQKSRCSACAFPAARKRKYNWSIKAIRRKTTGTGRMRYLRHVPRRFKTNFREGTEAAPRKQTASAS

SEQ ID NO: 6866 - protein, 94 aa, Tamarix hispida
MGKGTGSFGKRRNKTHTLCVRCGRRSFHLQKSRCSACAFPAARKRKYNWSVKAIRRRTTGTGRMRYLRHVPRRFKTNFREGTQAAPRKQAAATA

SEQ ID NO: 6867 - protein, 94 aa, Nicotiana tabacum
MGKGTGSFGKRRNKTHTLCVRCGRRSFHLQKSRCSACAYPAARKRTYNWSVKAIRRKTTGTGRMRYLRNVPRRFKTNFREGTEAAPRKKAAVSA

SEQ ID NO: 6868 - protein, 96 aa, Phalaenopsis aphrodite
KGTGSFGKRRNKTHTLCVRCGRRSFHLQKSTCSSCGYPAARIRKYNWSIKAIRRKTTGTGRMRYLRHLPRRFKSNFREGTQATPRKRAAAAAPSAF

SEQ ID NO: 6869 - protein, 96 aa, Unknown
  Sequence found in Organisms: Cannabis sativa, Humulus lupulus
MGKGTGSFGKRRNKTHTLCVRCGRRSFHLQKSRCSACAYPAARKRTYNWSVKAIRRKTTGTGRMRYLRNVPRRFKSGFREGTQAAPRSKGAAAATA

SEQ ID NO: 6870 - protein, 96 aa, Elaeis guineensis
MGKGTGSFGKRRNKTHTLCVRCGRRSFHLQKSRCAACGYPSARIRKYNWSVKAIRRKTTGTGRMRYLRHVPRRFKSNFREGTQATPRKRAVASASS

SEQ ID NO: 6871 - protein, 96 aa, Allium cepa
MGKGTGSFGKRRNKTHTLCVRCGRRSFHLQKSRCASCGFPAARLRKYNWSEKAIRRKTTGTGRMRYLRHVSRRFKSGFREGTQAAPRKKAAAAATS

SEQ ID NO: 6872 - protein, 96 aa, Ricinus communis
MGKGTGSFGKRRNKTHTLCVRCGRRSFHLQKSRCSACAYPASRLRKYNWSVKAIRRKTTGTGRMRYLRHVPRRFKTNFREGTQAPPRNKGAAAATA

SEQ ID NO: 6873 - protein, 96 aa, Flaveria ramosissima
MGKGTGSFGKRRNKTHTLCVRCGRRSFHLQKSRCSACAYPAARLRKYNWSEKAIRRKTTGTGRMRYLRNVPRRFKSNFREGTQATPRTKGAAAAST

SEQ ID NO: 6874 - protein, 96 aa, Linum usitatissimum
MGKGTGSFGKRRNKTHTLCVRCGRRSFHLQKSRCSACAYPAARVRKYNWSEKAIRRKTTGTGRMRYMRHLPRRFKSGFREGTQAAPRTKGTAAAST

SEQ ID NO: 6875 - protein, 95 aa, Actinidia deliciosa
MGKGTGSFGKRRNKTHTLCVRCGRRSFHLQKSRCSACAFPAARKRTYNWSVKAIRRKTTGTGRMRYLRNVPRRFKSGFREGTQAAPRKIGSAAAA

SEQ ID NO: 6876 - protein, 95 aa, Unknown
  Sequence found in Organisms: Solanum tuberosum, Solanum phureja
MGKGTGSFGKRRNKTHTLCVRCGRRSFHIQKSRCSACAYPAARLRKYNWSVKALRRKTTGTGRMRYLRNVPRRFKTNFREGTEAAPRKKGTAAAA

SEQ ID NO: 6877 - protein, 95 aa, Fagus grandifolia
MGKGTGSFGKRRNKTHTLCVRCGRRSFHLQKSRCSACAYPASRIRKYNWSVKAIRRKTTGTGRMRYLRNVPRRFKTNFREGTQATPRNKGTAAAS

SEQ ID NO: 6878 - protein, 95 aa, Centaurea maculosa
MGKGTGSFGKRRNKTHTLCVRCGRRSFHLQKSRCSACAYPAARVRKYNWSEKAIRRKTTGTGRMRYLRHLPRRFKSNFREGTQAAPRKIGAASSA

SEQ ID NO: 6879 - protein, 95 aa, Unknown
  Sequence found in Organisms: Centaurea maculosa, Cirsium arvense
MGKGTGSFGKRRNKTHTLCVRCGRRSFHLQKSRCSACAYPAARVRKYNWSEKAIRRKTTGTGRMRYLRHLPRRFKSNFREGTQAAPRKIGASAST

SEQ ID NO: 6880 - protein, 95 aa, Centaurea maculosa
MGKGTGSFGKRRNKTHTLCVRCGRRSFHLQKSRCSACAYPAARLRKYNWSEKAIRRKTTGTGRMRYLRHLPRRFKSNFREGTQAAPRKIGAASSA

SEQ ID NO: 6881 - protein, 95 aa, Gossypium hirsutum
MGKGTGSFGKRRNKTHTLCVRCGRRSFHLQKSRCSACAFPAARKRTYNWSVKAIRRKTTGTGRMRYLRHVPRRFKTGFREGTEAAPRKKVAAAFA

SEQ ID NO: 6882 - protein, 95 aa, Unknown
  Sequence found in Organisms: Gossypium hirsutum, Gossypium raimondii
MGKGTGSFGKRRNKTHTLCVRCGRRSFHLQKSRCSACAFPAARKRTYNWSVKAIRRKTTGTGRMRYLRHVPRRFKTGFREGTEAAPRKKVAAASA

SEQ ID NO: 6883 - protein, 95 aa, Gossypium hirsutum
MGKGTGSFGKRRNKTHTLCVRCGRRSFHLQKSRCGACGYPASRIRKYNWSVKAIRRKTTGTGRMRYLRHVPRRFKTEFREGTQATPRKKAAVAAS

SEQ ID NO: 6884 - protein, 95 aa, Gossypium raimondii
MGKGTGSFGKRRNKTHTLCVRCGRRSFHLQKSRCGACGYPASRIRKYNWSVKAIRRKTTGTGRMRYLRRVPRRFKTGFREGTQATPRKKGAVAAS

SEQ ID NO: 6885 - protein, 95 aa, Catharanthus roseus
MGKGTGSFGKRRNKTHTLCVRCGRRSFHLQKSRCSACAYPAARKRTYNWSVKAIRRKTTGTGRMKYLRHVPRRFKTNFREGTQAAPRKKVAAASA

SEQ ID NO: 6886 - protein, 95 aa, Plantago ovata
MGKGTGSFGKRRNKTHTLCVRCGRRSFHLQKSRCSACAYPAARKRTYNWSVKAIRRKTTGTGRMRYLRNVPRRFKTGFREGTEAAPRKKSAAASA

SEQ ID NO: 6887 - protein, 95 aa, Picea glauca
MGKGTGSFGKRRNKTHTLCIRCGRRSFHIQKSRCSACAYPSKRIRKYNWSVKAIRRKTTGTGRMRYLRHMPRRFKNNFREGTQATPKKKAAATTF

SEQ ID NO: 6888 - protein, 94 aa, Amorphophallus konjac
MGKGTGSFGKRRNKTHTLCVRCGRRSFHLQKSRCGACGYPSSRIRKYNWSVKAIRRKTTGTGRMRYLRHVPRRFKTGFREGTQAAPRKQSTASA

SEQ ID NO: 6889 - protein, 89 aa, Persea americana
SFGKRRNKTHTLCIRCGRRSFHLQKSRCAACGYPAARIRKYNWSVKAIRRKTTGTGRMRYLRHLPRRFKSNFREGTEAAPRKKAAAASF

SEQ ID NO: 6890 - protein, 95 aa, Ocimum basilicum
MGKGTGSFGKRRNKTHTLCVRCGRRSFHLQKSRCSACAYPAARKRTYNWSVKAIRRKTTGTGRMRYLRNVARRFKTNFREGTEAAPRKKAAVASA

SEQ ID NO: 6891 - protein, 95 aa, Theobroma cacao
MGKGTGSFGKRRNKTHTLCVRCGRRSFHLQKSRCGACGYPASRIRKYNWSVKAIRRKTTGTGRMRYLRHVPRRFKTGFREGTQATPRKKAAVAAS

SEQ ID NO: 6892 - protein, 95 aa, Catharanthus roseus
MGKGTGSFGKRRNKTHTLCVRCGRRSFHLQKSRCSACAYPAARKRTYNWSVKAIRRKTTGTGRMKYLRHVPRRFKTNFREGTQAAPRKKVAAAST

SEQ ID NO: 6893 - protein, 95 aa, Cephalotaxus harringtonia
MGKGTGSFGKRRNKTHTLCVRCGRRSFHIQKSRCSACAYPAARIRKYNWSVKAIRRKTTGTGRMRYLRHMPRRFKNNFREGTQATPRKKAAATSF

SEQ ID NO: 6894 - protein, 95 aa, Unknown
  Sequence found in Organisms: Citrus sinensis, Citrus clementina, Citrus sinensis
MGKGTGSFGKRRNKTHTLCVRCGRRSFHLQKSRCAACAYPAARKRTYNWSVKAIRRKTTGTGRMRYLRHVPRRFKSGFREGTQAAPRKKGAAASA

SEQ ID NO: 6895 - protein, 95 aa, Coffea canephora
MGKGTGSFGKRRNKTHTLCVRCGRRSFHLQKSRCAACAYPAARKRTYNWSVKAIRRKTTGTGRMRYLRHVPRRFKTNFREGTQAAPRKKVAAASA

SEQ ID NO: 6896 - protein, 94 aa, Gossypium hirsutum
GKGTGSFGKRRNKTHTLCVRCGRRSFHLQKSRCSACAFPAARKRKYNWSVKAIRRKTTGTGRMRYLRHVPRRFKTGFREGTEAAPRKKVAAASA

SEQ ID NO: 6897 - protein, 95 aa, Gossypium hirsutum
MGKGTGSFGKRRNKTHTLCVRCGRRSFHLQKSRCSACAFPAARKRKYNWSVKAIRRKTTGTGRMRYLRHVPRRFKTGFREGSEAAPRKKVAAASA

SEQ ID NO: 6898 - protein, 95 aa, Gossypium hirsutum
MGKGTGSFGKRRNKTHTLCVRCGRRSFHLQKSRCSACGYPASRIRKYNWSVKAIRRKTTGTGRMRYLRHLPRRFKTGFREGTQATPRKKAAVAAS

SEQ ID NO: 6899 - protein, 95 aa, Gossypium hirsutum
MGKGTGSFGKRRNKTHTLCVRCGRRSFHLQKSRCGACGYPASRIRKYNWSMKAIRRKTTGTGRMRYLRHVPRRFKTGFREGTQATPRKKGAVAAS

SEQ ID NO: 6900 - protein, 95 aa, Vigna unguiculata
MGKGTGSFGKRRNKTHTLCVRCGRRSFHLQKSRCAACAFPAARTRKYNWSVKAIRRKTTGTGRMRYLRHVPRRFKSGFREGTEAAPRKRGAATTA

SEQ ID NO: 6901 - protein, 95 aa, Vigna unguiculata
MGKGTGSFGKRRNKTHTLCVRCGRRSFHLQKSRCAACAFPAARTRKYNWSVKAIRRKTTGTGRMRYLRHVPRRFKSGFREGTEAAPRKRGAASTT

SEQ ID NO: 6902 - protein, 95 aa, Vigna unguiculata
MGKGTGSFGKRRNKTHTLCVRCGRRSFHLQKSRCAACAFPAARTRKYNWSVKAIRRKTTGTGRMRYLRHVPRRFKSGFREGTEAAPRKRGAATTV

SEQ ID NO: 6903 - protein, 95 aa, Cryptomeria japonica
MGKGTGSFGKRRNKTHTLCVRCGRRSFHIQKSRCSACAYPAARIRKYNWSVKAIRRKTTGTGRMRYLRHMPRRFKNNFREGTQAVPRKKVAAASF

SEQ ID NO: 6904 - protein, 95 aa, Unknown
  Sequence found in Organisms: Cucumis sativus, Cucumis melo
MGKGTGSFGKRRNKTHTLCVRCGRRSFHLQKSRCAACAFPAARKRKYNWSVKAIRRKTTGTGRMRYLRHVPRRFKSGFREGTEAAPRNKGAAASA

SEQ ID NO: 6905 - protein, 95 aa, Cucurbita pepo
MGKGTGSFGKRRNKTHTLCVRCGRRSFHLQKSRCSACAFPAARKRSYNWSVKAIRRKTTGTGRMRYMRHVPRRFKSGFREGTQAAPRSKGAAASA

SEQ ID NO: 6906 - protein, 95 aa, Cycas rumphii
MGKGTGSFGKRRNKTHTLCVRCGRRSFHIQKSRCSACAYPAKRIRKYNWSVKAIRRKTTGTGRMRYLRHMPRRFKNNFREGTQATPRKKAAAASF

SEQ ID NO: 6907 - protein, 95 aa, Eucalyptus grandis
MGKGTGSFGKRRNKTHTLCVRCGRRSFHLQKSRCGACGFPSARKRKYNWSVKAIRRKTTGTGRMRYLRNVPRRFKSGFREGTEAAPRKHAGAATA

SEQ ID NO: 6908 - protein, 95 aa, Fraxinus spp
MGKGTGSFGKRRNKTHTLCVRCGRRSFHIQKSRCSACAYPAARKRTYNWSVKAIRRKTTGTGRMRYLRHVPRRFKTNFREGTQAAPRKKGAAASA

SEQ ID NO: 6909 - protein, 95 aa, Heritiera littoralis
MGKGTGSFGKRRNKTHTLCVRCGRRSFHLQKSRCAACGFPAARKRTYNWSVKAIRRKTTGTGRMRYLRHVPRRFKSGFREGTQAAPRKKVAAASA

SEQ ID NO: 6910 - protein, 95 aa, Actinidia deliciosa
MGKGTGSFGKRRNKTHTLCVRCGRRSFHLQKSRCSACAFPAARKRTYNWSVKAIRRKTTGTGRMRYLRNVPRRFKSGFREGTEAAPRKKGAAAPA

SEQ ID NO: 6911 - protein, 95 aa, Lactuca sativa
MGKGTGSFGKRRNKTHTLCVRCGRRSFHLQKSRCSACAYPAARVRKYNWSVKAIRRKTTGTGRMRYLRNLPRRFKSNFREGTQAAPRKIGAASSS

SEQ ID NO: 6912 - protein, 95 aa, Medicago truncatula
MGKGTGSFGKRRNKTHTLCVRCGRRSFHLQKSRCSACAYPAARVRKYNWSEKAIRRKTTGTGRMRYLRNVPRRFKSGFREGTEAAPRNKGAAAST

SEQ ID NO: 6913 - protein, 95 aa, Momordica charantia
MGKGTGSFGKRRNKTHTLCVRCGRRSFHLQKSRCSACAFPAARKRKYNWSVKAIRRKTTGTGRMRYMRHVPRRFKSGFREGTQAAPRGKGAATSA

SEQ ID NO: 6914 - protein, 95 aa, Unknown
  Sequence found in Organisms: Nicotiana benthamiana, Nicotiana tabacum
MGKGTGSFGKRRNKTHTLCVRCGRRSFHIQKSRCSACAYPAARLRKYNWSVKALRRKTTGTGRMRYLRNVPRRFKTNFREGTEATPRKKGAAVAS

SEQ ID NO: 6915 - protein, 95 aa, Unknown
  Sequence found in Organisms: Nicotiana benthamiana, Orobanche aegyptiaca, Nicotiana tabacum
MGKGTGSFGKRRNKTHTLCVRCGRRSFHLQKSRCSACAYPAARLRKYNWSEKALRRKTTGTGRMRYLRNVPRRFKTGFREGTEAAPRKKAAAAST

SEQ ID NO: 6916 - protein, 95 aa, Orobanche aegyptiaca
MGKGTGSFGKRRNKTHTLCVRCGRRSFHLQKSRCSACAYPAARKRTYNWSVKAIRRKTTGTGRMRYLRHVPRRFKTNFREGTQAAPRKKATAGSA

SEQ ID NO: 6917 - protein, 93 aa, Pisum sativum
GKGTGSFGKRRNKTHTLCVRCGRRSFHLQKSCCSACAYPAARVRKYNWSVKAIRRKTTGTGRMRYLRNVPRRSKSGFREGTEAAPRKKGAVTA

SEQ ID NO: 6918 - protein, 95 aa, Lippia dulcis
MGKGTGSFGKRRNKTHTLCVRCGRRSFHLQKSRCSACAYPAARKRTYNWSVKAIRRKTTGTGRMRYLRNVPRRFKTNFREGTQAAPRKKAAAVSA

SEQ ID NO: 6919 - protein, 95 aa, Lippia dulcis
MGKGTGSFGKRRNKTHTLCVRCGRRSFHLQKSRCSACAYPAARKRTYNWSVKAIRRKTTGTGRMRYLRNVPRRFKTNFREGTEAAARKKAAAVSA

SEQ ID NO: 6920 - protein, 95 aa, Cajanus cajan
MGKGTGSFGKRRNKTHTLCVRCGRRSFHLQKSRCAACAFPAARKRKYNWSVKAIRRKTTGTGRMRYLRNVPRRFKSGFREGTEAAPRKKGAAATA

SEQ ID NO: 6921 - protein, 95 aa, Unknown
  Sequence found in Organisms: Solanum lycopersicum, Solanum tuberosum, Solanum phureja
MGKGTGSFGKRRNKTHTLCVRCGRRSFHLQKSRCSACAYPAARKRSYNWSVKAIRRKTTGTGRMRYLRNVPRRFKTNFREGTEAAPRKKGTAASA

SEQ ID NO: 6922 - protein, 95 aa, Sciadopitys verticillata
MGKGTGSFGKRRNKTHTLCVRCGRRSFHIQKSRCSACAYPSARIRKYNWSVKAIRRKTTGTGRMRYLRHMPRRFKNNFREGTQATPRKKAAAASF

SEQ ID NO: 6923 - protein, 95 aa, Sequoia sempervirens
MGKGTGSFGKRRNKTHTLCVRCGRRSFHIQKSRCSACAYPAARIRKYNWSVKAIRRKTTGTGRMRYLRHMPRRFKNNFREGTQAIPRKKAAATSF

SEQ ID NO: 6924 - protein, 95 aa, Camellia sinensis
MGKGTGSFGKRRNKTHTLCVRCGRRSFHLQKSRCSACAFPAARKRTYNWSVKAIRRKTTGTGRMRYLRNVPRRFKSGFREGTEAAPRKKGAAATS

SEQ ID NO: 6925 - protein, 95 aa, Triphysaria pusilla
MTKGTGSFGKRRNKTHTLCVRCGRRSFHLQKSRCSACAYPAARKRTYNWSVKAIRRKTTGTGRMRYLRNVPRRFKTNFREGTVAAPRKKAAAASA

SEQ ID NO: 6926 - protein, 95 aa, Utricularia gibba
MGKGTGSFGKRRNKTHTLCVRCGRRSFHLQKSRCAACAYPAARKRTYNWSVKAIRRKTTGTGRMRYLRHVPRRFKTNFREGTQAAPRNKAAAASA

SEQ ID NO: 6927 - protein, 94 aa, Ambrosia trifida
GKVQEALVNEGTKHIHCVSDVVAVASHLQKSRCSACAYPAARVRKYNWSEKAIRRKTTGTGRMRYLRNVPRRFKTGFREGTQAAPRKTAAAASA

SEQ ID NO: 6928 - protein, 60 aa, Musa acuminata
AARVLSRATAMGKGTGSFGKRRNKTTPSASAAAAAAFTYRRAAAEHAAILPAGSANIIGV

SEQ ID NO: 6929 - protein, 526 aa, Cirsium arvense
MAGQKNDYEKRSHYQPDFPGSEKRTNPGDERESHAIGPDDTVYRYLCPGRKIGSIIGRGGEIVKQLRSDTQAKIRINESVPGCEERVVIIYSSGEETNSFGDSDDLVSPAQDALFKVHDRIIAEEAPIDDEVDEVQQVTVRMLVPSDQIGCVIGKGGQVVQTIRSETRAQIRILSSEHLPNCALSTDELLQISGEATVVRNALYQLASRLHDNPSRSQHLLLSSSNLHRAGGGYMGPNSGAPPMGVVSLMGPYGSYRNDGGDWAASAKEFSLRFVCPTENIGAVIGKGGVIIKQMRQESGASIKVDSSAAEGDDCLITVSAREVFEETSPTIDAAMRLQPRCSEKSEKDSGVFILTTRLLVPSSRIGCLIGKGGSIISEMRSLTRANIRILSTENLPKVASEDEEMVQISGDPNVASNALLQVTTRLRANVFEMEGTRAALPPAIPYLPVEMADSSRYGNRDGNSRGRGHASHSGRYDPELPPGDNYGGSQIPGSGYGSYGVYPGRSTGGGLSNPNPVSHGKHHGY

SEQ ID NO: 6930 - protein, 322 aa, Cirsium arvense
MAKRWINGDETAKQMLGRVLKERPLLLLPHPLHRIPLGVSNIVEIVGPSPSAKTEILLHVAVSCILPKSWNGIQYGGLEHSVLFLDLDCRLDIFRLSQSLKLRIAETNKLHKITKKQKGVDLSNRISDHQFEYDDMDLFTECMKRFSYTRCYDSFEFLAALKVLHHKLEKERNTKDGNGIHVLMIDNIGAFYWINRGFSSLPQGNPNRKNLSLQSVFETVVPEIKKLLVLHPMLVLATKMVTYQVKSSYSRWVSEVNIEKGTYREYMPSIWQSFVTHRILVRTSDDKRKIQDQVCYLAEWLLPALNLTDEFVVGDAGILTLV

SEQ ID NO: 6931 - protein, 111 aa, Cucurbita pepo
CINGEGTGSFGKRRNKTHTLCVRCGRRSFHLQKSRCSACAFPAARKRKYNWSVKAIRRKTTGTGRMRYMRHVPRRFKSGFREGTEAAPEIKDLQHQRKVLEEVRLNLLAPN

SEQ ID NO: 6932 - protein, 96 aa, Pinus pinaster
MGKGTGSFGKRRNKTHTLCIRCGRRSFHIQKSRCSACAYPSKRIRKYNWSVKAIRRKTTGTGRMRYLRHMPRRFKNNFREGTQATPRRRLLQPHFK

SEQ ID NO: 6933 - protein, 134 aa, Juglans hindsii x Juglans regia
AGLYKPPYKIDIQSPLRRSFISYPKQHLLSLGQVFCICPNGKGNGELRKEEDKTHTLCVRCGRRSFHLQKSRCAACAYPAARKRTYNWSVKAIRRKTTGTGRMRYLRHVPRRFKSGFREGTQAAPRKKGAAATA

SEQ ID NO: 6934 - protein, 94 aa, Amaranthus tuberculatus
MGKGTGSFGKRRNKTHTLCVRCGRRSFHLQKSRCGGCGFPSARKRKYNWSVKAIRRKTTGTGRMRYLRNVPRRFKTGFREGTEAAPRKQVAAAS

SEQ ID NO: 6935 - protein, 94 aa, Artemisia annua
MGKGTGSFGKRRNKTHTLCVRCGRRSFHLQKSRCSACAYPAARVRKYNWSEKAIRRKTTGTGRMRYLRNVPRRFKSGFREGTQAVPRKVAAASA

SEQ ID NO: 6936 - protein, 94 aa, Cyamopsis tetragonoloba
MGKGTGSFGKRRNKTHTLCVRCGRRSFHLQKSRCAACAFPAARNRKYNWSVKAIRRKTTGTGRMRYLRNVPRRFKSGFREGTEAAPRKRGAATA

SEQ ID NO: 6937 - protein, 94 aa, Gnetum gnemon
MGKGTGSFGKRRNKTHTLCIRCGRRSFHLQKSRCGACAYPAARLRKYNWSVKAIRRKTTGTGRMRYLRHLPRRFKNNFREGTQATSKKRAAVQA

SEQ ID NO: 6938 - protein, 94 aa, Lotus japonicus
MGKGTGSFGKRRNKTHTLCVRCGRRSFHLQKSRCAACAFPAARKRKYNWSVKAIRRKTTGTGRMRYLRNVPRRFKSGFREGTEAAPRNKGAAAS

SEQ ID NO: 6939 - protein, 94 aa, Silene vulgaris
MGKGTGSFGKRRNKTHTLCVRCGRRSFHLQKSRCSACAFPAARTRKYNWSVKAIRRKTTGTGRMRYLRNVPRRFKTGFREGTQAAPRKQVAAAS

SEQ ID NO: 6940 - protein, 97 aa, Flaveria ramosissima
MGKGTGSFGKRRNKTHTLCVRCGRRSFHLQKSRCSACAYPAARLRKYNWSEKAIRRKTTGTGRMRYLRNVPRRFKSNFREGTQATPRTKGAAAAAST

SEQ ID NO: 6941 - protein, 96 aa, Unknown
  Sequence found in Organisms: Ambrosia trifida, Helianthus annuus
MGKGTGSFGKRRNKTHTLCVRCGRRSFHLQKSRCSACAYPAARVRKYNWSVKAIRRKTTGTGRMRYLRNVPRRFKSGFREGTQATPRSKGTAAAST

SEQ ID NO: 6942 - protein, 96 aa, Manihot esculenta
MGKGTGSFGKRRNKTHTLCVRCGRRSFHLQKSRCGACAYPASRVRKYNWSVKAIRRKTTGTGRMRYLRHVPRRFKTNFREGTQATPRNKGAAAASS

SEQ ID NO: 6943 - protein, 96 aa, Unknown
  Sequence found in Organisms: Castanea mollissima, Quercus alba
MGKGTGSFGKRRNKTHTLCVRCGRRSFHLQKSRCSACAYPAARVRKYNWSVKAIRRKTTGTGRMRYLRNVPRRFKTNFREGTQATPRNKGTAAASS

SEQ ID NO: 6944 - protein, 96 aa, Flaveria ramosissima
MGKGTGSFGKRRNKTHTLCVRCGRRSFHLQKSRCSACAYPAARLRKYNWSEKAIRRKTTGTGRMRYLRNVPRRFKGNFREGTQATPRTKGAAAAST

SEQ ID NO: 6945 - protein, 96 aa, Linum usitatissimum
MGKGTGSFGKRRNKTHTLCVRCGRRSFHLQKSRCSACAYPAARVRKYNWSEKAIRRKTTGTGRMRYMRHMARRFKSGFREGTQAAPRTKGTAAASS

SEQ ID NO: 6946 - protein, 96 aa, Carthamus tinctorius
MGKGTGSFGKRRNKTHTLCVRCGRRSFHLQKSRCSACAYPAARVRKYDWSVKAIRRKTTGTGRMRYLRHLPRRFKSNFREGTQAAPRKIGGAASSA

SEQ ID NO: 6947 - protein, 95 aa, Phaseolus coccineus
MGKGTGSFGKRRNKTHTLCVRCGHRSFHLQKSRCSACAFPAARTRKYNWSAKAIRRKTTGTGRMRYLRHVPRRFKSGFREGTEAAPRKRGAASTA

SEQ ID NO: 6948 - protein, 95 aa, Unknown
  Sequence found in Organisms: Centaurea maculosa, Cirsium arvense, Cynara scolymus, Taraxacum officinale, Lactuca sativa, Carthamus tinctorius, Helianthus annuus
MGKGTGSFGKRRNKTHTLCVRCGRRSFHLQKSRCSACAYPAARVRKYNWSVKAIRRKTTGTGRMRYLRNVPRRFKSNFREGTQATPRSKGAVASA

SEQ ID NO: 6949 - protein, 95 aa, Gossypium hirsutum
MGKGTGSFGKRRNKTHTLCVRCGRRSFHLQKSRCGACGYPASRIRKYNWSLKAIRRKTTGTGRMRYLRRVPRRFKTGFREGTQATPRKKGAVAAS

SEQ ID NO: 6950 - protein, 95 aa, Gossypium raimondii
MGKGTGSFGKRRNKTHTLCVRCGRRSFHLQKSRCGACGYPASRIRKYNWSVKAIRRKTTGTGRMRYLRHLPRRFKTGFREGTQATPRKKAAVAAS

SEQ ID NO: 6951 - protein, 95 aa, Carpinus betulus
MGKGTGSFGKRRNKTHTLCVRCGRRSFHLQKSRCSACAFPAARKRTYNWSVKAIRRKTTGTGRMRYLRHLPRRFKSGFREGTQAAPRKKGAAATA

SEQ ID NO: 6952 - protein, 95 aa, Helianthus annuus
MGKGTGSFGKRRNKTHTLCVRCGRRSFHLQKSRCSACAYPAARVRKYNWSEKAIRRKTTGTGRMRYLRNVPRRFKSNFREGTQATPRTKGAAAST

SEQ ID NO: 6953 - protein, 95 aa, Unknown
  Sequence found in Organisms: Euphorbia peplus, Euphorbia esula, Citrullus lanatus
MGKGTGSFGKRRNKTHTLCVRCGRRSFHLQKSRCAACAFPAARKRKYNWSVKAIRRKTTGTGRMRYLRNVPRRFKSGFREGTEAAPRNKGAAASA

SEQ ID NO: 6954 - protein, 95 aa, Unknown
  Sequence found in Organisms: Abies balsamea, Pseudotsuga menziesii
MGKGTGSFGKRRNKTHTLCIRCGRRSFHIQKSRCSACAYPSKRIRKYNWSVKAIRRKTTGTGRMRYLRDMPRRFKNNFREGTQATPKKKAAATTF

SEQ ID NO: 6955 - protein, 95 aa, Amaranthus tuberculatus
MGKGTGSFGKRRNKTHTLCVRCGRRSFHLQKSRCSACAFPAARTRKYNWSVKAIRRKTTGTGRMRYLRNVPRRFKTGFREGTQAAPRKQGAAASA

SEQ ID NO: 6956 - protein, 95 aa, Ambrosia trifida
MGKGTGSFGKRRNKTHTLCVRCGRRSFHLQKSRCSACAYPAARLRKYNWSEKAIRRKTTGTGRMRYLRNVPRRFKSNFREGTQATPRTKGAAAST

SEQ ID NO: 6957 - protein, 95 aa, Aquilegia formosa
MGKGTGSFGKRRNKTHTLCVRCGRRSFHLQKSRCAACGYPASRIRKYNWSMKAIRRKTTGTGRMQYLRNVPRRFKSNFREGSQAAPRSKNAAASS

SEQ ID NO: 6958 - protein, 95 aa, Artemisia annua
MGKGTGSFGKRRNKTHTLCVRCGRRSFHLQKSRCSACAYPAARVRKYNWSEKAIRRKTTGTGRMRYMRNVPRRFKSGFREGTQATPRSKGAAAST

SEQ ID NO: 6959 - protein, 95 aa, Manihot esculenta
MGKGTGSFGKRRNKTHTLCVRCGRRSFHLQKSRCAACAFPAARKRKYNWSVKAIRRKTTGTGRMRYLRHVPRRFKSGFREGTQAAPRKKGAATSA

SEQ ID NO: 6960 - protein, 95 aa, Unknown
  Sequence found in Organisms: Cedrus atlantica, Pinus taeda
MGKGTGSFGKRRNKTHTLCIRCGRRSFHIQKSRCSACAYPSKRIRKYNWSVKAIRRKTTGTGRMRYLRHMPRRFKNNFREGTQATPKKKATATTF

SEQ ID NO: 6961 - protein, 95 aa, Chelidonium majus
MGKGTGSFGKRRNKTHTLCVRCGRRSYHLQKSRCAACGYPAARLRKYNWSVKALRRKTTGTGRMKYLRNVPRRFKSNFREGTQAAPRKIGAAASS

SEQ ID NO: 6962 - protein, 95 aa, Cycas rumphii
MGKGTGSFGKRRNKTHTLCVRCGRRSFHIQKSRCSACAYPAKRIRKYNWSVKAIRRKTTGTGRMRYLRHMPRRFKNNFREGTQAAPRKKVATASF

SEQ ID NO: 6963 - protein, 95 aa, Cycas rumphii
MGKGTGSFGKRRNKTHTLCVRCGRRSFHIQKSRCSACAYPAKRIRKYNWSVKAIRRKTTGTGRMRYLRHMPRRFKNNFREGTRAAPRKKVASASF

SEQ ID NO: 6964 - protein, 95 aa, Unknown
  Sequence found in Organisms: Taraxacum officinale, Lactuca sativa
MGKGTGSFGKRRNKTHTLCVRCGRRSFHLQKSRCSACAYPAARVRKYNWSVKAIRRKTTGTGRMRYLRNVPRRFKSNFREGTQATPRSKGAVATA

SEQ ID NO: 6965 - protein, 95 aa, Solanum melongena
MGKGTGSFGKRRNKTHTLCVRCGRRSFHIQKSRCSACAYPAARLRKYNWSVKALRRKTTGTGRMRYLRNVPRRFKTNFREGTQATPRKKGTAAAS

SEQ ID NO: 6966 - protein, 95 aa, Eucalyptus grandis
MGKGTGSFGKRRNKTHTLCVRCGRRSFHLQKSRCGACGFPSARKRKYNWSVKAIRRKTTGTGRMKYLRHLPRRFKSGFREGTQAAPRKQAAAASA

SEQ ID NO: 6967 - protein, 95 aa, Flaveria ramosissima
MGKGTGSFGKRRNKTHTLCVRCGRRSFHLQKSRCSACAYPAARLRKYNWSVKAIRRKTTGTGRMRYLRNVPRRFKSGFREGTQATPRSKGAAASA

SEQ ID NO: 6968 - protein, 95 aa, Gnetum gnemon
MGKGTGSFGKRRNKTHTLCIRCGRRSFHLQKSRCGACAYPAKRIRKYNWSAKAIRRKTTGTGRMRYLRHLPRRFKNNFREGTQATSKKRAAVAQS

SEQ ID NO: 6969 - protein, 95 aa, Lotus japonicus
MGKGTGSFGKRRNKTHTLCVRCGRRSFHLQKSRCAACAFPAARKRKYNWSVKAIRRKTTGTGRMRYLRNVPRRFKSGFREGTEAAPRNKGAAATA

SEQ ID NO: 6970 - protein, 93 aa, Lippia dulcis
KGTGSFGKRRNKTHTLCVRCGRRSFHLQKSRCSACAYPAARKRTYNWSVKAIRRKTTGTGRMRYLRNVPRRFKTNFREGTEAAPRKKAVAASA

SEQ ID NO: 6971 - protein, 95 aa, Podocarpus macrophillus
MGKGTGSFGKRRNKTHTLCIRCGRRSFHIQKSRCSACAYPAKRIRKYNWSVKAIRRKTTGTGRMRYLRHMPRRFKNNFREGTQATPRKKAASTQF

SEQ ID NO: 6972 - protein, 94 aa, Populus trichocarpa
MGKGTGSFGKRRNKTHTLCVRCGRRSFHLQKSRCSACAFPAARVRKYNWSVKAIRRKTTGTGRMKYLRHLPRRFKTNFREGTQATPRNKGAAAA

SEQ ID NO: 6973 - protein, 95 aa, Primula obconica
MTKGTGSFGKRRNKTHTLCVRCGRRSFHLQKSRCSACAFPAARKRTYNWSVKAIRRKTTGTGRMRYLRNVPRRFKSGFREGTEAAPRKKGAAASA

SEQ ID NO: 6974 - protein, 95 aa, Pseudotsuga menziesii
MGKGTGSFGKRRNKTHTLCIRCGRRSFHIQKSRCSACAYPAKRIRKYNWSVKAIRRKTTGTGRMRYIRHMPRRFKNNFREGTQATPRKKASATSF

SEQ ID NO: 6975 - protein, 95 aa, Rosa hybrid cultivar
MGKGTGSFGKRRNKTHTLRVRCGRHSFHLQKSRCSACAYPAARTRKFNWSVKAIRRKTTGTGRMRYLRNVPRRFKSGFREGTEAAPRKKGAAASA

SEQ ID NO: 6976 - protein, 95 aa, Senecio madagascariensis
MTKGTGSFGKRRNKTHTLCVRCGRRSFHLQKSRCSACAYPAARVRKYNWSEKAIRRKTTGTGRMRYMRNVPRRFKSGFREGTQAAPRKIAASSST

SEQ ID NO: 6977 - protein, 95 aa, Silene vulgaris
MGKGTGSFGKRRNKTHTLCVRCGRRSFHLQKSRCSACAFPAARTRKYNWSVKAIRRKTTGTGRMRYLRNVPRRFKTGFREGTQAAPRKQVAAASA

SEQ ID NO: 6978 - protein, 95 aa, Silene vulgaris
MGKGTGSFGKRRNKTHTLCVRCGRRSFHLQKSRCSACAFPAARTRKYNWSVKAIRRKTTGTGRMRYLRNVPRRFKTGFREGTQAAPRKQVAAASS

SEQ ID NO: 6979 - protein, 95 aa, Glycine max
MGKGTGSFGKRRNKTHTLCVRCGRRSFHLQKSRCAACAFPAARTRKYNWSVKAIRRKTTGTGRMRYLRNVPRRFKSGFRDGTEAAPRKRGAAAST

SEQ ID NO: 6980 - protein, 95 aa, Glycine max
MGKGTGSFGKRRNKTHTLCVRCGRRSFHLQKSRCAACAFPAARTRKYNWSVKAIRRKTTGTGRMRYLRNVPRRFKSGFREGTEAAPRKKGAATTA

SEQ ID NO: 6981 - protein, 95 aa, Taxus baccata
MGKGTGSFGKRRNKTHTLCVRCGRRSFHIQKSRCSACAYPAARIRKYNWSVKAIRRKTTGTGRMRYLRHMPRRFKNNFREGTQPTPRKKAAATSF

SEQ ID NO: 6982 - protein, 95 aa, Nicotiana tabacum
MGKGTGSFGKRRNKTHTLCVRCGRRSFHLQKSRCSACAYPAARLRKYNWSEKALRRKTTGTGRMRYLRNVPRRFKTGFREGTEAAPRKKAAAVSA

SEQ ID NO: 6983 - protein, 95 aa, Nicotiana tabacum
  misc_feature (2)..(2): Xaa can be any naturally occurring amino acid
MXKGTGSFGKRRNKTHTLCVRCGRRSFHIQKSRCSACAYPAARLRKYNWSVKALRRKTTGTGRMRYLRNVPRRFKTNFREGTEATPRKKGAAVAS

SEQ ID NO: 6984 - protein, 95 aa, Triphysaria pusilla
MTKGTGSFGKRRNKTHTLCVRCGRRSFHLQKSRCSACAYPAARKRTYNWSVKAIRRKTTGTGRMRYLRNVPRRFKTNFREGTQAAPRKKAVAASA

SEQ ID NO: 6985 - protein, 95 aa, Triphysaria pusilla
MTKGTGSFGKRRNKTHTLCVRCGRRSFHLQKSRCSACAYPAARKRTYNWSVKAIRRKTTGTGRMRYLRNVPKRFKTNFREGTQAAPRKKAAAASA

SEQ ID NO: 6986 - protein, 99 aa, Valeriana officinalis
MGKAGKGTGSFGKRRNKTHTLCVRCGRRSFHLQKSRCSACAFPAARVRKYNWSEKAIRRKTTGTGRMRHLRHLPRRFKSNFREGTQAAPRNKSASAASA

SEQ ID NO: 6987 - protein, 94 aa, Fagopyrum esculentum
MGKGTGSFGKRRNKTHTLCVRCGRRSFHLQKSRCSACAYPAARLRKYNWSVKAIRRKTTGTGRMRYLRNVPRRFKTGFREGTQATPRKQVAASS

SEQ ID NO: 6988 - protein, 93 aa, Fraxinus spp
GKGTGSFGKRRNKTHTLCVRCGRRSFHIQKSRCSACAYPAARVRKYNWSVKAIRRKTTGTGRMRYLRHVAVRFKSNFREGTQAPPRKKGAAAS

SEQ ID NO: 6989 - protein, 94 aa, Silene vulgaris
MGKGTGSFGKRRNKTHTLCVRCGRRSFHLQKSRCSACAFPAARTRKYNWSVKAIRRKTTGTGRMRYLRNVPRRFKTGFREGTQAAPRKQVAATS

SEQ ID NO: 6990 - protein, 94 aa, Ambrosia trifida
GKVQEDFGKRRNKTHTLCVRCGRRSFHLQKSRCSACAYPAARVRKYNWSEKAIRRKTTGTGRMRYLRNVPRRFKSGFREGTQAAPRKKAAADSA

SEQ ID NO: 6991 - protein, 94 aa, Artemisia annua
NGKRNREFGKRRNKTHTLCVRCGRRSFHLQKSRCSACAYPAARVRKYNWSEKAIRRKTTGTGRMRYLRNVPRRFKSGFREGTQAVPRKVAAASA

SEQ ID NO: 6992 - protein, 55 aa, Manihot esculenta
NDENCRVREQGVLVRGGTRPTPFVSGVAAGASTSRRAVVLPVLSLLLARGSIIGV

SEQ ID NO: 6993 - protein, 119 aa, Flaveria ramosissima
RSLGFCFFIVSRDGQGNRELWKEEEQDTHPVCEVWPPQLPPAEEPMLRLCLSCCSPQEINWSVKAIRRKTTGTGRMRYLRNVPRRFKSGFREGTQATLGAKELLPALRFEGKISMYFSI

SEQ ID NO: 6994 - protein, 114 aa, Panax ginseng
GARQSKLGLGFDIHFAKWGKLGKEQEASGRGGTKHTLCVRCGRRSFHLQKSRCSACAFPAARVRKYNWSVKAIRRKTTGTGRMRYLRHVPRRFKSNFREGTQATPRNKGAAATA

SEQ ID NO: 6995 - protein, 126 aa, Podocarpus macrophillus
RVLGSERAKSLGRGGRSRGGRCCRCTIISYNNGEGDGEFGKRRNKTHTLCIRCGRRSFHLQKSRCSACAYPAKRIRKYNWSAKAIRRKTTGTGRMRYLRHMPRRFKNNFREGTQATPRKKVATASS

SEQ ID NO: 6996 - protein, 76 aa, Tabernaemontana elegans
MGKGTGSFGKRRNKTHTLCVRCGRRSFHLQKSRCGSCGYPAARLRKYNWSVKAIRRKTTGTGRMRYLRHVAVRFKG

SEQ ID NO: 6997 - protein, 86 aa, Tragopogon dubius
MGKGTGSFGKRRNKTHTLCVRCGRRSFHLQKSRCSACAYPAARVRKYNWSVKAIRRKTTGTGRMRYLRHLPRRFKSKTSEKGPKLL

SEQ ID NO: 6998 - protein, 132 aa, Tragopogon dubius
MGKGTGSFGKRRNKTHTLCVRCGRRSFHLQKSRCSACAYPAARVRKYNWSEKAIRGRRLEQGVCVTCAMFPAGSRVTSGKVPKQHQGAKELLPVPKNSTICCCFIRSGKTDLWIFVCLLIPFLLFRCSRILN

SEQ ID NO: 6999 - protein, 98 aa, Valeriana officinalis
MGKAGKGTGSFGKRRNKTHVLCVRCGRRSFHLQKSRCSACAFPAARVRKYNWSEKAIRRKTTGTGRMRYLRHLPRRFKSNFREGTQAAPRNKAAAAST

SEQ ID NO: 7000 - protein, 98 aa, Panax ginseng
MGKAGKGTGSFGKRRNKTHTLCVRCGRRSFHLQKSRCSACAFPAARVRKYNWSVKAIRRKTTGTGRMRYLRHVPRRFKSNFREGTQATPRSKGAAAAS

SEQ ID NO: 7001 - protein, 96 aa, Malus domestica
MGKGTGSFGKRRNKTHTLCVRCGRRSFHLQKSRCSACAYPAARLRKYNWSEKALRRKTTGTGRMRYLRNVPRRFKSGFLEGTQAAPRRKGAAAASS

SEQ ID NO: 7002 - protein, 96 aa, Flaveria ramosissima
MGKGTGSFGKRRNKTHTLCVRCGRRSFHLQKSRCSACAYPAARLRKYNWSEKAIRRKTTGTGRMRYLRNVPHRFKSNFREGTQATPRTKGTAAAST

SEQ ID NO: 7003 - protein, 96 aa, Linum usitatissimum
MGKGTASFGKRRNKTHTLCVRCGRRSFHLQKSRCSACAYPAARVRKYNWSEKAIRRKTTGTGRMRYMRHMARRFKSGFREGTQAAPRTKGTAAASS

SEQ ID NO: 7004 - protein, 96 aa, Carica papaya
MGKGTGSFGKRRNKTHTLCVRCGRRSFHLQKSRCAACGFPASRTRKYNWSVKAIRRKTTGTGRMRYLRHLPRRFKSNFREGTEATPRNKGAAAGSA

SEQ ID NO: 7005 - protein, 96 aa, Populus trichocarpa
MGKGTGSFGKRRNKTHTLCVRCGRRSFHLQKSRCSACAFPAARVRKYNWSEKAIRRKTTGTGRMKYLRHLPRRFKTNFREGTQAAPRNKGAAAASS

SEQ ID NO: 7006 - protein, 96 aa, Prunus persica
MGKGTGSFGKRRNKTHTLCVRCGRRSFHLQKSRCSACAYPAARLRKYNWSEKALRRKTTGTGRMRYLRNVPRRFKSNFTEGTQAAPRRKGTAAAAS

SEQ ID NO: 7007 - protein, 95 aa, Unknown
  Sequence found in Organisms: Centaurea maculosa, Helianthus annuus
MGKGTGSFGKRRNKTHTLCVRCGRRSFHLQKSRCSACAYPAARVRKYNWSEKAIRRKTTGTGRMRYLRNVPRRFKSGFREGTQATPRSKGAAAST

SEQ ID NO: 7008 - protein, 94 aa, Centaurea maculosa
GKGTGSFGKRRNKQHTLCVRCGRRSFHLQKSRCSACAYPAARVRKYNWSEKAIRRKTTGTGRMRYLRHLPRRFKSNFREGTQAAPRKIGAASSA

SEQ ID NO: 7009 - protein, 93 aa, Gossypium hirsutum
KGTGSFGKRRNKTHTLCVRCGRRSFHLQKSRCGACGYPASRIRKYNWSMKAIRRKTTGTGRMRYLRHVPRRFKTGFREGTQATPRKKGAVAAS

SEQ ID NO: 7010 - protein, 95 aa, Ambrosia trifida
MGKGTGSFGKRRNKTHTLCVRCGRRSFHLQKSRCSACAYPAARVRKYNWSEKAIRRKTTGTGRMRYLRNVPRRFKSGFREGTQATPRSKGAAASA

SEQ ID NO: 7011 - protein, 95 aa, Bruguiera gymnorhiza
MGKGTGSFGKRRNKTHTLCVRCGRRSFHLQKSRCAACAFPAARKRTYNWSVKAIRRKTTGTGRMRYLRNVPRRFKSGFREGTEAAPRKKGVAATA

SEQ ID NO: 7012 - protein, 95 aa, Bruguiera gymnorhiza
MGKGTGSFGKRRNKTHTLCVRCGRRSFHLQKSRCAACAFPAARKRKYNWSVKAIRRKTTGTGRMRYLRNVPRRFKSGFREGTQAAPRKKGVAATA

SEQ ID NO: 7013 - protein, 95 aa, Cichorium intybus
MGKGTGSFGKRRNKTHTLCVRCGRRSFHLQKSRCSACAYPAARVKKYNWSVKAIRRKTTGTGRMRYLRNVPRRFKSNFREGTQATPRSKGAVASA

SEQ ID NO: 7014 - protein, 95 aa, Unknown
  Sequence found in Organisms: Cucumis sativus, Cucumis melo
MGKGTGSFGKRRNKTHTLCVRCGRRSFHLQKSRCSACAFPAARKRTYNWSVKAIRRKTTGTGRMRYLRHVPRRFKSGFREGTEAAPRSKGASSSA

SEQ ID NO: 7015 - protein, 95 aa, Euonymus alatus
MGKGTGSFGKRRNKTHTLCVRCGRRSFHLQKSRCSACAFPAARKRTYNWSVKAIRRKTTGTGRMRYLRHLPRRFKSGFREGTQAAPRNRGAAATA

SEQ ID NO: 7016 - protein, 95 aa, Unknown
  Sequence found in Organisms: Euonymus alatus, Tripterygium wilfordii
MGKGTGSFGKRRNKTHTLCVRCGRRSFHLQKSRCSACAFPAARKRTYNWSVKAIRRKTTGTGRMRYLRHLPRRFKSGFREGTQAAPRNKGAAATA

SEQ ID NO: 7017 - protein, 95 aa, Flaveria ramosissima
MGKGTGSFGKRRNKTHTLCVRCGRRSFHLQKSRCSACAYPAARLRKYNWSEKAIRRKTTGTGRMRYLRNVPRRFKSGFREGTQATPRSKGAAAST

SEQ ID NO: 7018 - protein, 95 aa, Flaveria ramosissima
MGKGTGSFGKRRNKTHTLCVRCGRRSFHLQKSRCSACAYPAARLRKYNWSVKAIRRKTTGTGRMRYLRNVPRRFKSNFREGTQATPRTKGAVSST

SEQ ID NO: 7019 - protein, 95 aa, Actinidia deliciosa
MGKGTGSFGKRRNKTHTLCVRCGRRSFHLQKSRCSACAFPAARKRTYNWSVKAIRRKTTGTGRMRYLRNVPRRFKSGFREGTQAAPRKIGSAAPA

SEQ ID NO: 7020 - protein, 95 aa, Capsicum annuum
MGKGTGSFGKRRNKTHTLCVRCGRRSFHIQKSRCSACAYPAARLRKYNWSVKALRRKTTGTGRMRYLRNVPRRFKTNFREGTEATPRKKGTAAPS

SEQ ID NO: 7021 - protein, 95 aa, Lippia dulcis
MGKGTGSLGRRRNKTHTLCVRCGRRSFHLQKSRCSACAYPAARKRTYNWSVKAIRRKTTGTGRMRYLRNVPRRFKTNFREGTQAAPRKKAAAVSA

SEQ ID NO: 7022 - protein, 91 aa, Cajanus cajan
TGSFGKRRNKTHTLCVRCGRRSFHLQKSRCSACAFPAARKRKYNWSVKAIRRKTTGTGRMRYLRHVPRRFKSGFREGTEAAPRKRGAAASA

SEQ ID NO: 7023 - protein, 95 aa, Populus trichocarpa
MGKGTGSFGKRRNKTHTLCVRCGRRSFHLQKSRCSACAFPAARKRKYNWSEKAIRRKTTGTGRMRYLRNVPRRFKSGFREGTQAEPRKKGAAASA

SEQ ID NO: 7024 - protein, 95 aa, Silene vulgaris
MTKGTGSFGKRRNKTHTLCVRCGRRSFHLQKSRCSACAFPAARTRKYNWSVKAIRRKTTGTGRMRYLRNVPRRFKTGFREGTQAAPRKQVAAASS

SEQ ID NO: 7025 - protein, 95 aa, Camellia sinensis
MGKGTGSFGKRRNKTHTLCVRCGRRSFHLQKSRCSACAFPAARKRTYNWSVKAIRRKTTGTGRMRYLRNVPRRFKSGFREGTEAAPRKKGSAPPA

SEQ ID NO: 7026 - protein, 99 aa, Gossypium raimondii
MFPFQGKGTGSFGKRRNKTHTLCVRCGRRSFHLQKSRCSACAFPAARKRTYNWSVKAIRRKTTGTGKMRYLRHVPRRFKTGFREGTEAAPRKKVVAASA

SEQ ID NO: 7027 - protein, 94 aa, Picea glauca
MGKGTGSFGKRRNKTHTLCIRCGRRSFHIQKSRCSACAYPSKRIRKYNWSVKAIRRKTTGTGRMRYLRHMPRRFKNNFREGLRQPPEEGCCYHI

SEQ ID NO: 7028 - protein, 95 aa, Antirrhinum majus
RERGVLVRGGTRPHTVCEVRSPQFSPPEEPLFRLCLSCCSQEDLQLERKGYPKKDHRNWTHEVHAQCATQIQDQLQRRYSSCTKGEVSSCFCLGF

SEQ ID NO: 7029 - protein, 103 aa, Gossypium hirsutum
FCSSKNKRNGKGTGSFGKRRNKTHTLCVRCGRRSFHLQKSRCGACGYPASRIRKYNWSVKAIRRKTTGTGRMRYLRRVPRRFKTGFREGTQATPRKKGAVAAS

SEQ ID NO: 7030 - protein, 61 aa, Flaveria ramosissima
ESCFSSRQSAEMGKGTGSFGKRRNKTHTLCVRCGRRSFHLQKSRCSACAYPAARLRKSTGA

SEQ ID NO: 7031 - protein, 109 aa, Olea europaea
DDNSAATLNLYLQFAHGKGNREFGKRRNKTHTLCVRCGRRSFHIQKSRCSACAYPAARLRKYNWSVKAIRRKTTGTGRMRYLRHVAVRFKSNFREGTQAPPRKKGTAAA

SEQ ID NO: 7032 - protein, 55 aa, Petunia hybrida
NPSSQCFCSCSIMVKGTGSFGKRRELYTHTMCELWAAQFPFTEKSLLCLCLSCCP

SEQ ID NO: 7033 - protein, 71 aa, Pinus taeda
MTQDANLMAMYRKIYKGDFKCPPWFSPSVVKIVSKLLDPNPRTRIGIPRLMEIPWFRKGFKAGRPVSRDDV

SEQ ID NO: 7034 - protein, 98 aa, Scabiosa columbaria
MGKAGKGTGSFGKRRNKTHTLCVRCGRRSFHLQKSRCSACAFPAARVRKYNWSAKAIRRKTTGTGRMRYLRHLPRRFKSNFREGTQAPPRNKAAVASA

SEQ ID NO: 7035 - protein, 98 aa, Scabiosa columbaria
MGKAGKGTGSFGKRRNKTHTLCVRCGRRSFHLQKSRCSACAFPAARVRKYNWSAKAIRRKTTGTGRMRYLRHLPRRFKSNFREGTQAPPRNKVAAAST

SEQ ID NO: 7036 - protein, 80 aa, Hordeum vulgare
KGTGSFGKRRNKTHTLCIRCGRRSFHLQKSTCSSCGYPAARIRKCKWSVKAIRRKTTGTGRMRYMRHVPRRFKSNFREGN

SEQ ID NO: 7037 - protein, 93 aa, Eschscholzia californica
MGKGTGSFGKRRNKTHTLCVRCGRRSYHLQKSRCAACGYPAARLRKYNWSVKALRRKTTGTGRMQYLRNVPRRFKSGFREGTQAAPRKVGASA

SEQ ID NO: 7038 - protein, 94 aa, Fagopyrum esculentum
MGKGTGSFGKRRNKTHTLCVRCGRRSFHLQKSRCSACAYPAARLRKYNWSVKAIRRKTTGTGRMRYLRNVPRRFKTGFREGTQATPRKQVTASS

SEQ ID NO: 7039 - protein, 96 aa, Tropaeolum majus
MGKGTGSFGKRRNKTHTLCVRCGRRSFHLQKSRCSACAFPAARVRKYNWSEKAIRRKTTGTGRMKYLRNVPRRFKTNFREGTQAKPRNKGAAAASS

SEQ ID NO: 7040 - protein, 96 aa, Tropaeolum majus
MGKGTGSFGKRRNKTHTLCVRCGRRSFHLQKSRCSACAFPAARVRKYNWSEKAIRRKTTGTGRMRYLRNVPRRFKTNFREGTQATPRKKGAAAVSA

SEQ ID NO: 7041 - protein, 96 aa, Malus domestica
MGKGTGSFGKRRNKTHTLCVRCGRRSFHLQKSRCSACAYPAARLRKYNWSEKALRRKTTGTGRMRYLRNVPRRFKSGFLEGTQAAPRSKGSAAASS

SEQ ID NO: 7042 - protein, 96 aa, Unknown
  Sequence found in Organisms: Euphorbia peplus, Euphorbia esula
  misc_feature (56)..(56): Xaa can be any naturally occurring amino acid
  misc_feature (79)..(79): Xaa can be any naturally occurring amino acid
MGKGTGSFGKRRNKTHTLCVRCGRRSFHLQKSRCSACAFPAARVRKYNWSEKAIRXKTTGTGRMRYMPHVPRRFKSGFXEGTQATPRQKGAAAASA

SEQ ID NO: 7043 - protein, 100 aa, Thalictrum flavum
ANNKQQWGKGTGSFGKRRNKTHTLCVRCGRRSFHLQKSRCSACAYPAARTRKYNWSVKAIRRKTTGTGRMQYMRHLPRRFKSNFREGTVAAPRTKGAAAA

SEQ ID NO: 7044 - protein, 95 aa, Vaccinium corymbosum
MGKGTGSFGKRRNKTHTLCVRCGRRSFHLQKSRCSACAFPAARKRKYNWSVKAIRRKTTGTGRMRYLRNVPRRFKSGFIEGAQAAPRKKGAAPAV

SEQ ID NO: 7045 - protein, 95 aa, Eschscholzia californica
MGKGTGSFGKRRNKTHTLCVRCGRRSYHLQKSRCAACGYPAARLRKYNWSVKALRRKTTGTGRMQYLRNVPRRFKSGFREGTQAAPRKVGASAST

SEQ ID NO: 7046 - protein, 95 aa, Eschscholzia californica
MGKGTGSFGKRRNKTHTLCVRCGRRSYHLQKSRCAACGYPAARLRKYNWSEKALRRKTTGTGRMRYLRNVPRRFKSGFREGTQATPRKAGAAASA

SEQ ID NO: 7047 - protein, 95 aa, Tropaeolum majus
MGKGTGSFGKRRNKTHTLCVRCGRRSFHLQKSRCSACAFPAARKRTYNWSEKAIRRKTTGTGRMRYLRNVPRRFKTGFREGTQAAPRKKAVAAST

SEQ ID NO: 7048 - protein, 94 aa, Unknown
  Sequence found in Organisms: Rosa hybrid cultivar, Fragaria vesca
MGKGTGSFGKRRNKTHTLCVRCGRRSFHLQKSRCSACAYPAARLRKYNWSEKALRRKTTGTGRMRYLRHVPRRFKSGFLEGTQAKPRSKGTATA

SEQ ID NO: 7049 - protein, 94 aa, Arnica chamissonis
GKGTGSFGKRRNKTHTLCVRCGRRSFHLQKSRCSACAYPAARVRKYNWSEKAIRRKTTGTGRMRYLRNVPRRFKSGFREGTQATPRSKGAAAST

SEQ ID NO: 7050 - protein, 95 aa, Arnica chamissonis
MGKGTGSFGKRRNKTHTLCVRCGRRSFHLQKSRCSACAYPAARVRKYNWSEKAIRRKTTGTGRMRYLRNVPRRFKSGFREGTQATPRSKGAVASA

SEQ ID NO: 7051 - protein, 95 aa, Cleome spinosa
MGKGTGSFGKRRNKTHTLCVRCGRRSFHIQKSRCSACAFPAARKRTYNWSVKAIRRKTTGTGRMRYLRHVPRRFKTGFREGTEAKPRNKAAASSA

SEQ ID NO: 7052 - protein, 92 aa, Cleome spinosa
MGKGTGSFGKRRNKTHTLCVRCGRRSFHIQKSRCSACAFPAARKRTYNWSVKAIRRKTTGTGRMRYLRHVPRRFKTGFREGTEAKPRNKSAT

SEQ ID NO: 7053 - protein, 94 aa, Gossypium hirsutum
GKGTGSFGKRRNKTHTLCVRCGRRSFHLQKSRCSACAFPAARKRTYNWSVKAIRRKTTGTGKMRYLRHVPRRFKTGFREGTEAAPRKKVVAASA

SEQ ID NO: 7054 - protein, 95 aa, Distylium racemosum
MGKGTGSFGKRRNKTHTLCVRCGRRSFHIQKSRCSACAYPAKRIRKYNWSAKAIRRKTTGTGRMRYLRHMPRRFKNNFREGTQATPRKKAASTSF

SEQ ID NO: 7055 - protein, 95 aa, Distylium racemosum
MGKGTGSFGKRRNKTHTLCVRCGRRSFHIQKSRCSACAYPAKRIRKYNWSAKAIRRKTTGTGRMRYLRHMPRRFKNNFREGTQATPRNKAVAASS

SEQ ID NO: 7056 - protein, 95 aa, Flaveria ramosissima
MGKGTGSFGKRRNKTHTLCVRCGRRSFHLQKSRCSACAYPAARLRKYNWSVKAIRRKTTGTGRMRYLRNVPRRFKSNFREGTQATPRTKGTVSST

SEQ ID NO: 7057 - protein, 95 aa, Actinidia deliciosa
MGKGTGSFGKRRNKTHTLCVRCGRRSFHLQKSRCSACAFPAARKRTYNWSVKAIRRKTTGTGRMRYLRHIPRRFKSGFIEGTQAAPRKKGAAPIS

SEQ ID NO: 7058 - protein, 95 aa, Nicotiana benthamiana
  misc_feature (75)..(75): Xaa can be any naturally occurring amino acid
  misc_feature (89)..(89): Xaa can be any naturally occurring amino acid
MGKGTGSFGKRRNKTHTLCVRCGRRSFHIQKSRCSACAYPAARLRKYNWSVKALRRKTTGTGRMRYLRNVPRRFXTNFREGTEATPRKXGAAVTS

SEQ ID NO: 7059 - protein, 95 aa, Populus trichocarpa
MGKGTGSFGKRRNKTHTLCVRCGRRSFHLQKSRCSACAFPAARKRKYNWSEKAIRRKTTGTGRMRYLRNVPRRFKSGFREGTQAEPRKKGTAASA

SEQ ID NO: 7060 - protein, 95 aa, Triphysaria pusilla
MTKGTGSFGKRRNKTHTLCVRCGRRSFHLQKSRCSACAYPAARKRTYNWSVKAIRRKTTGTGRMRYLRNVPRRFKTNFREGTQAAPRSKSVAASA

SEQ ID NO: 7061 - protein, 90 aa, Gossypium hirsutum
MGKGTGSFGKRRNKTHTLCVRCGRRSFHLQKSRCSACAFPAARKRKYNWSVKAIRRKTTGTGRMRYLRHVPCRFKTGFREGTEAAPYNWQ

SEQ ID NO: 7062 - protein, 85 aa, Eragrostis curvula
SAAPRQTHTLCIRCGRRSFHLQKGTCSSCGYPAARIRKYNWSVKAIRRKTTGTGRMRYMRHVPKRFKSNFREGTEAAPKKRAAAN

SEQ ID NO: 7063 - protein, 93 aa, Carica papaya
GKGTGSFGKRRNKTHTLCVRCGRRSFHLQKSRCAACAFPAARKRKYNWSVKAIRRKTTGTGRMRYLRHLPRRFKSGFREGAQATPRKAAAASS

SEQ ID NO: 7064 - protein, 68 aa, Arnica chamissonis
MGKGTGSFGKRRNKTHTLCVRCGRRSFHLQKSRCSACAYPAARVRKYNWSEKAIRRKTTGTGRIALPA

SEQ ID NO: 7065 - protein, 63 aa, Sarracenia psittacina
MGKGTGSFGKRRNKTHTLCVRCGRRSFHLQKSRCAACAYPAARKRNITGARRRFEGRQLGQVV

SEQ ID NO: 7066 - protein, 131 aa, Thalictrum flavum
MGRFITRTICQSLCLSLDKHNPSHLLHQGEAKRGFSFGDGTGSFGKRRNKTHTLCVRCGRRSFHLQKSRCAACGYPASRIRKYNWSMKAIRRKTTGTGRMQYLRNVPRRFKSNFREGTQAAPRSKNAAGSA

SEQ ID NO: 7067 - protein, 100 aa, Vaccinium corymbosum
PAAHQWGRGTGSFGKRRNKTHTLCVRCGRRSFHLQKSRCSACAFPAARKRKYNWSVKAIRRKTTGTGRMRYLRNVPRRFKSGFREGTEAAPRKKAAAATA

SEQ ID NO: 7068 - protein, 95 aa, Eschscholzia californica
MGKGTGSFGKRRNKTHTLCVRCGRRSYHLQKSRCAACGYPAARLRKYNWSLKALRRKTTGTGRMQYLRNVPRRFKSGFREGTQAAPRKVGASAST

SEQ ID NO: 7069 - protein, 95 aa, Carpinus betulus
MGKGTGSFGKRRNKTHTLCVRCGRRSFHLQKSRCSACAFPASRVRKYNWSEKAIRRKTTGTGRMRYLRHLPRRFKTNFREGTQATPRNKGTSAAP

SEQ ID NO: 7070 - protein, 95 aa, Arabidopsis lyrata
MGKGTGSFGKRRNKSHTLCVRCGRRSFHIQKSRCSACAYPAARKRTYNWSVKAIRRKTTGTGRMRYLRNVPRRFKTGFREGTEAKPRNKAAASSA

SEQ ID NO: 7071 - protein, 97 aa, Brassica oleracea
MTKGTGSFGKRRNKSHTLCVRCGRRSFHIQKSRCSACAYPAARKRTYNWSVKAIRRKTTGTGRMRYLKNVPRRFKTCFREGTEAKPRNKGAAAASSS

SEQ ID NO: 7072 - protein, 95 aa, Cleome gynandra
MGKGTGSFGKRRNKTHTLCVRCGRRSFHIQKSRCSACAFPAARKRTYNWSVKAIRRKTTGTGRMRYLRNVPRRFKTGFREGTEAKPRNKAAASSA

SEQ ID NO: 7073 - protein, 95 aa, Cleome spinosa
MGKGTGSFGKRRNKTHTLCVRCGRRSFHIQKSRCSACAFPAARKRTYNWSVKAIRRKTTGTGRMRYLRHVPRRFKTGFREGTQATPRNKAASASA

SEQ ID NO: 7074 - protein, 94 aa, Cyamopsis tetragonoloba
TRGTGSFGKRRNKTHTLCVRCGRRSFHLQKSRCAACAFPAARKRKYNWSVKAIRRKTTGTGRMRYLRHVPRRFKSGFREGTEAAPRKRGSATTA

SEQ ID NO: 7075 - protein, 94 aa, Raphanus sativus
MTKGTGSFGKRRNKSHTLCVRCGRRSFHIQKSRCSACAYPAARKRTYNWSVKAIRRKTTGTGRMRYLRNVPRRFKTGFREGTEAKPRVKSAASS

SEQ ID NO: 7076 - protein, 268 aa, Unknown
  Sequence found in Organisms: Sorghum bicolor, Saccharum officinarum
MASTIMAATSRVVAAKTPFLGQGRAAANASPLRDVAAAASGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7077 - protein, 268 aa, Panicum virgatum
MASTIMAATSRVLAAKTPFLGQGRAAANASPLRDVAAAASGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7078 - protein, 270 aa, Panicum virgatum
MASTIMAATSRVLAAKTPFLGQGRAAAIASPLRDVVAAAAASGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7079 - protein, 269 aa, Cynodon dactylon
MASTIMAATNSRVVAAKTPFLGQGRTAGNATPLRDVAAAAGGRITMSNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGFRINGLDGVGDGNNLYPGGQYFDPLGLADDPVTFAELKVKEIKNGRLAMFSMFGFFVQAIVTGKGPLENLLDHLDDPVANNAWVYATKFAPGS

SEQ ID NO: 7080 - protein, 268 aa, Setaria italica
MASIMAAATSRVLAAKTLFLGQGRAAANASPLRDVAAAASGRITMSNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7081 - protein, 268 aa, Pennisetum glaucum
MASIMAAATSRVIAAKTPFLGQGRAAANVSPFRDVAAAASGRITMSNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7082 - protein, 285 aa, Zea mays
MASTIMAATSRIVAAKTPFLGQGRAAANASPLRDVAAAAAGGRITMVRGASIVRVLASLPLQGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7083 - protein, 268 aa, Unknown
  Sequence found in Organisms: Leymus cinereus x Leymus triticoides, Secale cereale, Triticum aestivum
MASTIMAAASRAVVAKTPFLSGQGRAASASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7084 - protein, 268 aa, Triticum aestivum
MASTIMAAASRAVVAKTPFLSGQGRAAGASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7085 - protein, 268 aa, Avena sativa
MASTIMAAASRAVAAKTPFLSGQSRAASASPLRDVAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSDGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7086 - protein, 268 aa, Hordeum vulgare
MASTIMAAASRAVVAKTPFLSGQGRAASASPLRDIAAATNGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7087 - protein, 268 aa, Triticum aestivum
MASTIMAAASRAVVAKTPFLSGQGRAASATPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7088 - protein, 268 aa, Leymus cinereus x Leymus triticoides
MASTIMAAASRAVVTKTPFLSGQGRAASASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7089 - protein, 115 aa, Avena sativa
TAAQLGRRPDPRSSRYGIHYHGRRLPRRRRQAPFLSGQSRAASASPLRDVAAAANGRITMGNDLWYGPDRVKYLGPLLRADAVVPQRPSSPATTAGTPPGYLPTRRPLPGTGRWR

SEQ ID NO: 7090 - protein, 268 aa, Lolium multiflorum
MTSTIMAAASRTVAAKTPFLSGQSRAASASPLRVVAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSDGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7091 - protein, 266 aa, Oryza sativa
MASTIMAPTSRVLAAKTPFLGHPRPSNAPVRDIAAAATGRITMSKELWYGPDRVKYLGPFSAQTPSYLRGEFPGDYGWDTAGLSADPEAFARNRALEVIHGRWAMLGALGCITPEVLEKWVRVDFKEPVWFKAGAQIFSDGGLDYLGNPNLVHAQSILAVLGFQVVLMGLVEGYRINGLPGVGDGNDLYPGGQYFDPLGLADDPVTFAELKVKEIKNGRLAMFSMFGFFVQAIVTGKGPLENLLDHLADPVANNAWVYATKFTPGS

SEQ ID NO: 7092 - protein, 267 aa, Brachypodium distachyon
MVSTLMAPASRAVAGKTPFLGARPAVASPLRDVAAAASNGRISMSNELWYGPDRVKYLGPFSAQTPSYLSGEFPGDYGWDTAGLSADPEAFARNRALEVIHGRWAMLGALGCVFPEVLQKWVGVEFKEPVWFKAGAQIFSEGGLDYLGNPNLVHAQSILAVLGSQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7093 - protein, 267 aa, Glycine max
MAATLMAATSSGTLKATPFLGQGKGANANALRDVVSMGTGKYTMGNDLWYGPDRVKYLGPFSAQTPSYLKGEFPGDYGWDTAGLSADPEAFAKNRALEVIHGRWAMLGALGCITPEVLEKWLRVDFKEPVWFKAGAQIFSEGGLDYLGNPNLVHAQSILAVLGFQVILMGLVEGYRINGLDGVGEGNDLYPGGQYFDPLGLADDPVTFAELKVKEIKNGRLAMFSMFGFFVQAIVTGKGPLENLLDHLDNPVANNAWVYATKFAPGS

SEQ ID NO: 7094 - protein, 269 aa, Castanea mollissima
MASTLMAATASSSTVLKPTPFLGQNRGANVNSLRDVVPMGTGKYTMGNDLWYGPDRVKYLGPFSAQTPSYLRGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVILMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7095 - protein, 224 aa, Carpinus betulus
MGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7096 - protein, 260 aa, Secale cereale
ASRAVVAKTPFLSGQGRAASASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7097 - protein, 162 aa, Setaria italica
MLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 7098 - protein, 262 aa, Secale cereale
GRRSRAVVAKTPFLSGQGRAASASPLRNIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 7099 - protein, 269 aa, Quercus alba
MASTLMAATASSRTVLKPTPFLGQNRGTNVNSLRDVVPMGTGKYTMGNELWYGPDRVKYLGPFSAQTPSYLRGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVILMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7100 - protein, 269 aa, Quercus alba
MASTLMAATASSRTVLKPTPFLGQNRGTNVNSLRDVVPMGTGKYTMGNELWYGPDRVKYLGPFSAQTPSYLRGEFPGDYGWDTAGLSADPEAFARNRALEVIHGRWAMLGALGCITPEVLEKWVNVDFKEPVWFKAGAQIFSEGGLDYLGNPNLVHAQSILAVLGFQVILMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7101 - protein, 268 aa, Glycine max
MAATLMAATTSSGTLKATPFLGQGKGANANALRDVVSMGTGKYTMGNDLWYGPDRVKYLGPFSAQTPSYLKGEFPGDYGWDTAGLSADPEAFAKNRALEVIHGRWAMLGALGCITPEVLEKWLRVDFKEPVWFKAGAQIFSEGGLDYLGNPNLVHAQSILAVLGFQVILMGLVEGYRINGLDGVGEGNDLYPGGQYFDPLGLADDPVTFAELKVKEIKNGRLAMFSMFGFFVQAIVTGKGPLENLLDHLDNPVANNAWVYATKFSPGS

SEQ ID NO: 7102 - protein, 265 aa, Fraxinus spp
MASMAATASSTAVVRATPFLGQTKNANPLRDVVFMGNGKYTMGNDLWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPSLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFAPGS

SEQ ID NO: 7103 - protein, 264 aa, Juglans hindsii x Juglans regia
  misc_feature (23)..(23): Xaa can be any naturally occurring amino acid
MAATASSSTVLRPTPFLGQNRGXNANPLRDVVPMGTGKYTMGNDLWYGPDRVKYLGPFSAQTPSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVILMGLVEGFRINGLPGVGEGNDLYPGGQYFDPLGLADDPVAFAELKVKEIKNGRLAMFSMFGFFVQAIVTGKGPLENLLDHLDNPVANNAWVYATKFVPGS

SEQ ID NO: 7104 - protein, 269 aa, Phaseolus coccineus
MAATLMAATSSSGTVLKSTPFLGQGKGANANPLRDVVSMGTGKYTMSNELWYGPDRVKYLGPFSAQTPSYLKGEFPGDYGWDTAGLSADPEAFAKNRALEVIHGRWAMLGALGCITPEVLEKWLRVDFKEPVWFKAGAQIFSEGGLDYLGNPNLVHAQSILAVLGFQVVLMGLVEGFRINGLDGVGEGNNLYPGGQYFDPLGLADDPVNFAELKVKEIKNGRLAMFSMFGFFVQAIVTGKGPLENLLDHLDNPVANNAWVFATKFAPGS

SEQ ID NO: 7105 - protein, 214 aa, Arachis hypogaea
MAATLMAATASSGTVLKSTPFLGQTRGSNANPLRDVVSMGTGKYTMGNELWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSTWQFLDSKLSSWASSRASASTASPAWARATTSILGDSTLTLLDLPTTLSLSLSSR

SEQ ID NO: 7106 - protein, 264 aa, Unknown
  Sequence found in Organisms: Centaurea maculosa, Cirsium arvense
MAATAASSTTVVRATPFLGQARSNLNPLRDVVSIPNAKFTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7107 - protein, 264 aa, Tropaeolum majus
MASTATSSTVLSPTPFLGQTRGSSVNPLRDVVSMGTGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVILMGLVEGFRINGLPEVGEGNDLYPGGQYFDPLGLADDPVTFAELKVKEIKNGRLAMFSMFGFFVQAIVTGKGPLENLLDHLSDPVANNAWVYATKFAPGS

SEQ ID NO: 7108 - protein, 264 aa, Euonymus alatus
MASMLSASTVLRTTPFLGQGRSSFANPLRDVVSMGTPKYTMGNDLWYGPDRVKYLGPFSAQTPSYLTGEFPGDYGWDTAGLSADPEAFAKNRALEVIHGRWAMLGALGCITPEVLEKWVNVDFKEPVWFKAGAQIFSEGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDDPVANNAWVYATKFAPGS

SEQ ID NO: 7109 - protein, 264 aa, Platanus occidentalis
MAASASSSTVLRPTPFLGQNRAANANPLRDVVSMGTGKFTMGNELWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNNLYPGGTYFDPLGLADDPVTFAELKVKEIKNGRLAMFSMFGFFVQAIVTGKGPLENLLDHLDNPVANNAWVYATKFVPGS

SEQ ID NO: 7110 - protein, 264 aa, Prunus persica
MAATASSSTLLRPTPFLGQTRGPSFNTLRDVAPMGTGKYTMGNELWYGPDRVKYLGPFSAQTPSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7111 - protein, 267 aa, Aristolochia fimbriata
MAATITAASASSGTVLRPSAFLGQKSNANPLRDVVPAGNGRITMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGDGNNLYPGGTYFDPLGLADDPVTFAELKVKEIKNGRLAMFSMFGFFVQAIVTGKGPLENLLDHLDNPVANNAWVYATKFVPGS

SEQ ID NO: 7112 - protein, 264 aa, Vigna unguiculata
MAATSGSGTVLKPTPFLGQGKGANANPLRDAVSMGTGKYTMSNDLWYGPDRVKYLGPFSAQTPSYLKGEFPGDYGWDTAGLSADPEAFAKNRALEVIHGRWAMLGALGCITPEVLEKWLRVDFKEPVWFKAGAQIFSEGGLDYLGNPNLVHAQSILAVLGFQVVLMGLVEGFRINGLDGVGEGNNLYPGGQYFDPLGLADDPTTFAELKVKEIKNGRLAMFSMFGFFVQAIVTGKGPLENLLDHLDNPVANNAWVYATKFAPGS

SEQ ID NO: 7113 - protein, 264 aa, Cajanus cajan
MAATTSSGTVLKPTPFLGQGKGANANPLRDVVSMGTGKYTMGNELWYGPDRVKYLGPFSAQTPSYLKGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVVLMGLVEGFRINGLDGVGEGNNLYPGGQYFDPLGLADDPATFAELKVKEIKNGRLAMFSMFGFFVQAIVTGKGPLENLLDHLDNPVANNAWVYATKFVPGS

SEQ ID NO: 7114 - protein, 245 aa, Fagus grandifolia
MAATASSSTVLKPTPFLGQNRGTNANSLRDVVPMGTGKYTMGNDLWYGPDRVKYLGPFSAQTPSYLKGEFPGDYGWDTAGLSADPEAFAKNRALEVIHGRWAMLGALGCITPEVLEKYVNVDFKEPVWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPVGEPLGPS

SEQ ID NO: 7115 - protein, 264 aa, Beta vulgaris
MASMLSSGTVLRPTPFLGQGRGANGNTLRDVVPVGSAKFTMGNDLWYGPDRVKYLGPFSAQTPSYLNGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVILMGLVESFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7116 - protein, 264 aa, Centaurea maculosa
MAATAASSTTVVRATPFLGQARSNLNPLRDVVSIPNAKFTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLDGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7117 - protein, 265 aa, Cirsium arvense
MAATAASSTTVVRATPFLGQTRSSLINPLRDVVSIPNAKYTMGNDLWYGPDRVKYLGPFSAQTPSYLTGEFPGDYGWDTAGLSADPEAFAKNRALEVIHGRWAMLGALGCITPEVLEKWLKVDFKEPVWFKAGAQIFSEGGLDYLGNPNLVHAQSILAVLGFQVILMGLVEGFRINGLDGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7118 - protein, 264 aa, Cucumis sativus
MAATAATATLLRATPFLGQARASPQNPLRDVVAMGTGKYTMSNDLWYGPDRVKYLGPFSAQTPSYLNGEFPGDYGWDTAGLSADPEAFAKNRALEVIHGRWAMLGALGCITPEVLEKWLKVDFKEPVWFKAGSQIFTEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDDPVANNAWVYATKFAPGS

SEQ ID NO: 7119 - protein, 265 aa, Flaveria ramosissima
MASMAANSTTVVRATPFLGQTRGSNVNALRDSVSMVNGKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7120 - protein, 266 aa, Flaveria ramosissima
MASSMAANSTTVVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7121 - protein, 265 aa, Fraxinus spp
MASMAAAASSTTVVRATPFLGQTKNSNPLKDVVSVGNGKYTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7122 - protein, 264 aa, Humulus lupulus
MATTASSSSLLRPTPFLGQNRGTSSNGLRDVVPMGTGKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7123 - protein, 264 aa, Carica papaya
MAATASSRTVLSPTPFLGQTKGSSSNPLRDAVSLGTGKFTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVILMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7124 - protein, 266 aa, Tripterygium wilfordii
MASMLSASTSTVLRTTPFLGQGRTSFANPLRDVVSMGTPKYTMGNDLWYGPDRVKYLGPFSAQTPSYLTGEFPGDYGWDTAGLSADPEAFAKNRALEVIHGRWAMLGALGCITPEVLEKWVSVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7125 - protein, 263 aa, Vaccinium corymbosum
MASMFMAATSSTSTALRPTPFLGQTRGANANPPRFIVMASRNDLWYGPDRVKYLGPFSAQTPSYLTGEFPGDYGWDTAGLSADPEAFARNRALEVIHGRWAMLGALGCITPEVLEKWVKVDFKEPIWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7126 - protein, 266 aa, Catharanthus roseus
MASMAATATSSTTVVRATPFLGQTKTANPLRDVVSMGNPKFTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7127 - protein, 263 aa, Arachis hypogaea
MASTLSSTVVKPTPFLGQGRGTNNNTLRDVVSMGTGKYTMGNELWYGPDRVKYLGPFSAQTPSYLTGEFPGDYGWDTAGLSADPEAFARNRALEVIHGRWAMLGALGCITPEILEKWVRVDFKEPVWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7128 - protein, 269 aa, Vigna unguiculata
MAATLMAASASTGTVLKPTPFLGQSRATNANPLRDFVSMGHGKYTMGNELWYGPDRVKYLGPFSAQTPSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVVLMGLVEGFRINGLPGVGEGNDLYPGGQYFDPLGLADDPVAFAELKVKEIKNGRLAMFSMFGFFVQAIVTGKGPLENLLDHLDNPVANNAWVYATKFVPGS

SEQ ID NO: 7129 - protein, 264 aa, Malus domestica
MAAAASSSTLLRTTPFLGQSRGPSFNTLKDVVPMGTGKYTMGNDLWYGPDRVKYLGPFSAQTPSYLNGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7130 - protein, 264 aa, Vitis vinifera
MAATASSSTVLRPTPFLGQTRGANSNPLRDVVPMGTGKYTMGNELWYGPDRVKYLGPFSAQTPSYLTGEFPGDYGWDTAGLSADPEAFARNRALEVIHGRWAMLGALGCITPEVLEKWLGVDFKEPIWFKAGAQIFSEGGLDYLGNPNLVHAQSILAVLGFQVVLMGLVEGFRINGLPGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7131 - protein, 265 aa, Ipomoea nil
MASMAAAASSTTVVRATPFLGQTKNANPLRDAVPMGPAKFTMGNDLWYGPDRVKYLGPFSAQTPSYLTGEFPGDYGWDTAGLSADPEAFAKNRALEVIHGRWAMLGALGCITPEVLEKWLNVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7132 - protein, 264 aa, Medicago truncatula
MALMAASSAAVVKQTPFLGQRKGAANPLRDVVAMGTSRFTMGNELWYGPDRVKYLGPFSAQTPSYLTGEFPGDYGWDTAGLSADPEAFAKNRALEVIHGRWAMLGALGCITPEVLEKWVRVDFKEPVWFKAGSQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHIDNPVANNAWVYATKFVPGS

SEQ ID NO: 7133 - protein, 264 aa, Cucumis melo
MASTATSATLLRATPFLGQTRGSPQNPLRDFVAMGTGKYTMGNDLWYGPDRVKYLGPFSAQTPSYLNGEFPGDYGWDTAGLSADPEAFAKNRALEVIHGRWAMLGALGCITPEVLEKWLKVDFKEPVWFKAGAQIFTEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFAPGS

SEQ ID NO: 7134 - protein, 262 aa, Olea europaea
MAATASSSTVVRATPFLGQTKNVNPLKDVVSMGNGKYTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLEGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7135 - protein, 266 aa, Tragopogon dubius
MAATTASSTTVIRSSSFLGQTKGSNANTLRVSVSMANGGKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVILMGLVEGFRINGLDGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7136 - protein, 263 aa, Trigonella foenum-graecum
MAATASSATVVKQTPFLGQRKGAANPLRDVVAMGTSKFTMGNELWYGPDRVKYLGPFSAQTPSYLTGEFPGDYGWDTAGLSADPEAFAKNRALEVIHGRWAMLGALGCITPEVLEKWVRVDFKEPVWFKAGSQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHIDNPVANNAWVYATKFVPGS

SEQ ID NO: 7137 - protein, 263 aa, Vaccinium corymbosum
MASMFMAATSSTSTALRPTPFLGQTRGANANPPRFIVMASRNDLWYGPDRVKYLGPFSAQTPSYLTGEFPGDYGWDTAGLSADPEAFARNRALEVIHGRWAMLGALGCITPEVLEKWVKVDFKEPIWFKAGAQIFSEGGLDYLGNPNLVHAQSILAVLGFQVVLMGLVEGFRINGLPGVGEGNNLYPGGQYFDPLGLADDPATFAELKVKEIKNGRLAMFSMFGFFVQAIVTGKGPLENLLDHLDNPVANNAWVYATKFVPGS

SEQ ID NO: 7138 - protein, 264 aa, Cannabis sativa
MAATGSSSTLLRPTPFLGQNRGPSSNALKDVVPMGTGKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7139 - protein, 269 aa, Phaseolus coccineus
MAATLMAASASTGTVLKPTPFLGQSRGTNANPLRDVVSMGPGKYTMGNDLWYGPDRVKYLGPFSAQTPSYLTGEFPGDYGWDTAGLSADPEAFAKNRALEVIHGRWAMLGALGCITPEVLERWVKVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHIDNPVANNAWVYATKFVPGS

SEQ ID NO: 7140 - protein, 268 aa, Ricinus communis
MASTVMAATASSSSVLRPTPFLGQRGSSANPLKDVVSMGNGKYIMGNELWYGPDRVKYLGPFSAQTPSYLNGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFSPGS

SEQ ID NO: 7141 - protein, 270 aa, Lotus japonicus
MAATLMAATTASSGTVIKPSPFLGQTKGSNSNTLRDVVSMGTGKYTMGNDLWYGPDRVKYLGPFSAQTPSYLTGEFPGDYGWDTAGLSADPEAFAKNRALEVIHGRWAMLGALGCITPEVLEKWVRVDFKEPVWFKAGSQIFSEGGLDYLGNPNLVHAQSILAVLGFQVLLMGLVEGFRINGLPGVGEGNNLYPGGQYFDPLGLADDPATFAELKVKEIKNGRLAMFSMFGFFVQAIVTGKGPLENLLDHLDDPVANNAWVYATKFVPGS

SEQ ID NO: 7142 - protein, 162 aa, Centaurea maculosa
MLGALGCITPEVLEKWVKVDFKEPVWFKAGAQIFSEGGLDYLGNPNLVHAQSILAVLGFQVILMGLVEGFRINGLDGVGDGNNLYPGGQYFDPLGLADDPLTFAELKVKEIKNGRLAMFSMFGFFVQAIVTGKGPLENLLDHLDNPVAHNAWVYATKFVPGS

SEQ ID NO: 7143 - protein, 266 aa, Citrullus lanatus
MAATATATSATLLRATPFLGQTRGSSQNSLRDVVAMGTGKYTMGNDLWYGPDRVKYLGPFSAQTPSYLNGEFPGDYGWDTAGLSADPEAFAKNRALEVIHGRWAMLGALGCITPEVLEKWLKVDFKEPVWFKAGAQIFTEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFAPGS

SEQ ID NO: 7144 - protein, 265 aa, Amsonia hubrichtii
MASVAATASSNTVVRATPFLGQTKCANPLRDVVSMGNGKYTMGNELWYGPDRVKYLGPFSAQTPSYLNGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7145 - protein, 263 aa, Artemisia annua
MAATASSTVVRATPFLGQTRPSSINPLRDVVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLDGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7146 - protein, 263 aa, Manihot esculenta
MASMASSSTILRPTPFLGQKGSTANPLRDGVAMGNGKYIMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGKYFDPLGLADDPVTFAELKVKEIKNGRLAMFSMFGFFVQAIVTGKGPLENLLDHLDNPVANNAWVYATKFVPGS

SEQ ID NO: 7147 - protein, 263 aa, Catharanthus roseus
MAATATSSTTVVRATPFLGQTKTANPFRDVVSMGNPKFTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7148 - protein, 269 aa, Centaurea maculosa
  misc_feature (170)..(170): Xaa can be any naturally occurring amino acid
MASMAAATASSTTVVKATPFLGQTRSASNVNPLRDSVSMLNGKFTMSNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVIXMGLVEGFRINGLDGVGDGNNLYPGGQYFDPLGLADDPLTFAELKVKEIKNGRLAMFSMFGFFVQAIVTGKGPLENLLDHLDNPVAHNAWVYATKFVPGS

SEQ ID NO: 7149 - protein, 264 aa, Cichorium intybus
MAAAASSTTVVRATPFLGQTRPSSLNPLRDAVSMPSAKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7150 - protein, 263 aa, Flaveria ramosissima
MAAAANSTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7151 - protein, 264 aa, Panax ginseng
MATTASSSTVVRATPFLGQTKASNANPLRDVVSMGTGKFTMGNDLWYGPDRVKYLGPFSAQTPSYLNGEFPGDYGWDTAGLSADPEAFAKNRALEVIHGRWAMLGALGSITPEVLEKWVKVDFKEPVWFKAGAQIFTEGGLDYLGNPNLVHAQSILAVLGFQVVLMGLVEGFRINGLPGVGEGNDLYPGGQYFDPLGLADDPDTFAELKVKEIKNGRLAMFSMFGFFVQAIVTGKGPLENLLDHLDNPVANNAWVYATKFVPGS

SEQ ID NO: 7152 - protein, 265 aa, Lactuca sativa
MAATASSSSTVVRATPFLGQTKGSNANTLRDSVSMVNGKFTMGNDLWYGPDRVKYLGPFSAQTPSYLTGEFPGDYGWDTAGLSADPEAFAKNRALEVIHGRWAMLGALGSITPEVLAKWVKVDFKEPVWFKAGSQIFSEGGLDYLGNPNLVHAQSILAVLGFQVVLMGLVEGFRINGLDGVGDGNNLYPGGQYFDPLGLADDPVTFAELKVKEIKNGRLAMFSMFGFFVQAIVTGKGPLENLLDHLDDPVANNAWVYATKFAPGS

SEQ ID NO: 7153 - protein, 262 aa, Nicotiana tabacum
MAATASSTTVVRATPFLGQTKNANPLRDVVPMGSAKFTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNNLYPGGQYFDPLGLADDPTTFAELKVKEIKNGRLAMFSMFGFFVQAIVTGKGPLENLLDHLDNPVANNAWVYATKFVPGA

SEQ ID NO: 7154 - protein, 269 aa, Musa acuminata
MAATLTAASSRATTVVAPSPFLGQTRASSANPLRDAVPMGKGRITMGNELWYGPDRVKYLGPFSAQTPSYLKGEFPGDYGWDTAGLSADPEAFARNRALEVIHGRWAMLGAFGCITPEVLEKWVKVDFKEPVWFKAGAQIFSDGGLDYLGNPNLVHAQSILAVLGCQVVLMGLVEGFRINGLPGVGEGNDLYPGGTYFDPLGLADDPATFAELKVKEIKNGRLAMFSMFGFFVQAIVTGKGPLENLLDHLDNPVANNAWVYATKFVPGS

SEQ ID NO: 7155 - protein, 269 aa, Musa acuminata
MAATLTAASSRATTVVAPSPFLGQTRASSANPLRDAVPMGKGRITMGNELWYGPDRVKYLGPFSAQTPSYLKGEFPGDYGWDTAGLSADPEAFARNRALEVIHGRWAMLGAFGCITPEVLEKWLKVDFKEPVWFKAGAQIFSDGGLDYLGNPNLVHAQSILAVLGCQVVLMGLVEGFRINGLPGVGEGNDLYPGGTYFDPLGLADDPVTFAELKVKEIKNGRLAMFSMFGFFVQAIVTGKGPLENLLDHLDNPVANNAWVYATKFVPGS

SEQ ID NO: 7156 - protein, 268 aa, Unknown
  Sequence found in Organisms: Citrus sinensis, Citrus clementina, Citrus sinensis
MASIMAAATASSSTSLRATPFLGQSRTTANALKDVVPMGNAKYTMGNELWYGPDRVKYLGPFSAQTPSYLTGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLENPVANNAWVYATKFVPGS

SEQ ID NO: 7157 - protein, 264 aa, Cajanus cajan
MAATASTGTVLKPTPFLGLSRGINANPLRDVVSMGTGKYTMGNELWYGPDRVKYLGPFSAQTPSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7158 - protein, 262 aa, Gossypium raimondii
MASMLSSGIVLRPTPFLGQTKNANPLRDVVSLGTPKYAMGNELWYGPDRVKYLGPFSAQTPSYLTGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGFPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7159 - protein, 262 aa, Unknown
  Sequence found in Organisms: Gossypium hirsutum, Gossypium raimondii
MASMLSSGTVLRPTPFLGQNRNANPLRDVVSVGTAKYTMGNELWYGPDRVKYLGPFSAQIPSYLNGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7160 - protein, 265 aa, Plantago ovata
MASMAATASSTTVVRATPFLGQTKNANPLRDFVPMGKGKYSMGSDLWYGPDRVKYLGPFSAQTPSYLTGEFPGDYGWDTAGLSADPEAFAKNRALEVIHGRWAMLGALGCITPEVLEKWVSVDFKEPVWFKAGAQIFSEGGLDYLGNPNLVHAQSILAVLGFQVVLMGLVEGFRINGLDGVGEGNDLYPGGQYFDPLGLAEDPVTFAELKVKEIKNGRLAMFSMFGFFVQAIVTGKGPLENLLDHLDNPVANNAWVYATKFVPGS

SEQ ID NO: 7161 - protein, 268 aa, Papaver somniferum
MVSTLMAANSTTVLRTSPFLGQNRVSSPNSLRDVVAMGNGKYTMAGNDLWYGPDRVKYLGPFSAQTPSYLKGEFPGDYGWDTAGLSADPEAFAKNRALEVIHGRWAMLGALGCITPEVLEKWVKVDFKEPVWFKAGSQIFSEGGLDYLGNPNLVHAQSILAVLGFQVLLMGLVEGFRINGLDGVGEGNNLYPGGTYFDPLGLADDPVTFAELKVKEIKNGRLAMFSMFGFFVQAIVTGKGPLENLFDHLDNPVANNAWVYATKFVPGA

SEQ ID NO: 7162 - protein, 264 aa, Acacia harpophylla
MAATASSSTVLKPSPFLGQTRASNSNSLIDLVPLGKAKYTMGNELWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7163 - protein, 264 aa, Ambrosia trifida
MAATASSTTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7164 - protein, 232 aa, Ambrosia trifida
MASMAANSSTVVRATPFLGQTRASNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWLKVDFKEPVWFKAGAQIFSEGGLDYLGNPNLVHAQSILAVLGFQVVLMGLVEGFRINGLEGVGDGNNLYPGGQYFDPLGLADDPITFAELKVKEIKNGRLAMFSMLGFLYKQL

SEQ ID NO: 7165 - protein, 264 aa, Ambrosia trifida
MAATASSTTVVQATPFLGQTRPSSLNPLRDMVSMSSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7166 - protein, 265 aa, Ambrosia trifida
MASMAANSSTVVRATPFLGQTRTSNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWLKVDFKEPVWFKAGAQIFSEGGLDYLGNPNLVHAQSILAVLGFQVVLMGLVEGFRINGLEGVGDGNNLYPGGQYFDPLGLADDPITFAELKVKEIKNGRLAMFSMFGFFVQAIVTGKGPLENLLDHLDNPVANNAWVYATKFVPGS

SEQ ID NO: 7167 - protein, 265 aa, Arnica chamissonis
MASMAANSTTVVRATPFLGQTKASNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVVLMGLVEGFRINGLEGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7168 - protein, 265 aa, Arnica chamissonis
MASMAANSTTVVRATPFLGQTKASNVNSLRDSVSMINGKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVVLMGLVEGFRINGLEGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7169 - protein, 224 aa, Gossypium hirsutum
MGNELWYGPDRVKYLGPFSAQTPSYLTGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7170 - protein, 265 aa, Ipomoea batatas
MASMAAAASSTTVVRATPFLGQTKNANALRDAVPMGPAKFTMGNDLWYGPDRVKYLGPFSAQTPSYLTGEFPGDYGWDTAGLSADPEAFAKNRALEVIHGRWAMLGALGCITPEVLEKWLNVDFKEPVWFKAGAQIFSEGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGS

SEQ ID NO: 7171 - protein, 261 aa, Phalaenopsis aphrodite
MAATIIRPTPFLGQARPASAAANPLKDGLQMADWKFKMGNDLWYGPDRVKYLGPFSAQTPSYLTGEFPGDYGWDTAGLSADPEAFAKNRALEVIHGRWAMLGALGCITPEVLEKWLRVDFKEPVWFKAGSQIFSEGGLDYLGNPNLVHAQSILAVLGVQVILMGLVEGYRINGLDGVGEGNNLYPGGTYFDPLGLADDPPTFAELKVKEIKNGRLAMFSMFGFFVQAIVTGKGPLENLLDHLDDPVANNAWAYATKFVPGS

SEQ ID NO: 7172 - protein, 262 aa, Lippia dulcis
MASMASSTTLVKATPFLGQTKNPNPLRDVVSMGNAKYTMSNDLWYGPDRVKYLGPFSAQTPSYLNGEFPGDYGWDTAGLSADPEAFAKNRALEVIHGRWAMLGALGCITPEVLERWVGVNFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFAPGS

SEQ ID NO: 7173 - protein, 264 aa, Helianthus annuus
MAAAASSTTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7174 - protein, 265 aa, Helianthus annuus
MASMATSSSTVVRATPFLGQTRASNVNSLRDSVSMVNGKFTMGNELWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPITFAELKVKEIKNGRLAMFSMFGFFVQAIVTGKGPLENLLDHLDNPVANNAWVYATKFVPGS

SEQ ID NO: 7175 - protein, 264 aa, Tragopogon dubius
MAAAASSTTVVRATPFLGQTRTSSINPLRDFVSMPSAKFTMGNDLWYGPDRVKYLGPFSAQTPSYLTGEFPGDYGWDTAGLSADPEAFAKNRALEVIHGRWAMLGALGCITPEVLEKWVKVDFKEPVWFKAGSQIFSEGGLDYLGNPNLVHAQSILAVLGFQVILMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7176 - protein, 264 aa, Lactuca sativa
MAAAASSTTVVRATPFLGQTRPSGLNSLRDVVSMPSAKFTMGNDLWYGPDRVKYLGPFSAQTPSYLTGEFPGDYGWDTAGLSADPEAFAKNRALEVIHGRWAMLGAFGCITPEVLQKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFAPGS

SEQ ID NO: 7177 - protein, 211 aa, Papaver somniferum
MASTLMAANSTTVLRTSPFLGQNRVSSPNSLRDVVAMGNGKYTMAGNDLWYGPDRVKYLGPFSAQTPSYLKGEFPGDYGWDTAGLSADPEAFAKNRALEVIHGRWAMLGALGCITPEVLEKWVKVDFKEPVWFKAGSQIFSEGGLDYLGNPNLVHAQSILAVLGFQVLLMGLVEGFRINGLDGVGEGNNLYPGGPTSTHWDLPMTLLPLLN

SEQ ID NO: 7178 - protein, 194 aa, Ambrosia trifida
MASMATNSSTVVRATPFLGQTRATNVNSLRDSVSMVNGKFTMGNDLWYGPDRVKYLGPFSSQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGDGNNLYPGGAIL

SEQ ID NO: 7179 - protein, 282 aa, Ocimum basilicum
QWLHSPAQQPPFKATPFLGQTKNANPLRDVVSMGNAKYTMGNDLWYGPDRVKYLGPFSAQTPSYLTGEFPGDYGWDTAGLSADPEAFAKNRALEVIHGRWAMLGALGCITPEVLEKWVNVDFKEPVWFKAGAQIFTEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVFATKFTLDRKMGGYLIFSGVREWIRCVH

SEQ ID NO: 7180 - protein, 191 aa, Primula obconica
MDGTLLVCPADPEAFAKNRALEVIHGRWAMLGALGCITPEVLEKWVKVDFKEPVWFKAGAQIFSEGGLDYLGNPNLVHAQSILAVLGFQVILMGLVEGFRINGLPGVGDGNNLYPGGQYFDPLGLADDPVTFSELKVKEIKNGRLAMFSMFGFFVQAIVTGKGPLENLLDHLDSPVANNAWVYATKFVPGS

SEQ ID NO: 7181 - protein, 264 aa, Cicer arietinum
MAATASSATVVKQSPFLGQRKGASANPLRDVVSMGTSKFTMGNELWYGPDRVKYLGPFSAQTPSYLTGEFPGDYGWDTAGLSADPEAFAKNRALEVIHGRWAMLGALGCITPEVLEKWVRVDFKEPVWFKAGSQIFTEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHIDNPVANNAWVYATKFVPGS

SEQ ID NO: 7182 - protein, 265 aa, Ambrosia trifida
MASMAANSSTVVRATPFLGQTRTSNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWLKVDFKEPVWFKAGAQIFSEGGLDYLGNPNLVHAQSILAVLGFQVVLMGLVEGFRINGLEGIGDGNNLYPGGQYFDPLGLADDPITFAELKVKEIKNGRLAMFSMFGFFVQAIVTGKGPLENLLDHLDNPVANNAWVYATKFVPGS

SEQ ID NO: 7183 - protein, 262 aa, Antirrhinum majus
  misc_feature (119)..(119): Xaa can be any naturally occurring amino acid
MAATASSTTVVRATPFLGQTKTANPLRDVVSMGNGKYTMGNDLWYGPDRVKYLGPFSAQTPSYLTGEFPGDYGWDTAGLSADPEAFAKNRALEVIHGRWAMLGAFGCITPEVLQKWVSXQFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7184 - protein, 265 aa, Arnica chamissonis
MASMAANSTNVVRATPFLGQTKASNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWVKVDFKEPIWFKAGSQIFSEGGLDYLGNPNLVHAQSILAVLGFQVVLMGLVEGFRINGLEGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7185 - protein, 263 aa, Trifolium pratense
MALMAASSATVVKQTPFLGQRKGANSLRDVVAMGTSKFTMGNELWYGPDRVKYLGPFSAQTPSYLTGEFPGDYGWDTAGLSADPEAFAKNRALEVIHGRWAMLGALGCITPEVLEKWVRVDFKEPVWFKAGSQIFSEGGLDYLGNPNLVHAQSILAVLGFQVVLMGLVEGFRINGLPGVGDGNNLYPGGQYFDPLGLADDPVTFAELKVKEIKNGRLAMFSMFGFFVQAIVTGKGPLENLLDHLDNPVANNAWVYATKFVPGA

SEQ ID NO: 7186 - protein, 261 aa, Flaveria ramosissima
AANSTTVVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7187 - protein, 262 aa, Flaveria ramosissima
AAAASSTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7188 - protein, 264 aa, Lactuca sativa
MAAAASSTTVVRATPFLGQTRPSRLNSLRDVVSMPSAKFTMGNDLWYGPDRVKYLGPFSAQTPSYLTGEFPGDYGWDTAGLSADPEAFAKNRALEVIHGRWAMLGAFGCITPEVLQKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFAPGS

SEQ ID NO: 7189 - protein, 264 aa, Lactuca sativa
MAAAASSTTVVRATPFLGQTRSSSLNPLRDVVSMPSAKFTMGNDLWYGPDRVKYLGPFSAQTPSYLTGEFPGDYGWDTAGLSADPEAFAKNRALEVIHGRWAMLGAFGCITPEVLQKWVKVDFKEAVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDDPVANNAWVYATKFVPGS

SEQ ID NO: 7190 - protein, 262 aa, Olea europaea
MATTASSTAVVRATPFLGQTKNAKSFKDVVSMGNGKYTMGNDLWYGPDRVKYLGPFSAQTPSYLTGKFPGDYGWDTAGLSADPEAFAKNRALEVIHGRWAMLGALGCITPEVLEKWVKVYFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLGNPVANNAWVYATKFAPGS

SEQ ID NO: 7191 - protein, 262 aa, Lippia dulcis
MAAAASSTAVLGARPFLGKTKNANPLRDAVPMGNAKFAMSNDLWYGPDRVKYLGPFSAQTPSYLTGEFPGDYGWDTAGLSADPEAFARNRALEVIHGRWAMLGALGCITPEVLEKWLKVDFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7192 - protein, 263 aa, Populus trichocarpa
MASLASSSTIVRPTPFLGKRGSNANPLRDVVSMGNGKYIMSNELWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPATFAELKVKEIKNGRLAMFSMFGFFVQAIVTGKGPLENLLDHLDNPVANNAWVYATKFVPGS

SEQ ID NO: 7193 - protein, 261 aa, Primula obconica
MASMSTVLRPTPFLGQTKGANANSLRDVVAMGTGKYTMGNDLWYGPERVKYLGPFSAQTPSYLTGEFPGDYGWDTAGLSADPEAFAKNRALEVIHGRWAMLGALGCITPEVLEKWVKVDFKEPVWFKAGSQIFSEGGLDYLGNPNLVHAQSILAVLGFQVILMGLVEGFRINGLPGVGDGNNLYPGGEYFDPLGLADDPVTFAELKVKEIKNGRLAMFSMFGFFVQAIVTGKGPLENLLDHLDNPVANNAWVYATKFVPGS

SEQ ID NO: 7194 - protein, 263 aa, Scabiosa columbaria
MSMAASSSTVVRATPFLGGTRSYVNPLRDVVAMGTSRLTMGNDLWYGPDRVKYLGPFSAQTPSYLTGEFPGDYGWDTAGLSADPEAFAKNRALEVIHGRWAMLGALGCIFPEVLEKWVKVDFKEPVWFKAGAQIFSEGGLDYLGNPNLVHAQSILAVLGFQVVLMGLVEGFRINGLDGVGEGNNLYPGGTYFDPLGLADDPVTFAELKVKEIKNGRLAMFSMFGFFIQAIVTGKGPLENLLDHLDNPVANNAWVYATKFVPGA

SEQ ID NO: 7195 - protein, 263 aa, Scabiosa columbaria
MSMAASSSTVLRATPFLGQTRANANPLRDFVPMGPSKLTMGNDLWYGPDRVKYLGPFSAQTPSYLNGEFPGDYGWDTAGLSADPEAFAKNRALEVIHGRWAMLGALGCIFPEVLEKWVKVDFKEPVWFKAGAQIFSEGGLDYLGNPNLVHAQSILAVLGFQVVLMGLVEGFRINGLDGVGEGNNLYPGGTYFDPLGLADDPVTFAELKVKEIKNGRLAMFSMFGFFIQAIVTGKGPLENLLDHLDNPVANNAWVYATKFVPGA

SEQ ID NO: 7196 - protein, 269 aa, Elaeis guineensis
MAATLTAASARTTTIVGPTPFLGQTRASTSNPLRDVVSMGNGKFTMGNELWYGPDRVKYLGPFSAQTPSYLTGEFPGDYGWDTAGLSADPEAFARNRALEVIHGRWAMLGALGCITPEVLEKWVRVDFKEPVWFKAGAQIFTEGGLDYLGNPNLVHAQSILAVLGFQVVLMGLVEGYRINGLPGVGEGNDLYPGGTYFDPLGLADDPTTFAELKVKEIKNGRLAMFSMFGFFVQAIVTGKGPLENLLDHLDNPVANNAWVYATKFVPGS

SEQ ID NO: 7197 - protein, 268 aa, Lactuca sativa
MASMAATASSSSTVVRATPFLGQTKGSNANTLRDSVSMVNGKFTMGNDLWYGPDRVKYLGPFSAQTPSYLTGEFPGDYGWDTAGLSADPEAFAKNRALEVIHGRWAMLGALGSITPEVLAKWVKVDFKEPVWFKAGSQIFSEGGLDYLGNPNLVHAQSILAVLGFQVVLMGLVEGFRINGLDGVGDGNNLYPGGQYFDPLGLADDPVTFAELKVKEIKNGRLAMFSMFGFFVQAIVTGKGPLENLLDHLDDPVANNAWVYATKFAPGS

SEQ ID NO: 7198 - protein, 269 aa, Aquilegia formosa
MVATLMAASPTSSTVLKASPFLGQTRSSNANSLRNVVAMGTAKISMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVLLMGAVEGFRINGLDGVGEGNDLYPGGTYFDPLGLADDPVTFAELKVKEIKNGRLAMFSMFGFFVQAIVTGKGPLENLLDHLDNPVANNAWVYATKFVPGS

SEQ ID NO: 7199 - protein, 264 aa, Vigna unguiculata
  misc_feature (63)..(63): Xaa can be any naturally occurring amino acid
MAASASTGTVLKPTPFLGQSRATNANPLRDFVSMGHGKYTMGNELWYGPDRVKYLGPFSAQTXSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLGFQVVLMGLVEGFRINGLPGVGEGNDLYPGGQYFDPLGLADDPVAFAELKVKEIKNGRLAMFSMFGFFVQAIVTGKGPLENLLDHLDNPVANNAWVYATKFVPGS

SEQ ID NO: 7200 - protein, 264 aa, Platanus occidentalis
MAASANSSTVLRPTPFLGQNRVSSTNPLRNVVSMGTGKFTMGNDLWYGPDRVKYLGPFSAQTPSYLTGEFPGDYGWDTAGLSADPEAFAKNRALEVIHGRWAMLGALGCITPEVLEKWVNVDFKEPVWFKAGAQIFSEGGLDYLGNPNLVHAQSILAVLGFQVVLMGLVEGFRINGLPGVGEGNNLYPGGTYFDPLGLADDPVTFAELKVKEIKNGRLAMFSMFGFFVQAIVTGKGPLENLLDHLDNPVANNAWVYATKFVPGS

SEQ ID NO: 7201 - protein, 215 aa, Taraxacum officinale
MAAAASSTTVVRATPFLGQTRTSSLNPLRDVVSMPSAKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVVLMGLVEGFRINGLEGVGEGNNLYPGGQYFDPLGLADDPVTFAELKVKEIKN

SEQ ID NO: 7202 - protein, 265 aa, Unknown
  Sequence found in Organisms: Brassica napus, Brassica juncea, Brassica oleracea, Brassica rapa
MASTFMSSSSVLTPTPFLGQTKGSTFNPLRDAVSLGSPKYTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7203 - protein, 261 aa, Musa acuminata
MASSTVVTPTRFLGQTRTSTSANPLRDVVAMGRGRITMGNELWYGPDRVKYLGPFSAQTPSYLRGEFPGDYGWDTAGLSADPEAFARNRALEVIHGRWAMLGALGCITPEVLEKWLKVDFKEPVWFKAGAQIFSEGGLDYLGNPNLVHAQSILAVLGFQVVLMGLVEGFRINGLAGVGEGNDLYPGGTYFDPLGLADDPVTFAELKVKEIKNGRLAMFSMFGFFVQAIVTGKGPLENLLDHLDNPVTNNAWVYATKFVPGS

SEQ ID NO: 7204 - protein, 262 aa, Antirrhinum majus
  misc_feature (17)..(17): Xaa can be any naturally occurring amino acid
  misc_feature (227)..(227): Xaa can be any naturally occurring amino acid
  misc_feature (237)..(237): Xaa can be any naturally occurring amino acid
MAATASSTTVVKATPFXGQTKNANPLRDVVSMGNGKYAMSNDLWYGPDRVKYLGPFSAQTPSYLTGEFPGDYGWDTAGLSADPEAFAKNRALEVIHGRWAMLGAFGCITPEVLEKWVSVDFKEPVWFKAGAQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVXAIVTGKGPLXNLLDHLDNPVANNAWVYATKFVPGS

SEQ ID NO: 7205 - protein, 264 aa, Chelidonium majus
MAASASSSTVLRPSQFLGQNRASSSNSLRDVVAMGTGKYTMSNDLWYGPDRVKYLGPFSAQTPSYLTGEFPGDYGWDTAGLSADPEAFARNRALEVIHGRWAMLGALGCITPEVLQKWVKVDFKEAVWFKAGSQIFSEGGLDYLGNPNLVHAQSILAVLGFQVLLMGLVEGFRINGLDGVGDGNNLYPGGTYFDPLGLADDPVTFAELKVKEIKNGRLAMFSMFGFFVQAIVTGKGPLENLFDHLDDPVANNAWVYATKFVPGS

SEQ ID NO: 7206 - protein, 267 aa, Cicer arietinum
MALMAATASSATVVKQSPFLGQRKGASANPLRDVVSMGTSKFTMGNELWYGPDRVKYLGPFSAQTPSYLTGEFPGDYGWDTAGLSADPEAFAKNRALEVIHGRWAMLGALGCITPEVLEKWVRVDFKEPVWFKAGSQIFTEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHIDNPVANNAWVYATKFVPGS

SEQ ID NO: 7207 - protein, 261 aa, Solanum melongena
MAATASSSTVVRATPFLGQTRSVNPLRDLPVGNGRYAMSNDLWYGPDRVKYLGPFSAQTPSYLTGEFPGDYGWDTAGLSADPEAFAKNRALEVIHGRWAMLGALGCIFPEVLEKWVKVDFKEPVWFKAGAQIFSDGGLDYLGNPNLVHAQSILAVLGFQVVLMGLVEGFRINGLPGVGEGNDLYPGGQYFDPLGLADDPATFAELKVKEIKNGRLAMFSMFGFFVQAIVTGKGPLENLLDHLDNPVANNAWVYATKFVPGS

SEQ ID NO: 7208 - protein, 263 aa, Flaveria ramosissima
MAAAASSTVVHATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7209 - protein, 263 aa, Flaveria ramosissima
MAAAASSTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7210 - protein, 262 aa, Pisum sativum
MAATASSATVVKQTPFLGQRKSANPLRDVVAMGTSKFTMGNDLWYGPDRVKYLGPFSAQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQIVLMGLVEGFRINGLPDVGEGNDLYPGGQYFDPLGLADDPVTFAELKVKEIKNGRLAMFSMFGFFVQAIVTGKGPLENLLDHLDNPVANNAWVYATKFVPGA

SEQ ID NO: 7211 - protein, 265 aa, Capsicum annuum
MASMAATASSTTVVRATPFLGQTKNTNPLRDVVPMGSGKFTMSNDLWYGPDRVKYLGPFSAQTPSYLTGEFPGDYGWDTAGLSADPEAFAKNRALEVIHGRWAMLGALGCITPEVLEKWVKVDFKEPVWFKAGSQIFSDGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGS

SEQ ID NO: 7212 - protein, 262 aa, Capsicum annuum
MAATASSTTVVRATPFLGQTKNTNPLRDVVPMGSGKFTMSNDLWYGPDRVKYLGPFSAQTPSYLTGEFPGDYGWDTAGLSADPEAFAKNRALEVIHGRWAMLGALGCITPEVLEKWVKVDFKEPVWFKAGSQIFSDGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGS

SEQ ID NO: 7213 - protein, 262 aa, Unknown
  Sequence found in Organisms: Solanum tuberosum, Solanum phureja
MAATASSTTVVRATPFLGQTKNANPLRDVVAMGSARFTMSNDLWYGPDRVKYLGPFSAQTPSYLNGEFPGDYGWDTAGLSADPEAFAKNRALEVIHGRWAMLGALGCIFPEVLEKWVKVDFKEPVWFKAGAQIFSDGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGA

SEQ ID NO: 7214 - protein, 261 aa, Scabiosa columbaria
MSMAASSSTVLRATPFLGQTRANALRDFVPIGPSKLTMGNDLWYGPDRVKYLGPFSAQTPSYLNGEFPGDYGWDTAGLSADPEAFAKNRALEVIHGRWAMLGALGCIFPEVLEKWVKVDFKEPVWFKAGAQIFSEGGLDYLGNPNLVHAQSILAVLGFQVVLMGLVEGFRINGLDGVGEGNNLYPGGTYFDPLGLADDPVTFAELKVKEIKNGRLAMFSMFGFFIQAIVTGKGPLENLLDHLDNPVANNAWVYATKFVPGA

SEQ ID NO: 7215 - protein, 265 aa, Tabernaemontana elegans
MASMAATASSATVVRATPFLGQTKSVNPLKDVVSMGNGKYTMGNELWYGPDRLKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGYRINGLPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7216 - protein, 265 aa, Vinca minor
MASMAATASSTTVIRATPFLGLTKSANPLRDVLSMGNGKFTMGNELWYGPDRVKYLGPFSAQTPSYLTGEFPGDYGWDTAGLSADPEAFAKNRALEVIHGRWAMLGALGCITPEVLEKWVNIDFKEPVWFKAGAQIFSEGGLDYLGNPNLVHAQSILAVLGFQVVLMGLVEGFRINGLPGVGEGNDLYPGGQYFDPLGLADDPVTFDELKVKEIKNGRLAMFSMFGFFVQAIVTGKGPLENLLDHLDNPVANNAWVYATKFVPGS

SEQ ID NO: 7217 - protein, 251 aa, Ambrosia trifida
MASMATNSSTVVRATPFLGQTRASNVNSLRDSVSMVNGKFTMGNELWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGDGNDLYPGGQYFDPLGLADDPITFAELKVKEIKNGRLAMFSMFGFFVQAIVTGKGPLEKPFGPFGQPCG

SEQ ID NO: 7218 - protein, 270 aa, Amorphophallus konjac
MAATLTVASASSTVRPTPFLGQTRGSPANPLIRDAVPMGNGKYTMGNELWYGPDRVKYLGPFSAQTPSYLTGEFPGDYGWDTAGLSADPEAFARNRALEVIHGRWAMLGALGCITPEVLEKWVRVDFKEPVWFKAGAQIFSAGGLDYLGNPNLVHAQSILAVLGFQVVLMGLVEGYRINGLPGVGEGNDLYPGGQYFDPLGLADDPATFAELKVKEIKNGRLAMFSMFGFFVQAIVTGKGPLGEPARPPRQPRRQQRLGLRHPSSPRDLN

SEQ ID NO: 7219 - protein, 285 aa, Flaveria ramosissima
MAAAASSTVVHATPFLGQSRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDTLWLTMHGFMPLSLCLALRVFSLSTVLVTASLGRKMCRLL

SEQ ID NO: 7220 - protein, 224 aa, Flaveria ramosissima
MGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPITFAELKVKEIKNGRLAMFSMFGFFVQAIVTGKGPLENLLDHLDNPVANNAWVYATKFVPGS

SEQ ID NO: 7221 - protein, 224 aa, Populus trichocarpa
MGNELWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGS

SEQ ID NO: 7222 - protein, 267 aa, Eschscholzia californica
MVSTLMAASANSSTVLRPSQFLGQNRVSNSLRDVVAMGTSKYTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVILMGLVEGFRINGLPGVGEGNNLYPGGTYFDPLGLADDPTTFAELKVKEIKNGRLAMFSMFGFFVQAIVTGKGPLENLLDHLDNPVANNAWVYATKFVPGS

SEQ ID NO: 7223 - protein, 262 aa, Nicotiana benthamiana
MAATGSSATVVRATPFLGQTKYANPLRDVVPMGSAKFTMSNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7224 - protein, 262 aa, Unknown
  Sequence found in Organisms: Solanum lycopersicum, Solanum tuberosum, Solanum phureja
MAATGSSATVVRATPFLGQTKYANPLRDIVPMGSARFTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLPGVGEGNNLYPGGQYFDPLGLADDPTTFAELKVKEIKNGRLAMFSMFGFFVQAIVTGKGPLENLLDHLDNPVANNAWVYATKFVPGS

SEQ ID NO: 7225 - protein, 262 aa, Nicotiana tabacum
MAATGSSATVVRATPFLGQIKYANPLRDVVPMGSAKFTMSNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7226 - protein, 265 aa, Brassica juncea
MASTFTSSSSVLTQTPFLGQTKGSTFNPLRDVVSLGTPKCTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7227 - protein, 265 aa, Brassica juncea
MASTFTSSSSVLSPTPFLGQTKGSTFNPLRDVVSLGTPKYTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7228 - protein, 265 aa, Triticum aestivum
MASTFMSSSSVLTPTPFLGQTKGSTFNPLRDAVSLGSPKYTMGNDLWYGPDRVKYLGPFSVQTPSYLTGEFPGDYGWDIAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7229 - protein, 265 aa, Arabidopsis lyrata
MASTFTSSSSVLSPTTFLGQTKASSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFAPGA

SEQ ID NO: 7230 - protein, 265 aa, Arabidopsis thaliana
MASTFTSSSSVLTPTTFLGQTKASSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFAPGA

SEQ ID NO: 7231 - protein, 262 aa, Arnica chamissonis
MAANSTTVVRATPFLGQTKASNVNSLRDSVSMVNGKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVVLMGLVEGFRINGLEGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7232 - protein, 263 aa, Artemisia annua
MASTAAASSTTVVRATPFLGQTKGSNVNSLRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLDGVGDGNNLYPGGQYFDPLGLADDPATFAELKVKNGRLAMFSMFGFFVQAIVTGKGPLENLLDHLDNPVANNAWVYATKFVPGS

SEQ ID NO: 7233 - protein, 265 aa, Brassica napus
MASTFMSSSSVLTPTPFLGQTKGSTFNPLRDAVSLGSPKYTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTLAELKVKEIKNGRLAMFSMFGFFVQAIVTGKGPLENLLDHLDNPVANNAWAFATKFVPGA

SEQ ID NO: 7234 - protein, 263 aa, Euphorbia peplus
MAATASSSSVLRPTPFFGQRGSTSNSLRDVVSLGNSKYIMGNELWYGPDRVKYLGPFSAQTPSYLSGEFPGDYGWDTAGLSADPEAFAKNRALEVIHGRWAMLGALGCIIPEVLEKWVKVDFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDDPVANNAWVYATKFVPGS

SEQ ID NO: 7235 - protein, 259 aa, Flaveria ramosissima
NSTTVVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7236 - protein, 264 aa, Panax ginseng
MAATASSSTVVRATPFLGQTKGPNANSLRDVVSMGTGKFTMGNDLWYGPDRVKYLGPFSAQTPSYLNGEFPGDYGWDTAGLSADPEAFAKNRALEVIHGRWAMLGALGCITPEILQKWVKVDFKEPVWFKAGSQIFTEGGLDYLGNPNLVHAQSILAVLGFQVVLMGLVEGFRINGLAGVGEGNDLYPGGQYFDPLGLADDPVTFAELKVKEIKNGRLAMFSMFGFFIQAIVTGKGPLENLLDHLDNPVANNAWVYATKFVPGS

SEQ ID NO: 7237 - protein, 224 aa, Gossypium hirsutum
MGNELWYGPDRVKYLGPFSAQTPSYLTGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGFPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7238 - protein, 90 aa, Papaver somniferum
MYLSSGNKLGCVNPSIVSNRVVKVIKEVLKRTFSGNNGLNKETEHRKHSKTSVLNFLHLQFSKGNRVIGKSQWVEVGSTRVQIVSLTNSV

SEQ ID NO: 7239 - protein, 241 aa, Cynara scolymus
  misc_feature (239)..(239): Xaa can be any naturally occurring amino acid
MGNDLWYGPDRVKYLGPFSAQTPSYLSGEFPGDYGWDTAGLSADPEAFAKNRALEVIHGRWAMLGALGCITPEVLEKWLKVDFKEPVWFKAGAQIFSEGGLDYLGNPNLVHAQSILAVLGFQVILMGLVEGFRINGLDGVGDGNNLYPGGQYFDPLGLADDPLTFAELKVKEIKNGRLAMFSMFGFFVQAIVTGKGPLENLLDHLDNPVANNAWVYATKFVPGQSLWCKCYEFMNQTGXFQ

SEQ ID NO: 7240 - protein, 224 aa, Flaveria ramosissima
MGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7241 - protein, 224 aa, Flaveria ramosissima
MGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7242 - protein, 264 aa, Sarracenia psittacina
MAATTGTGTVVRPTPFLGQIRGSTANPFRDVVSMGTAKFTMGNELWYGPDRVKYLGPFSAQTPSYLTGEFPGDYGWDTAGLSADPEAFAKNRALEVIHGRWAMLGALGCITPEVLQKWVKVAFKEPVWFKAGAQIFSEGGLDYLGNPNLVHAQSILAVLGFQVVLMGLVEGFRINGLPGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7243 - protein, 1204 aa, Brassica rapa
MLSASLAKSSLEEMLESLRQKDECHQQPRDIPPALPSRPTSRARLPSARRSLPANFSVSSVIEDQNQSGSVASSRQPEAEGKRRKEKDLRVKRKSFGSKKMRRTGYVSESPYAAEKEEEEVVKVTAAAKVSPVEEQKPEWNDNVDYFIKKKLRVWCRVANGQWQLGKIQSTAADTSLVMLSTANVVEVSTEDLFPANPDILEGVENLIQLSYLNEPSVLFNLRVRYSQDVIYSKAGPVLIAVNPFKNVDIYGDDFISAYQKKDVDAPHVYAVAGAAYDEMMREEKNQSIIISGESGAGKTETAKFAMQYLAALGGGSCGVEYEILKTTCILEAFGNAKTSRNANSSRFGKLIEIHFSAMGKICGAKLETLSFDQSRVVQLCNGERSYHIFYEFCAGASPVLKERLKLKTASEYTYLNQSDCLTIDRVDDAQKFRKLLEAFDIVQIPKEHQERVFALLAAVLWLGNVSFRVTDNENHVEVVADEAVTNAAMLMGCNSEELMVVLSTRKLQAGTDCISKKLTLRQATNMRDGIAKFIYASLFDWLVEQINIALEVGKSLTGRSISILDIYGFESFKNNSFEQFCINYANERLQQHFNRHLFKLEQEEYEEDGIDWTKVEFVDNQECLDLIEKKPIGLLTLLDEESNFPKATDLTFANKLKQHLKTNSCFKGERGRAFRVNHYAGEVLYDTNGFLEKNRDPLPADLINLLSSCDCQLLKLFSTKMRGKYQKPLMLSDSTNQTVGTKFKGQLFKLMNKLENTTPHFIRCIKPNSKQLPRVYEEDLVLQQLRCCGVLEVVRISRSGYPTRLTHQEFAGRYGFLLSDKKVSQDPLSVSIAVLKQYDVHPEMYQVGYTKLYLRTGQIGVFEDRRKKVLQGIVGLQKHLRGRLSREYFQNMRNGALVLQSYVRGENGRRMFDTKAKIHAVSVSEASAGELTAVINLQSAVRGWLSRKRFNSMQRQKELVDVTTKSKRKGGRRVSEDKDLPVERFQVQQSAMSDLQKRVLKSEEALVQKEEENTALRDQLRQFEERWSEYEIKMKSMEDTWQKQMSSLQMSLAAARKSLATENNTGQAGGRQDASMSPFGYDSEDTMSTGTPGVRTPTTKFSNGNTPELRIRELNGSLNAVNHLAREFDQRRLNFDEDARAIVEVKGGPQATPNGQQHPEDEFKRLKLRFETWKKDYKARLRETKARLHSDKGRHRKWWGKRG

SEQ ID NO: 7244 - protein, 144 aa, Elaeis guineensis
MASTFTSSSSVLTPTTFLGQTKASSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKDQSGSKPVHKSSPKAVWTT

SEQ ID NO: 7245 - protein, 204 aa, Gossypium hirsutum
MASMLSSGTVLRPTPFLGQNRNANPLRDVVSVGTAKYTMGNELWYGPDRVKYLGPFSAQIPSYLNGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGLPEVGEGNDLYPGGQYFDPLGLADKPCHIC

SEQ ID NO: 7246 - protein, 205 aa, Flaveria ramosissima
ANSTTVVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELK

SEQ ID NO: 7247 - protein, 171 aa, Flaveria ramosissima
TVVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFALTGSRV

SEQ ID NO: 7248 - protein, 218 aa, Heritiera littoralis
RQPFDSERQWLRCLALELSLGPTPFLGQNRTSNANALKDVVSMGNGKYTMGNELWYGPDRVKYLGPFSAQTPSYLTGEFPGDYGWDTAGLSADPEAFARNRALEVIHGRWAMLGALGCITPEVLEKWVRVNFKEPVWFRAGAQIFSEGGLDYLGNPNLVHAQSILAVLGFQVVLMGLVEGFRINGLPGVGVGKAFTLVADTLTLLALPMTLSHLLNSR

SEQ ID NO: 7249 - protein, 265 aa, Brassica juncea
MTSTLTTSSSVLCPTTFLGQTRSSSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7250 - protein, 265 aa, Brassica juncea
MASTFTSSSSVLCPTTFLGQTKSSSFNPLRDVVSLGSPKYTMGNDLWYGPDRVKYLGPFSIQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7251 - protein, 263 aa, Amborella trichopoda
MAATVGTSSVVRPSTFLLGQGKTLSPLRDNISFGNGRFTMGNDLWYGPDRVKYLGPFSAQTPSYLTGEFPGDYGWDTAGLSADPEAFARNRALEVIHGRWAMLGALGCITPEVLQKWVKVQLKEPVWFKAGAQIFSEGGLDYLGNPNLVHAQSILAVLGFQVVLMGLVEGYRINGLPGVGEGNNLYPGGTYFDPLGLADDPITFAELKVKEIKNGRLAMFSMFGFFVQAIVTGKGPLENLLDHLENPVANNAWVYATKFVPGS

SEQ ID NO: 7252 - protein, 265 aa, Brassica juncea
MASTFTSSSSVLTQTPFLGQTKGSTFNPLRDVVSLGTPKCTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7253 - protein, 263 aa, Coffea canephora
MAAAAGSSTVVVRATPFLGQPKNANPLREVVSMGNGKYTMGNELWYGPDRLKYLGPFSAQTPSYLTGEFPGDYGWDTAGLSADPEAFARNRALEVIHGRWAMLGALGCITPEVLEKYLKVDFKEPVWFKAGAQIFSEGGLDYLGNPNLVHAQSILAVLGFQVVLMGLVEGYRINGLEGVGEGNDLYPGGQYFDPLGLADDPATFAELKVKEIKNGRLAMFSMFGFFVQAIVTGKGPLENLLDHLDNPVANNAWVYATKFVPGS

SEQ ID NO: 7254 - protein, 254 aa, Flaveria ramosissima
NIVRATPFLGQTRGSNVNALRDSVSMVNGKFTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVP

SEQ ID NO: 7255 - protein, 255 aa, Flaveria ramosissima
VVRATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7256 - protein, 266 aa, Nuphar advena
  misc_feature (21)..(21): Xaa can be any naturally occurring amino acid
  misc_feature (31)..(31): Xaa can be any naturally occurring amino acid
  misc_feature (139)..(139): Xaa can be any naturally occurring amino acid
  misc_feature (200)..(200): Xaa can be any naturally occurring amino acid
MASTLASARSGTIVKTPFLGXARSSNAKSLXDLVSFGNGKFTMGNELWYGPDRVKYLGPFSAQTPSYLTGEFPGDYGWDTAGLSADPEAFAKNRALEVIHGRWAMLGALGCITPEVLQKWVKVQFKEPVWFKAGAQIFXEGGLDYLGNPNLVHAQSILAVLGFQVILMGLVEGFRINGLPGVGEGNNLYPGGQYFDPLGXADDPVTFFELKVKEIKNGRLAMFSMFGFFVQAIVTGKGPLENLLDHLDNPVANNAWVYATKFVPGF

SEQ ID NO: 7257 - protein, 265 aa, Raphanus sativus
MASTFTSSSSILSPTPFLGQTKGSTFNPLRDVVSLGTPKYTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7258 - protein, 264 aa, Triphysaria pusilla
MAATASSTSLVIRATPFLGNTKNAINPLRDVVSMGNAKYTMSNDLWYGPDRVKFLGPFSAQTPSYLNGEFPGDYGWDTAGLSADPEAFAKNRALEVIHGRWAMLGALGCITPEVLEKWVSVDFKEPVWFKAGAQIFSEGGLDYLGNPNLVHAQSILAVLGFQVVLMGLVEGFRINGLDGVGDGNDLYPGGQYFDPLGLADDPVTFAELKVKEIKNGRLAMFSMFGFFLQAIVTGKGPLENLLDHLDNPVANNAWVYATKFVPGS

SEQ ID NO: 7259 - protein, 264 aa, Brassica juncea
MASTFTSSSSVLTQTPFLGQTKGSTFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPG

SEQ ID NO: 7260 - protein, 260 aa, Capsicum annuum
MAATSSSASVVRATPFLGQTKYANPLRDVVSMGSGKFTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVP

SEQ ID NO: 7261 - protein, 262 aa, Nicotiana benthamiana
MAATGSSATVVRATPFLGQTKYANPLRYVVPMGSAKFTMSNELWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGDGNNLYPGGQYFDPLGLADDPTTFAELKVKEIKNGRLAMFSMFGFFVQAIVTGKGPLENLLDHLDNPVANNAWVYATKFVPGS

SEQ ID NO: 7262 - protein, 263 aa, Euphorbia esula
  misc_feature (60)..(60): Xaa can be any naturally occurring amino acid
MAATAISSSVLRPTPFFGQRGSTSNPLRDVVSLGNSKYIMGNELWYGPDRVKYLGPFSAXTPSYLSGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVILMGLVEGFRINGLEGVGEGNDLYPGGQYFDPLGLADDPVTFAELKVKEIKNGRLAMFSMFGFFVQAIVTGKGPLENLLDHLDDPVANNAWVYATKFVPGS

SEQ ID NO: 7263 - protein, 228 aa, Allium cepa
MAAAASTIVSPFLVGQSRVSAASQLRNVASMGNGKFTMGNELWYGPDRVKYLGPFSAQTPSYLTGEFPGDYGWDTAGLSADPEAFARNRALEVIHGRWAMLGALGCITPEVLQKWVNINFKEPVWFKAGAQIFSQGGLDYLGNPNLVHAQSILAVLGFQVLLMGAVEGFRINGLEGVGNGNDLYPGGQYFDPLGLADDPVTFAELKVKEIKTAGWLCSPCSGSLCRPL

SEQ ID NO: 7264 - protein, 261 aa, Allium cepa
MAAAASTIASPFLVGQSRVSAASQLRNVASVGNGKFTMGNELWYGPDRVKYLGPFSAQTPSYLTGEFPGDYGWDTAGLSADPEAFARNRALEVIHGRWAMLGALGCITPEVLQKWVNVNFKEPVWFKAGAQIFSQGGLDYLGNPNLVHAQSILAVLGFQVLLMGAVEGFRINGLDGVGNGNDLYPGGQYFDPLGLADDPVTFAELKVKEIKNGRLAMFSMFGFFVQAIVTGKGPLENWLDHLDNPVANNAWVYATKFVPGS

SEQ ID NO: 7265 - protein, 265 aa, Unknown
  Sequence found in Organisms: Thellungiella halophila, Eutrema halophilum
MASTFTSSSSVLTPTPFLGQTKGSSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVEFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHIDDPVANNAWAFATKFVPGA

SEQ ID NO: 7266 - protein, 265 aa, Eutrema parvulum
MASTFTSSSSVLSPTTFLGQTKGSTFNPLRDVVSLGSPKYTMGNDLWYGPDRVKYLGPFSVQTPSYLTGEFPGDYGWDTAGLSADPEAFAKNRALEVIHGRWAMLGALGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHIDSPVANNAWAFATKFVPGA

SEQ ID NO: 7267 - protein, 265 aa, Fagopyrum esculentum
MASMFSSGTLLRPTPFLSGQTRGGQANALRDVVSMGTPKFTMSNDLWYGPDRVKYLGPFSAQTPSYLTGEFPGDYGWDTAGLSADPEAFSKNRALEVIHGRWAMLGALGCITPEVLQKWVKVNFKEPIWFKAGAQIFSEGGLDYLGNPNLVHAQSILAVLGFQVVLMGLVEGFRINGLDGVGEGNNLYPGGQYFDPLGLADDPSTFAELKVKEIKNGRLAMFSMFGFFVQAIVTGKGPLENLLDHLDNPVANNAWVYATKFVPGS

SEQ ID NO: 7268 - protein, 256 aa, Flaveria ramosissima
TVVRATPFLGQTRGSNVNSLRDSLSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPITFAELKVKEIKNGRLAMFSMFGFFVQAIVTGKGPLENLLDHLDNPVANNAWVYATKFVPGS

SEQ ID NO: 7269 - protein, 256 aa, Flaveria ramosissima
TVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7270 - protein, 255 aa, Flaveria ramosissima
VVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7271 - protein, 264 aa, Vitis vinifera
MAATASSSTGLRPTQFLGQTRGSNANQLREVVPMGTGKFTMGNELWYGPDRVKYLGPFSAQTPSYLTGEFPGDYGWDTAGLSADPEAFARNRALEVIHGRWAMLGAFGCITPEVLEKWVKVDFKEPVWFKAGAQIFSEGGLDYLGNPNLVHAQSILAVLGFQVVLMGLVEGYRINGLPGVGEGNDLYPGGPYFDPLGLADDPVTFAELKVKEIKNGRLAMFSMFGFFVQAIVTGKGPLENLLDHLDNPVANNAWAYATKFVPGS

SEQ ID NO: 7272 - protein, 263 aa, Mimulus guttatus
MAAAAASSSAVVRATPFLGQTKTANPLRDVVSMGNGKYTMGNDLWYGPDRVKYLGPFSAQTPSYLTGEFPGDYGWDTAGLSADPEAFAKNRALEVIHGRWAMLGAFGCITPEILQKWVGVTLKEPVWFKAGSQIFSEGGLDYLGNPNLVHAQSILAVLGFQVLLMGAVEGFRINGLDGVGDGNDLYPGGQYFDPLGLADDPVTFAELKVKEIKNGRLAMFSMFGFFVQAIVTGKGPLENLLDHLDNPVANNAWVFATKFAPGS

SEQ ID NO: 7273 - protein, 265 aa, Raphanus sativus
MASTFTSSSSVLCPTTFLGQTKSSSFNPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7274 - protein, 271 aa, Zamia vazquezii
MAATITTAASTSSISKSSFLGSSRVSRSFTNALRNNVSLANARPRIIMGNELWYGPDRVKYLGPFSAQTPPYLTGEFPGDYGWDTAGLSADPEAFARNRALEVIHGRWAMLGALGCITPEVLEKWLRVDFKEPVWFKAGAQIFSEGGLDYLGNPNLIHAQSILAVLGFQVILMGLVEGFRINGLPGVGEGGDLYPGGTYFDPLGLADDPDTFAELKVKELKNGRLAMFSMFGFFVQAIVTGKGPLENLLDHLDNPVANNAWNYATKFVPGS

SEQ ID NO: 7275 - protein, 168 aa, Ambrosia trifida
MAATASSTTVVQATPFLGQTRPSSLNPLRDMVSMSSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLWAC

SEQ ID NO: 7276 - protein, 117 aa, Flaveria ramosissima
MAAAASSTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLESG

SEQ ID NO: 7277 - protein, 262 aa, Eschscholzia californica
MAASANSSTVLRPSQFLGQNRVSNSLRDVVAMGTSKYTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFSEGGLDYLGNPNLVHAQSILAVLGFQVILMGLVEGFRINGLPGVGEGNNLYPGGTYFDPLGLADDPTTFAELKVKEIKNGRLAMFSMFGFFVQAIVTGKGPLENLLDHLDNPVANNAWVYATKFVPGS

SEQ ID NO: 7278 - protein, 265 aa, Brassica napus
MASTFTSSSSVLCPTTFLGQTRSSSFNPLRDVVSLGSPKYTMGNDLWYGPDRVKYLGPFSVQTPSYLTGEFPGEYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGLRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7279 - protein, 252 aa, Flaveria ramosissima
ATPFLGQTRGSNVNSLRDSLSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPITFAELKVKEIKNGRLAMFSMFGFFVQAIVTGKGPLENLLDHLDNPVANNAWVYATKFVPGS

SEQ ID NO: 7280 - protein, 264 aa, Vitis vinifera
MAATASSSTGLRPTQFVGQTRGSNANQLREVVPMGTGKFTMGNELWYGPDRVKYLGPFSAQTPSYLTGEFPGDYGWDTAGLSADPEAFARNRALEVIHGRWAMLGAFGCITPEVLEKWVKVDFKEPVWFKAGAQIFSEGGLDYLGNPNLVHAQSILAVLGFQVVLMGLVEGYRINGLPGVGEGNDLYPGGPYFDPLGLADDPVTFAELKVKEIKNGRLAMFSMFGFFVQAIVTGKGPLENLLDHLDNPVANNAWAYATKFVPGS

SEQ ID NO: 7281 - protein, 264 aa, Tripterygium wilfordii
MTSMLSSSTVLRTTPFLGQGRTSFANPLGDVVSMGTPKYIMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGEGNDLYPGGQYFDPLGLANDPVSISELKVKEIKNGRLAMFSMFGFFVQAIVTGKGPLENLLDHLDNPVANNAWVYATKFVPGS

SEQ ID NO: 7282 - protein, 259 aa, Vinca minor
TASSTTVIRATPFLGQTKSSNPLRDVVSMGNAKYTMGNELWYGPDRVKYLGPFSAQTPSYLNGEFPGDYGWDTAGLSADPEAFAKNRALEVIHGRWAMLGALGCITPEVLEKWVNVDFKEPVWFKAGAQIFSEGGLDYLGNPNLVHAQSILAVLGFQVVLMGLVEGFRINGLAGVGEGDNLYPGGQYFDPLGLADDPVTFDELKVKEIKNGRLAMFSMFGFFVQAIVTGKGPLENLLDHLDNPVANNAWVYATKFVPGS

SEQ ID NO: 7283 - protein, 271 aa, Gossypium hirsutum
NSKSIPIDKQWLPCLALELFLGQPHSWPTKNANPLRDVVSLGTPKYAMGNELWYGPDRVKYLGPFSAQTPSYLTGEFPGDYGWDTAGLSADPEAFARNRALEVIHGRWAMLGALGCITPEVLEKWLRVDFKEPVWFKAGAQIFSEGGLDYLGNPNLVHAQSILAVLGFQVVLMGLVEGFRINGLPGVGEGNDLYPGGQYFDPLGLAEDPVTFAELKVKEIKNGRLAMFSMFGFFVQAIVTGKGPLENLLDHLDNPVANNAWVYATKFVPGS

SEQ ID NO: 7284 - protein, 264 aa, Zingiber officinale
MAAATLTAATVVGTFLGQARPSNGHNPLRDFVPMGKGKFTMGNDLWYGPDRVKYLGPFSAQTPSYLTGEFPGDYGWDTAGLSADPEAFAKNRALEVIHGRWAMLGALGCITPEVLQKWLRVEFKEPVWFKAGSQIFSEGGLDYLGNPNLVHAQSILAVLGFQVILMGLVEGYRINGIPGVGEGNDLYPGGTYFDPLGLADDPVAFAELKVKEIKNGRLAMFSMFGFFVQAIVTGKGPLENLLDHLDNPVANNAWVYATKFAPGS

SEQ ID NO: 7285 - protein, 267 aa, Capsicum annuum
MAATSSSASVVRATPFLGQTKYANPLRDVVSMGSGKFTMSNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLPGVGEGNDLYPGGQYFDPLGLADDPTTFAELKVKEIKNGRLAMFSMFGFFVQAIVTGKGPLENLLDHLDNPVANNAWVYATKFVPGSYIFTF

SEQ ID NO: 7286 - protein, 268 aa, Podocarpus macrophillus
MASTITAASTAAITKSSFLAPAKSFTNAIREEVSFVNSRPKYTMSSNNLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGYRINGLAGVGEGGDLYPGGQYFDPLGLADDPETFAELKVKEIKNGRLAMFSMFGFFVQAIVTGKGPLENLLDHLDNPVANNAWNYATKFAPGS

SEQ ID NO: 7287 - protein, 224 aa, Cleome spinosa
MSNDLWYGPDRVKYLGPFSVQTPSYLTGEFPGDYGWDTAGLSADPEAFAKNRALEVIHGRWAMLGALGCITPEVLEKWVRVDFKEPVWFKAGAQIFSEGGLDYLGNPNLVHAQSILAVLAFQVVLMGLVEGFRINGLEGIGEGNDLYPGGQYFDPLGLAEDPVTFAELKVKEIKNGRLAMFSMFGFFVQAIVTGKGPLENLLDHLDNPVANNAWAYATKFVPGA

SEQ ID NO: 7288 - protein, 255 aa, Cynara scolymus
PPVVRATPFLGQTRSTLINPLRDAVSIPNAKFTMGNDLWYGPDRVKYLGPFSAQTPSYLTGEFPGDYGWDTAGLSADPEAFAKNRALEVIHGRWAMLGALGCITPEVLEKWLKVDFKEPVWFKAGAQIFSEGGLDYLGNPNLVHAQSILAVLGFQVILMGLVEGFRINGLDGVGDGNNLYPGGQYFDPLGLADDPVTFAELKVKEIKNGRLAMFSMFGFFVQAIVTGKGPLENLLDHLDNPVAKHAWVYATKVVP

SEQ ID NO: 7289 - protein, 254 aa, Actinidia deliciosa
MASTLLLGLTRGVSANPLRNVAAMSTSRYTMSNELWYGPDRVKYLGPFSAQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGYRINGIPGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7290 - protein, 249 aa, Flaveria ramosissima
FLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLEGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7291 - protein, 265 aa, Linum usitatissimum
MAASTVMAAAASGTSRLNLGQTGPVSNRLRNVKTMATSRFNMGSNLWYGPDRVKYLGPFSAQTPSYLTGEFPGDYGWDTAGLSADPEAFAKNRALEVIHGRWAMLGALGCITPEVLQKWVKVDFKEPVWFKAGAQIFSEGGLDYLGNPNLVHAQSILAVLGFQVVLMGLVEGFRINGLPGVGEGNDLYPGGQYFDPLGLAEDPVTFAELKVKEIKNGRLAMFSMFGFFVQAIVTGKGPLENLLDHLDNPVANNAWVYATKFVPGS

SEQ ID NO: 7292 - protein, 264 aa, Silene vulgaris
MATMLSSGNVLSPTPFLGQGKGSDRNALKDVVPMGSAKFTMGNDLWYGPDRVKYLGPFSAQTPSYLTGEFPGDYGWDTAGLSADPEAFARNRALEVIHGRWAMLGALGCITPEVLQKWIGVQFKEPVWFKAGAQIFSEGGLDYLGNPNLVHAQSILAVLGFQVILMGLVESFRINGIEGVGEGENLYPGGQYFDPLGLADGPVTFSELKVKEIKNGRLAMFSMFGFFVQAIVTGKGPLENLLDHLDNPVANNAWIFATKFVPGS

SEQ ID NO: 7293 - protein, 268 aa, Cycas rumphii
  misc_feature (149)..(149): Xaa can be any naturally occurring amino acid
  misc_feature (186)..(186): Xaa can be any naturally occurring amino acid
  misc_feature (194)..(194): Xaa can be any naturally occurring amino acid
  misc_feature (207)..(207): Xaa can be any naturally occurring amino acid
  misc_feature (237)..(237): Xaa can be any naturally occurring amino acid
MAATITTAASTSSISKSSFLRSSSVSKNALRNNVSLANTRSRITMGRDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLXNPNLIHAQSILAVLGFQVVLMGLVEGFRINGLPGVGXGGDLYPGXKYFDPLGLADDPXTFAELKVKEVKNGRLAMFSMFGFFVQAIVXGKGPLENLLDHLDNPVANNAWEYATKFVPGS

SEQ ID NO: 7294 - protein, 262 aa, Nicotiana tabacum
MAATGSSATVVRATPFLGQTKYANPLRDVVPMGSAKFTMSNELWYGPDCVKYLGPFSAQTPSYLTGEFPGDYGWDTASLLADPEAFAKNRALEVIHGRWAMLGALGCITPEVLEKWVKVDFKEPVWFKAGAQIFSEGGLDYLGNPNLVHAQSILAVLGFQVVLMGLVEGFRINGLPGVGDGNNLYPGGQYFDPLDLADDPTTFAELKVKEIKNGRLAMFSMFGFFVQAIVTGKGPLENLLDHLDNPVANNAWLYATKFVPGS

SEQ ID NO: 7295 - protein, 260 aa, Linum usitatissimum
MAAVAASGTSRLNLGQTGPVSNRLRNVKALATSRFNMGSNLWYGPDRVKYLGPFSAQTPSYLTGEFPGDYGWDTAGLSADPEAFAKNRALEVIHGRWAMLGALGCITPEVLQKWVKVDFKEPVWFKAGAQIFSEGGLDYLGNPNLVHAQSILAVLGFQVVLMGLVEGFRINGLPGVGEGNDLYPGGQYFDPLGLAEDPVTFAELKVKEIKNGRLAMFSMFGFFVQAIVTGKGPLENLLDHLDNPVANNAWVYATKFVPGS

SEQ ID NO: 7296 - protein, 265 aa, Utricularia gibba
MASMVAAASSTTAVKPSPFLGQTKNSNPLRFIVPMGSAKYTMGNDLWYGPDRVKFLGPFSAQTPSYLNGEFPGDYGWDTAGLSADPEAFAKNRALEVIHGRWAMLGALGSITPEVLQKWLNVDFKEPVWFKAGAQIFSEGGLDYLGNPNLVHAQSILAVLGVQVVLMGLVEGYRINGLEGVGEGNDLYPGGQYFDPLGLADDPVTLAELKVKEIKNGRLAMFSMFGFFVQAIVTGKGPLENLLDHLDNPVANNAWVYATKFAPGS

SEQ ID NO: 7297 - protein, 268 aa, Zingiber officinale
MAVATLTAASSRAATVVSTFLGQTRPSNGHSLRDFVPVGKGKFTMGNELWYGPDRVKYLGPFSAQTPSYLTGEFPGDYGWDTAGLSADPEAFAKNRALEVIHGRWAMLGAFGCITPEVLQKWLRVQLKEPVWFKAGSQIFSEGGLDYLGNPNLVHAQSILAVLGCQVILMGLVEGYRINGLPGVGEGDDLYPGGTYFDPLGLADDPVAFAELKVKEIKNGRLAMFSMFGFFVQAIVTGKGPLENLLDHLDNPVANNAWVYATKFAPGS

SEQ ID NO: 7298 - protein, 260 aa, Utricularia gibba
AAASSTTAVKPSPFLGQTKNSNPLRFIVPMGSAKYTMGNDLWYGPDRVKFLGPFSAQTPSYLTGEFPGDYGWDTAGLSADPEAFAKNRALEVIHGRWAMLGALGSITPEVLQKWLNVDFKEPVWFKAGAQIFSEGGLDYLGNPNLVHAQSILAVLGVQVVLMGLVEGYRINGLEGVGEGNDLYPGGQYFDPLGLADDPVTLAELKVKEIKNGRLAMFSMFGFFVQAIVTGKGPLENLLDHLDNPVANNAWVYATKFAPGS

SEQ ID NO: 7299 - protein, 197 aa, Flaveria ramosissima
AAASSTVVQATPFLGQTRPSSLNPLRDMVSMPSAKYTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILQSRSSPSMALLRGSVLTGLKGLEMVTICIRAGNTLTHWALRTTP

SEQ ID NO: 7300 - protein, 242 aa, Picea glauca
ANANSLRDVVPMGGGKFTMLNELWYGPDRVKYLGPFSAQTPSYLTGEFPGDYGWDTAGLSADPEAFAKNRALEVIHGRWAMLGALGCITPEVLEKWVKVDFKEPVWFKAGAQIFTEGGLDYLGNPNLVHAQSILAVLGFQVVLMGLVEGYRINGLDGVGEGNDLYPGGTYFDPLGLADDPVTFAELKVKEIKNGRLAMFSMFGFFVQAIVTGKGPLENLLDHLDNPVANNAWVYATKFAPGS

SEQ ID NO: 7301 - protein, 265 aa, Cleome gynandra
MASTFGSSSSVLRPTPFVSQSKVSNFNPLRDVVSLGSPKYIMSNDLWYGPNRVKYLGPFSVQTPSYLTGEFPGDYGWDTAGLSADPEAFAKNRALEVIHGRWAMLGALGCLTPEVLEKWVRVDFKEPIWFKAGAQIFSEGGLDYLGNPNLVHAQSILAVLAVQVVLMGLVEGFRINGLEGVGEGNELYPGGQYFDPLGLADDPVTFAELKVKEIKNGRLAMFSMFGFFVQAIVTGKGPLENLLDHLDNPVANNAWAFATKFVPGA

SEQ ID NO: 7302 - protein, 162 aa, Malus domestica
MLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDNPVANNAWVYATKFVPGS

SEQ ID NO: 7303 - protein, 175 aa, Distylium racemosum
MAATITAAAASTTPITKSSFLASSKSFSNAIRDNVFFVNSRPRYTMSSNNLWYGPDRVKYLGPFSAQTPSYLTGEFPGDYGWDTAGLSADPEAFARNRALEVIHGRWAMLGALGCITPEVLEKWVRVDFKEPVWFKAGAQIFFRGWFGLSGKPQSGPCSEHSCSVGIPGGSDGTC

SEQ ID NO: 7304 - protein, 269 aa, Sciadopitys verticillata
MAATITARAVSTTTITKSSFLAPSKGINSSFRDKVSFAFSAPRYLMSLDLWYGPDRVKYLGPFSAQTPSYLNGEFPGDYGWDTAGLSADPEAFARNRALEVIHGRWAMLGALGCITPEVLEKWVRVDFKEPVWFKAGAQIFTEGGLDYLGNPNLVHAQSILAVLGCQVVLMGLVEGFRINGLPGVGEGGDLYPGGKYFDPLGLADDPEAFAELKVKEVKNGRLAMFSMFGFFVQAIVTGKGPLENLLDHLDNPVANNAWEYATKFVPGA

SEQ ID NO: 7305 - protein, 246 aa, Gerbera hybrid cultivar
TRPSNQNSLRNVVVSVSNAKFTMGNDLWYGPDRVKYLGPFSAQTPSYLTGEFPGDYGWDTAGLSADPEAFAKNRALEVIHGRWAMLGALGCITPEVLEKWVKVDFKEPVWFKAGAQIFSEGGLDYLGNPNLVHAQSILAVLGFQVVLMGLVEGFRINGLDGVGDGNNLYPGGQYFDPLGLADDPVTFAELKVKEIKNGRLAMFSMFGFFVQAIVTGKGPLENLLDHLDNPVANNAWVYATKFVPGS

SEQ ID NO: 7306 - protein, 260 aa, Pteridium aquilinum
CLALELSLGQPILGQNRTSNANPLRDVVSTGTGKYTMGNDLWYGPDRVKYLGPFSAQTPSYLTGEFPGDYGRDTAGLSADPEAFARNRALEVTHGRWAMLGALGCITPEVLQKWLRVNFMEPVWFKAGAQIFSEGGLDYLGNPSLVHAQSILAVLGFQVVLMGLVEGFRINGLPGVGEGNDLYPGGRYFDPLGLADDPATFAELKVKEIKNGRLAMFSMFGFFVQAIVTGKGPLENLFDHLDNPVANNAWVYATKFVPGS

SEQ ID NO: 7307 - protein, 273 aa, Cephalotaxus harringtonia
MAATITAASTATITKSSFLGSSKGINNAFKNRVFFPTAKTITTAKRIYAMSNDLWYGPDRVKYLGPFSSQTPSYLTGEFPGDYGWDTAGLSADPEAFARNRALEVIHGRWAMLGALGCITPEVLEKWVKVDFKEPVWFKAGAQIFSEGGLDYLGNPNLVHAQSILAVLGFQVVLMGLVEGFRINGLPDVGEGGDLYPGGKYFDPLGLADDPETFAELKVKEVKNGRLAMFSMFGFFVQAIVTGKGPLENLLDHLDNPVANNAWEYATKFVPGS

SEQ ID NO: 7308 - protein, 254 aa, Fragaria vesca
MAAAASSSTLLRPNTNSLRDVVPMGPGKYTMGNELWYGPDRVKYLGPFSAQTPSYLTGEFPGDYGWDTAGLSADPEAFAKNRALEVIHGRWAMLGAFGCITPEVLEKWVRVDFKEPVWFKAGAQIFSEGGLDYLGNPNLVHAQSILAVLGSQVLLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFVPGS

SEQ ID NO: 7309 - protein, 267 aa, Sequoia sempervirens
MAAAITAGSTATITKSSFLASSKSFNNASRSRASFTIAKPIYAMSLDLWYGPDRVKYLGPFSAQTPSYLNGEFPGDYGWDTAGLSADPEAFARNRALEVIHGRWAMLGALGCITPEVLEKWLRVDFKEPVWFKAGAQIFSDGGLDYLGNPNLVHAQSILAVLGFQVILMGLVEGFRINGLPDVGEGGDLYPGGQYFDPLGLADDPDTFAELKVKEIKNGRLAMFSMFGFFVQAIVTGKGPLENLLDHLDNPVANNAWEYATKFVPGA

SEQ ID NO: 7310 - protein, 93 aa, Gossypium hirsutum
MASMLSSGTVLRPTPFLGQNRNANPLRDVVSVGTTKYTIGNELWYGPDRVKYLGPFSAQIPSYFNSEFPGDYGWELLVCQVTLRPLLGTGLLR

SEQ ID NO: 7311 - protein, 268 aa, Cryptomeria japonica
MAATITAGSTATITKSSFLAPSKTFNNAPRNRVSFTTIAKPIYATSNDLWYGPDRVKYLGPFSSQTPSYLNGEFPGDYGWDTAGLSADPEAFARNRALEVIHGRWAMLGALGCITPEVLEKWLRVDFKEPVWFKAGAQIFTEGGLDYLGNPNLVHAQSILAVLGFQVILMGLVEGFRINGLPDVGEGGDLYPGGKYFDPLGLADDPETFAELKVKEIKNGRLAMFSMFGFFVQAIVTGKGPLENLLDHLDNPVANNAWEYATKFVPGA

SEQ ID NO: 7312 - protein, 278 aa, Liriodendron tulipifera
  misc_feature (268)..(268): Xaa can be any naturally occurring amino acid
MAAMLTAASASSGTLRKSFLGQNKGASANPLRDVVSMGNGKFTMGNELWYGPDRVKYLGPFSAQTPSYLTGEFPGDYGWDTAGLSADPEAFARNRALEVIHGRWAMLGALGCITPEVLEKWVKVDFKEPVWFKAGAQIFTEGGLDYLGNPNLVHAQSILAVLGFQVVLMGLVEGYRINGLPGVGDGNDLYPGGTYFDPLGLADDPVTFAELKVKEIKNGRLAMFSMFGFFVQAIVTGKGPLENLLDHLANPVANNAWVYATKFVPGSXMSLGSSLPCF

SEQ ID NO: 7313 - protein, 224 aa, Eragrostis curvula
MSNDLWYGPDRVKYLGPFSAQTPSYLRGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGFRINGLDGVGEGNNLYPGGQYFDPLGLADDPVTFAELKVKEIKNGRLAMFSLFGFFVQAIVTGKGPLENLLDHLDDPVANNAWVYATKFAPGS

SEQ ID NO: 7314 - protein, 162 aa, Cucurbita pepo
MLGAFGCITPEVLEKWLKVDFKEPVWFKAGAQIFSEGGLDYLGNPNLVHAQSILAVLGFQVVLMGLVEGFRINGLDGVGEGNDLYPGGQYFDPLGLADDPVTFAELKVKEIKNGRLAMFSMFGFFVQAIVTGKGPLENLLDHLDNPVANNAWVYATKFAPGS

SEQ ID NO: 7315 - protein, 281 aa, Flaveria ramosissima
WAFDSKSYGDSIRSRRRLTSYHVLLDATPFLGQTRGSNVNALRDSVSMVNGKYTMGNDLWYGPDRVKYLGPFSAQTPSYLTGEFPGDYGWDTAGLSADPEAFAKNRALEVIHGRWAMLGAFGCITPEVLEKWVKVDFKEPVWFKAGAQIFSEGGLDYLGNPNLVHAQSILAVLGFQVVLMGLVEGFRINGLEGVGEGNNLYPGGQYFDPLGLADDPVTFAELKVKEIKNGRLAMFSMFGFFVQAIVTGKGPLENLLDHLDNPVANNAWVYATKFVPGSLIM

SEQ ID NO: 7316 - protein, 254 aa, Rosa hybrid cultivar
MAATASTSTLLRPNSNSLRDVVPMGPGKYTMGNELWYGPDRVKYLGPFSAQTPSYLTGEFPGDYGWDTAGLSADPEAFAKNRALEVIHGRWAMLGAFGCITPEVLEKWVRVDFKEPVWFKAGAQIFSEGGLDYLGNPNLVHAQSILAVLGSQVVLMGLVEGFRINGLDGVGEGNDLYPGGQYFDPLGLADDPVTFAELKVKEIKNGRLAMFAMFGFFVQAIVTGKGPLENVLDHLDNPVANNAWVYATKFVPGS

SEQ ID NO: 7317 - protein, 239 aa, Brassica juncea
NPLRDVVSLGSPKYTMGNDLWYGPDRVKYLGPFSVQTPSYLTGEFPGDYGWDTAGLSADPEAFAKNRALEVIHGRWAMLGAFGCITPEVLQKWVRVDFKEPVWFKAGSQIFSEGGLDYLGNPNLVHAQSILAVLGFQVILMGLVEGFRINGLDGVGEGNDLYPGGQYFDPLGLADDPVTFAELKVKEIKNGRLAMFSMFGFFVQAIVTGKGPLENLLDHLDNPVANNAWAFATKFVPGA

SEQ ID NO: 7318 - protein, 294 aa, Setaria italica
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGTRSFRVMKSFSQQAGIQGGLGAAFPSHATFPHYAIPQGLPYHVYGYSPYTPDYSYPTNFYNIYGGAQYPFYGGAAAGMVTGTSPFYPYFQFGQSGNTTTNYTSGQGYNLQYPQMFHFSTVSSTAAAVTGFAQQFGGPLSLAASPQAQAGMTMALTAPTLPTPTQAAHPYRLIPSHFAVSAAPEQPLA

SEQ ID NO: 7319 - protein, 294 aa, Panicum virgatum
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARSFRVMKSFSQQAGIQGGLGAAFPSHATFPHYTIPQGLPYHVYGYSPYTPDYGYPTNFYNIYGGAQYPFYGGAAAGMVTGTSPFYPYFQFGQSGNTTTNYTSGQGYNLQYPQMFHFSTVSSTAAAVTGFAPQFGGPLSLAVSPQAQAGMTMALTAPTLPTPTQAAHPYRLIPSHFAVSAAPEQPLA

SEQ ID NO: 7320 - protein, 293 aa, Pennisetum glaucum
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGTRTFRVMKSFSQQGGIQGGLGATFPSHATFPHYAIPQGLPYHVYGYSPYTPDYGYPTNFYNIYGAQYPFYGGAAAGMVTGTSPFYPYFQFGQSGNATTNYTSGQGYNLQYPQMFQFSTVSSTAAAVTGFAQQFGGPLSLAASPQAQAGMTMALTAPTLPTPTQAAHPYRLIPSHFAVSAAPEQPLA

SEQ ID NO: 7321 - protein, 290 aa, Zea mays
MSPPSVMGQFGDTTYTKVFVGGLAWETQKETMRKYFEQFGEILEAVVITDKNTGRSKGYGFVTFRDSDAAMRACVDPAPVIDGRRANCNLASLGVQRSRPPTPQHGGARNFKVMKSFSQQAGIQGGLGAAFPSHATFPHYAIPQGLPYHIYGYSPYTLDYGYPTNFYNIYGGPQYTFYGGGAGMVTGTSPFYPYFQFGQSGNTTTNYTSGQGYNLQYPQMFHFSTVSSTAAAVNGFAQQYGGPLSLAASPQAQAGMTMALAAPTMPTPTQAAHPYRLIPSVSTAPEQPLA

SEQ ID NO: 7322 - protein, 300 aa, Oryza sativa
MSPPSVIGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARSFRVMKSFSQQAGIQGGLGAAFPSHATFPHYAIPQGLPYHVYGYSPYSPDYSYPTNYYNIYGGAQYPFYGAAAAAAAAAAGMVTGSSPFYPYFQFGQSGSTTTNYASGQGYNLQYPQMFHFSTVASTAAAVTGFAQQYGGPLSLAASPQAQAGMTMALTAPTLPTPTQAAHPYRLIPSHFAVSAAPEQPLA

SEQ ID NO: 7323 - protein, 293 aa, Brachypodium distachyon
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVKSFSQQAGIQGGLGAAFPSQATFPHYAIPQGLPYHVYGYSPYSPDYGYPTNYYNIYGGTQYPFYGGAGAGMVTGTSPFYPYFQFGQSGSTTTNYGNGQGYNMQYPQMFQFSTVASTPAAVTGFAPQYGGPLSLAASPQAQAGMTMALTAPTLPSPTPAAHPYRLITSHFAVSAAPEQSLA

SEQ ID NO: 7324 - protein, 296 aa, Secale cereale
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTNPFYPYFQFGQSGSTTPNYASGQGYNMQFPQMFPFSTVASTAAAVTGFAQQYGGPLSLAASPQAQAGMTMALTAPTLPSPTQAAHPYRLVPSHFAVSAAPEQSLA

SEQ ID NO: 7325 - protein, 264 aa, Secale cereale
MRKYFEQFGEILEAVVITDKNTGRSKGYGFVPSDPDAAMRSCVDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTNPFYPYFQFGQSGSTTPNYASGQGYNMQFPQMFPFSTVASTAAAVTGFAQQYGGPLSLAASPQAQAGMTMALTAPTLPSPTQAAHPYRLVPSHFAVSAAPEQSLA

SEQ ID NO: 7326 - protein, 334 aa, Secale cereale
MSPPSVMGQFGDTTYTKVFVGGLAWETQKETMRKYFEQFGEILEAVVITDKNTGRSKGYGFVTFRDPDAAMRSCIDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTNPFYPYFQFGQSGSTTPNYASGQGYNMQFPQMFPFSTVASTAAAVTGFAQQYGGPLSLAASPQAQAVCIPLNRHDYGSHSTNLAKSNSGCSSLPARPLALCCVCCSRAILGLTMVSILIVTVSFYSYVLVHASISNTKGCHQC

SEQ ID NO: 7327 - protein, 265 aa, Hordeum vulgare
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVMKSFGQQQAAGIQGALGAAFPSQATFPHYAIPQGLPYHVYGYSPYSPDYGFPANYYNIYGGNQYPFYGGAGTGMVTGTSPFYPYFQFGQSGSTTPNYATGQGYNMQYPQMFPFSTVASTAAAVTGFAQQYGGPLSLAASPQAQAVCIPIKQA

SEQ ID NO: 7328 - protein, 265 aa, Secale cereale
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTNPFYPYFQFGQSGSTTPNYASGQGYNMQFPQMFPFSTVASTAAAVTGFAQQYGGPLSLAASPQAQAVCIPIKQA

SEQ ID NO: 7329 - protein, 265 aa, Triticum aestivum
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTSPFYPYFQFGQSGSTTPNYATGQGYNMQFPQMFPFSTVASTAAAVTGFAQQYGGPLSLAASPQAQAVCIPIKQA

SEQ ID NO: 7330 - protein, 107 aa, Secale cereale
MSPPSVMGQFGDTTYTKVFVGGLAWETQKETMRKYFEQFGEILEAVVITDKNTGRSKGYGLYLPGPGCGHEVLRRPRAGDRREEGQLQPGIPWGAEIQASNPAARRS

SEQ ID NO: 7331 - protein, 265 aa, Triticum aestivum
MSPPSVMGQFGDTTYTKVFVGGLAWETQKETMRKYFEQFGEILEAVVITDKNTGRSKGYGFVTFRDPESAMRSCVDPAPVIDGRRANCNLASLGVQRSRPPTPQHGGARSFRVMKSFGQQQAAGIQGALGAAFPSQATFPHYAIPQGLPYHVYGYSPYSPDYGYPANYYNIYGGNQYPFYGGAGTGMVTGTSPFYPYFQFGQSGSTTPNYATGQGYNMQFPQMFPFSTVASTAAAVTGFAQQYGGPLSLAASPQAQAVCIPIKQA

SEQ ID NO: 7332 - protein, 262 aa, Sorghum bicolor
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFSQQAGIQGGLGAAFPSHATFPHYAIPQGLPYHVYGYSPYTPDGYPTNFYSIYGGAQYPFYGGAAAGMVTGTSPFYPYFQFGQSGNTTTNYTSGQGYNLQYPQMFQFSTVSSTAAAVTGFAQQYGGPLSLAASPQAQAVCIPIKQA

SEQ ID NO: 7333 - protein, 263 aa, Panicum virgatum
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGSRSFRVMKSFSQQAGIQGGLGAAFPSHATFPHYAIPQGLPYHVYGYSPYTPDYGYPTNFYNIYGGAQYPFYGGGAAGMVTGTSPFYPYFQFGQSGNTTTNYTSGQGYNLQYPHMFHFSTVSSTAAAVTGFAQQFGGPLSLAASPQAQAVCVPIKQA

SEQ ID NO: 7334 - protein, 200 aa, Saccharum officinarum
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFSQQAGIQGGLGAAFPSHATFPHYAIPQGLPYHVYGYSPYTPDYGYPTNFYNIYGGAQYPFYGGAATGMVTGTSPFYPYFQFGQ

SEQ ID NO: 7335 - protein, 262 aa, Brachypodium distachyon
MSPPSVMGQFGDTTYTKVFVGGLAWETQKETMRKYFEQFGEILEAVVITDKNTGRSKGYGFVTFRDPDAAMRSCVDPAPVIDGRRANCNLASLGVQRSRPPTPQHGGARSFRVKSFSQQAGIQGGLGAAFPSQATFPHYAIPQGLPYHVYGYSPYSPDYGYPTNYYNIYGGTQYPFYGGAGAGMVTGTSPFYPYFQFGQSGSTTTNYGNGQGYNMQYPQMFQFSTVASTPAAVTGFAPQYGGPLSLAASPQAQAVCIPIKQA

SEQ ID NO: 7336 - protein, 80 aa, Unknown
  Sequence found in Organisms: Setaria italica, Saccharum officinarum, Panicum virgatum
MSRSGQPPDLKKYMDKKLQIKLNANRVVIGTLRGFDQFMNLVVDNTVEVNGNDKTDIGMVVIRGNSVVMIEALEPVAKSQ

SEQ ID NO: 7337 - protein, 81 aa, Unknown
  Sequence found in Organisms: Sorghum bicolor, Triticum aestivum
MSRSGQPPDLKKYMDKKLQIKLNANRVVIGTLRGFDQFMNLVVDNTVEVNGNDKTDIGMVVIRGNSVVMIEALEPVAKSQQ

SEQ ID NO: 7338 - protein, 80 aa, Cynodon dactylon
MSRSGQPPDLKKYMDKKLHIKLNANRVVIGTLRGFDQFMNLVVDNTVEVNGNDKTDIGMVVIRGNSVVMIEALEPVAKSQ

SEQ ID NO: 7339 - protein, 80 aa, Eragrostis curvula
MSRSGQPPDLKKYMDKKLQIKLNANRVVVGTLRGFDQFMNLVVDNTVEVNGNDKTDIGMVVIRGNSVVMIEALEPVAKSQ

SEQ ID NO: 7340 - protein, 80 aa, Unknown
  Sequence found in Organisms: Zea mays, Pennisetum glaucum
MSRSGQPPDLKKYMDKKLQIKLNANRVVIGTLRGFDQFMNLVIDNTVEVNGNDKTDIGMVVIRGNSVVMIEALEPVAKSQ

SEQ ID NO: 7341 - protein, 80 aa, Panicum virgatum
MSRSGQPPDLKKYMDKKLQIKLNANRVVIGTLRGFDQFMNLVVDNTVEVNGNDKNDIGMVVIRGNSVVMIEALEPVAKAQ

SEQ ID NO: 7342 - protein, 80 aa, Unknown
  Sequence found in Organisms: Hordeum vulgare, Secale cereale, Triticum aestivum
MSRSGQPPDLKKYMDKKLQIKLNANRVVIGTLRGFDQFMNLVVDNTVEVNGDEKTDIGMVVLRGNSVVMIEALEPIARSQ

SEQ ID NO: 7343 - protein, 81 aa, Brachypodium distachyon
MSRSGQPPDLKKYMDKKLQIKMNANRVVIGTLRGFDQFMNLVVDNTVEVNGNEKTDIGMVVVRGNSVVMIEALEPIAKSQQ

SEQ ID NO: 7344 - protein, 80 aa, Cynodon dactylon
MSRSGQPPDLKKYMDKKLQIKLNANRVVIGTLRGFDQFMNLVVDNTVEVNGNEKNDIGMVVIRGNSVVMIEALEPVAKAQ

SEQ ID NO: 7345 - protein, 81 aa, Unknown
  Sequence found in Organisms: Pennisetum glaucum, Setaria italica
MSRSGQPPDLKKYMDKKLQIKLNANRVVIGTLRGFDQFMNLVVDNTVEVNGNDKNDIGMVVIRGNSVVMIEALEPVAKAAQ

SEQ ID NO: 7346 - protein, 81 aa, Avena sativa
MSRSGQPPDLKKYMDKKLQIKMNANRVVIGTLRGFDQFMNLVVDNTVEVNGDEKTDIGMVVVRGNSVVMIEALEPIAKSQQ

SEQ ID NO: 7347 - protein, 79 aa, Musa acuminata
MSRSGQPPDLKKYMDKKLQIKLNANRVVVGTLRGFDQFMNLVVDNTVEVNGNEKNDIGMVVIRGNSVVMIEALEPVART

SEQ ID NO: 7348 - protein, 66 aa, Fagus grandifolia
MDKKLQIKMNANRMVIGTLRGFDQFMNLVVDNTVEVNGNEKTDIGMVVIRGNSVVTVEALEPVNRS

SEQ ID NO: 7349 - protein, 80 aa, Allium cepa
MSRSGQPPDLKKYMDKKLQIKLNANRVVIGTLRGFDQFMNLVIDNTVEVNGNDKNDIGMVVLRGNSVVMIEALEPVNRTQ

SEQ ID NO: 7350 - protein, 61 aa, Secale cereale
MSRSGQPPDLKKYMDKKLQIKLNANRVVIGTLRGFDQFMNLVVDNTVESMEMRRPTSGWWF

SEQ ID NO: 7351 - protein, 80 aa, Secale cereale
MSRSGQPPDLKKYMDKKLQIKLNANRVVIGTLRGFDQFMNLVVDNTVEVNGDEKTDIGMGVLRGNSVVMIEALEPIARSQ

SEQ ID NO: 7352 - protein, 62 aa, Secale cereale
MSRSGQPPDLKKYMDKKLQIKLNANRVVIGTLRGFDQFMNLVVDNTVEVNGDEKTDSRDGWF

SEQ ID NO: 7353 - protein, 80 aa, Brachypodium distachyon
MSRSGQPPDLKKYMDKKLQIKLNANRVVIGTLRGFDQFMNLVVDNTVEVNGNDRNDIGMVVLRGNSVVMIEALEPIAKSQ

SEQ ID NO: 7354 - protein, 80 aa, Leymus cinereus x Leymus triticoides
MSRSGQPPDLKKYMDKKLQIKLNANRVVIGTLRGFDQFMNLVVDNTLEVNGDEKTDIGMVVLRGNSVVMIEALEPIARSQ

SEQ ID NO: 7355 - protein, 80 aa, Oryza sativa
MSRSGQPPDLKKYMDKKLQIKLNANRVIVGTLRGFDQFMNLVVDNTVEVNGNDKTDIGMVVVRGNSVVMIEALEPVPKSQ

SEQ ID NO: 7356 - protein, 80 aa, Oryza sativa
MSRSGQPPDLKKYMDKKLQIKLNANRVVIGTLRGFDQFMNLVVDNTVEVNGNEKNDIGMVVIRGNSVVMIEALEPVPKPQ

SEQ ID NO: 7357 - protein, 80 aa, Unknown
  Sequence found in Organisms: Sorghum bicolor, Saccharum officinarum
MSRSGQPPDLKKYMDKKLQIKLNANRVVIGTLRGFDQFMNLVIDNTVEVNGNEKNDIGMVVIRGNSVVMIEALEPVAKAQ

SEQ ID NO: 7358 - protein, 67 aa, Citrullus lanatus
MDKKLQIKLNANRLVIGTLRGFDQFMNLVVDNTVEVNGNEKTDIGMVVIRGNSVVTVEALEPVNRMQ

SEQ ID NO: 7359 - protein, 80 aa, Unknown
  Sequence found in Organisms: Cucumis sativus, Cucumis melo, Citrullus lanatus
MSRSGQPPDLKKYMDKKLQIKLNANRLVIGTLRGFDQFMNLVVDNTVEVNGNEKTDIGMVVIRGNSVVTVEALEPVNRMQ

SEQ ID NO: 7360 - protein, 79 aa, Unknown
  Sequence found in Organisms: Castanea mollissima, Quercus alba
MSRSGQPPDLKKYMDKKLQIKMNANRMVVGTLRGFDQFMNLVVDNTVEVNGNEKTDIGMVVIRGNSVVTVEALEPVNRS

SEQ ID NO: 7361 - protein, 80 aa, Cucurbita pepo
MSRSGQPPDLKKYMDKKLQIKMNANRLVVGTLRGFDQFMNLVVDNTVEVNGNEKTDIGMVVIRGNSVVTVEALEPVNRMQ

SEQ ID NO: 7362 - protein, 79 aa, Ipomoea nil
MSRSGQPPDLKKYMDKKLQIKMNANRMVVGTLRGFDQFMNLVIDNTVEVNGNEKNDIGMVVIRGNSVVTIEALEPVARS

SEQ ID NO: 7363 - protein, 80 aa, Momordica charantia
MSRSGQPPDLKKYMDKKLQIKLNANRLVIGTLRGFDQFMNLVVDNTVEVNGNEKTDIGMVVIRGNSVVTVEALEPVNRTQ

SEQ ID NO: 7364 - protein, 80 aa, Unknown
  Sequence found in Organisms: Mimulus guttatus, Lippia dulcis
MSRSGQPPDLKKYMDKKLQIKLNANRMVVGTLRGFDQFMNLVVDNTVEVNGNEKTDIGMVVIRGNSVVTVEALEPVARAQ

SEQ ID NO: 7365 - protein, 80 aa, Vinca minor
MSRSGQPPDLKKYMDKKLQIKLNANRMVVGTLRGFDQFMNLVVDNTVEVNGNEKTDIGMVVIRGNSVVTVEALEPVARTQ

SEQ ID NO: 7366 - protein, 79 aa, Musa acuminata
MSRSGQPPDLKKYMDKKLQIKLNANRVVVGTLRGFDQFMNLVVDNTVEVNGNEQNDIGMVVIRGNSVAMIEALEPVART

SEQ ID NO: 7367 - protein, 79 aa, Musa acuminata
MSRSGQPPDLKKYMDKKLQIKLNGNRVVVGTLRGFDQFMNLVVDNTVEVNSNEKNDIGMVVIRGNSVVMIEALEPVART

SEQ ID NO: 7368 - protein, 80 aa, Unknown
  Sequence found in Organisms: Gossypium hirsutum, Gossypium raimondii, Heritiera littoralis
MSRSGQPPDLKKYMDKKLQIKLNANRMVVGTLRGFDQFMNLVVDNTVEVNGNEKTDIGMVVIRGNSVVTVEALEPVGRMQ

SEQ ID NO: 7369 - protein, 80 aa, Unknown
  Sequence found in Organisms: Gossypium hirsutum, Gossypium raimondii
MSRSGQPPDLKKYMDKKLQIKLNANRLVVGTLRGFDQFMNLVVDNTVEVNGNEKTDIGMVVIRGNSVVTVEALEPVGRMQ

SEQ ID NO: 7370 - protein, 80 aa, Eschscholzia californica
MSRSGQPPDLKKYMDKQLQIKLNANRVVVGTLRGFDQFMNLVVDNTVEMNGNEKNDIGMVVIRGNSVVMIEALEPVPRAQ

SEQ ID NO: 7371 - protein, 80 aa, Elaeis guineensis
MSRSGQPPDLKKYMDKKLQIKLNANRVVVGTLRGFDQFMNLVIDNTVEVNGNEKNDIGMVVIRGNSVVMIEALEPVSKTQ

SEQ ID NO: 7372 - protein, 79 aa, Elaeis guineensis
MSRSGQPPDLKKYMDKKLQIKLNANRVVVGTLRGFDQFMNLVVDNTVEVIGNEKNDIGMVVIRGNSVVMIEALEPVGRT

SEQ ID NO: 7373 - protein, 80 aa, Papaver somniferum
MSRSGQPPDLKKYMDKQLQIKLNANRVVVGTLRGFDQFMNLVVDNTVEMNGNDKNDIGMVVIRGNSVVMIEALEPVSKAQ

SEQ ID NO: 7374 - protein, 80 aa, Unknown
  Sequence found in Organisms: Thellungiella halophila, Eutrema halophilum
MSRSGQPPDLKKYMDKKLQIKLNANRMVVGTLRGFDQFMNLVVDNTVEVNGNDKTDIGMVVIRGNSIVTVEALEPVGRSS

SEQ ID NO: 7375 - protein, 80 aa, Antirrhinum majus
MSRSGQPPDLKKYMDKKLQIKLNANRMVVGTLRGFDQFMNLVIDNTVEVNGNEKTDIGMVVIRGNSVVTVEALEPVARPQ

SEQ ID NO: 7376 - protein, 80 aa, Unknown
  Sequence found in Organisms: Arabidopsis thaliana, Arabidopsis lyrata
MSRSGQPPDLKKYMDKKLQIKLNANRMVTGTLRGFDQFMNLVVDNTVEVNGNDKTDIGMVVIRGNSIVTVEALEPVGRSS

SEQ ID NO: 7377 - protein, 79 aa, Musa acuminata
MSRSGQPPDLKKYMDKKLQIKLNANRVVVGTLRGFDQFMNLVIDNTVEVNGNEKNDIGMVVIRGNSVAMIEALEPVART

SEQ ID NO: 7378 - protein, 80 aa, Vitis vinifera
MSRSGQPPDLKKYMDKKLQIKLNANRMVVGTLRGFDQFMNLVVDNTVEVNGNEKTDIGMVVIRGNSVVTVEALEPVSRMQ

SEQ ID NO: 7379 - protein, 79 aa, Ipomoea batatas
MSRSGQPPDLKKYMDKKLQIKLNANRMVVGTLRGFDQFMNLVIDNTVEVNGNEKNDIGMVVIRGNSVVTIEALEPVARS

SEQ ID NO: 7380 - protein, 80 aa, Actinidia deliciosa
MSRSGQPPDLKKYMDKQLQIKLNANRMVVGTLRGFDQFMNLVVDNTVEVNGNDKTDIGMVVIRGNSVVTVEALEPVSRTQ

SEQ ID NO: 7381 - protein, 80 aa, Avena sativa
MSRSGQPPDLKKYMDKKLQIKLNANRVVIGTLRGFDQFMNLVVDNTVEVNGDERNDIGMVVLRGNSVVMIEALEPIAKSQ

SEQ ID NO: 7382 - protein, 80 aa, Lippia dulcis
MSRSGQPPDLKKYMDKKLQIKLNANRMVVGTLRGFDQFMNLVVDNTVEVNGDEKTDIGMVVIRGNSVVTVEALEPVARAQ

SEQ ID NO: 7383 - protein, 80 aa, Ananas comosus
MSRSGQPPDLKKYMDKKLQIKLNANRVVVGALRGFDQFMNLVIDNTVEVNGNEKNEIGMVVIRGNSVVMIEALEPVARTQ

SEQ ID NO: 7384 - protein, 80 aa, Primula obconica
MSRSGQPPDLKKYMDKKLQIKLNANRTVVGTLRGFDQFMNLVIDNTVEVNGNDKTDIGMVVIRGNSVVTVEALEPVPRTQ

SEQ ID NO: 7385 - protein, 79 aa, Raphanus sativus
MSRSGQPPDLKKYMDKKLQIKLNANRMVIGTLRGFDQFMNLVVDNTVEVNGDDKTDIGMVVIRGNSIVTVEALEPVGRS

SEQ ID NO: 7386 - protein, 80 aa, Salvia sclarea
MSRSGQPPDLKKYMDKKLQIKLNANRMVVGTLRGFDQFMNLVVDNTVEVNGNEKTDIGMVVIRGNSVVTVEALEPVSRAQ

SEQ ID NO: 7387 - protein, 80 aa, Tabernaemontana elegans
MSRSGQPPDLKKYMDKKLQIKLNANRMVVGTLRGFDQFMNLVVDNTVEVNGNEKTDIGMVVIRGNSVVTVEALEPVGRTQ

SEQ ID NO: 7388 - protein, 81 aa, Papaver somniferum
MSRSGQPPDLKKYMDKQLQIKLNANRVVVGTLRGFDQFMNLVVDNTVEMNGNDKNDIGMVVIRGNSVVMIEALEPVSKAQQ

SEQ ID NO: 7389 - protein, 81 aa, Zostera marina
MSRSGQPPDLKKYMDKKLQIKLNANRVVVGTLRGFDQFMNLVVDNTEEINGNEKNNIGMVVIRGNSVVMIEALEPVQRSQQ

SEQ ID NO: 7390 - protein, 79 aa, Unknown
  Sequence found in Organisms: Brassica napus, Brassica rapa
MSRSGQPPDLKKYMDKKLQIKLNANRTVVGTLRGFDQFMNLVVDNTVEVNGDDKTDIGMVVIRGNSIVTVEALEPVGRS

SEQ ID NO: 7391 - protein, 79 aa, Unknown
  Sequence found in Organisms: Arabidopsis thaliana, Brassica napus, Arabidopsis lyrata, Brassica juncea, Brassica oleracea, Brassica rapa, Raphanus sativus
MSRSGQPPDLKKYMDKKLQIKLNANRMVVGTLRGFDQFMNLVVDNTVEVNGDDKTDIGMVVIRGNSIVTVEALEPVGRS

SEQ ID NO: 7392 - protein, 80 aa, Unknown
  Sequence found in Organisms: Brassica napus, Brassica juncea, Brassica oleracea, Brassica rapa, Raphanus sativus, Eutrema parvulum
MSRSGQPPDLKKYMDKKLQIKLNANRMVVGTLRGFDQFMNLVVDNTVEVNGDDKTDIGMVVIRGNSIVTVEALEPVGRSS

SEQ ID NO: 7393 - protein, 80 aa, Cannabis sativa
MSRSGQPPDLKKYMDKKLQIKLNANRMVVGTLRGFDQFMNLVVDNTVEVNGNENNDIGMVVIRGNSVVTVEALEPVARAQ

SEQ ID NO: 7394 - protein, 80 aa, Unknown
  Sequence found in Organisms: Gossypium hirsutum, Gossypium raimondii
MSRSGQPPDLKKYMDKQLQIKLNANRMVVGTLRGFDQFMNLVVDNTVEVNGNEKTDIGMVVIRGNSVVTVEALEPVGRMQ

SEQ ID NO: 7395 - protein, 79 aa, Elaeis guineensis
MSRSGQPPDLKKYMDKKLQIKLNANRVVVGTLRGFDQFMNLVVDNTVEVNGSEKNDIGMVVIRGNSVVMIEALEPVSKT

SEQ ID NO: 7396 - protein, 80 aa, Unknown
  Sequence found in Organisms: Mimulus guttatus, Plantago ovata
MSRSGQPPDLKKYMDKKLQIKLNANRMVVGTLRGFDQFMNLVIDNTVEVNGNEKTDIGMVVIRGNSVVTVEALEPVQRAQ

SEQ ID NO: 7397 - protein, 80 aa, Gossypium hirsutum
MSRSGQPPDLKKYMDKKLQIKLNANRMVVGTLRGFDQFMNLVVDNTVEVNGNEKTDIGMVVIRGNCVVTVEALEPVGRMQ

SEQ ID NO: 7398 - protein, 80 aa, Amsonia hubrichtii
MSRSGQPPDLKKYMDKKLQIKLNANRMVVGTLRGFDQFMNLVVDNTVEVNGNEKNDIGMVVIRGNSVVTVEALEPVGRTQ

SEQ ID NO: 7399 - protein, 80 aa, Antirrhinum majus
MSRSGQPPDLKKYMDKKLQIKLNANRMVVGTLRGFDQFMNLVIDNTVEVNGNEKTDIGMVVIRGNSVVTVEALEPVPRPQ

SEQ ID NO: 7400 - protein, 80 aa, Aristolochia fimbriata
MSRSGQPPDLKKYMDKKLQIKLNANRVVVGTLRGFDQFMNLVIDNTLEINGNEKNDIGMVVIRGNSVVMIEALEPVGRTQ

SEQ ID NO: 7401 - protein, 80 aa, Ricinus communis
MSRSGQPPDLKKYMDKKLQIKLNANRMVVGTLRGFDQFMNLVVDNTVEVNGDEKTDIGMVVIRGNSVVTVEALEPVNRMQ

SEQ ID NO: 7402 - protein, 80 aa, Coffea canephora
MSRSGQPPDLKKYMDKKLQIKLNANRMVVGTLRGFDQFMNLVVDDTVEVNGNDKIKIGMVVIRGNSVVTVEALEPVARAQ

SEQ ID NO: 7403 - protein, 80 aa, Nicotiana benthamiana
MSRSGQPPDLKKYMDKQLQIKLNANRLVVGTLRGFDQFMNLVIDNTVEVNGNDKNEIGMVVIRGNSVVTIEALEPVARAQ

SEQ ID NO: 7404 - protein, 80 aa, Carica papaya
MSRSGQPPDLKKYMDKKLQIKLNANRMIVGTLRGFDQFMNLVVDNTVEVNGNEKTDIGMVVIRGNSVVTVEALEPVSRAQ

SEQ ID NO: 7405 - protein, 80 aa, Lippia dulcis
MSRSGQPPDLKKYMDKKLQIKLNANRMVVGTLRGFDQFMNLVVDNTVEVNGNEKSDIGMVVIRGNSVVTVEALEPVSRAQ

SEQ ID NO: 7406 - protein, 80 aa, Unknown
  Sequence found in Organisms: Solanum lycopersicum, Solanum tuberosum, Solanum phureja
MSRSGQPPDLKKYMDKQLQIKLNANRQVVGTLRGFDQFMNLVIDNTVEVNGNDKNEIGMVVIRGNSVVTIEALEPVARPQ

SEQ ID NO: 7407 - protein, 80 aa, Rosa hybrid cultivar
MSRSGQPPDLKKYMDKKLQIKLNANRMIIGTLRGFDQFMNLVVDNTVEVNGDEKTDIGMVVIRGNSVVTVEALEPVAKMQ

SEQ ID NO: 7408 - protein, 79 aa, Salvia sclarea
SRSGQPPDLKKYMDKKLQIKLNANRMVVGTLRGFDQFMNLVVDNTVEVNGNEKTDIGMVVIRGNSVVTVEALEPVSRAQ

SEQ ID NO: 7409 - protein, 80 aa, Sarracenia psittacina
MSRSGQPPDLKKYMDKQLQIKLNANRMVVGTLRGFDQFMNLVVDNTVEVNGNEKTDIGMVVIRGNSVVTVEALEPVSRTQ

SEQ ID NO: 7410 - protein, 105 aa, Elaeis guineensis
MSRSGQPPDLKKYMDKKLQIKLNANRVVVGTLRGFDQFMNLVIDNTVEVNGNEKNDIGMVVIEGEQCSHDRSSGASQTKRSSCPLLVVSLFETKWLYKYSWFMYY

SEQ ID NO: 7411 - protein, 150 aa, Brassica rapa
MLAESEKTMEKEKRLGFFSAQLSSERTRKGIDIYFENVGGKMLDAVLINMKLNGRIAVCGMISQYNLVDPEGVHNLTTILYKRIKVQGFAVSDFYDKYSKFLDFVLPYIRQGKITYVEDITEGLESGPSALLGLFHGKNVGKQLFVVARE

SEQ ID NO: 7412 - protein, 67 aa, Vinca minor
MDKKLQIKLNANRMVVGTLRGFDQFMNLVVDNTVEVNGNEKTDIGMVVIRGNSVVTVEALEPVGRTQ

SEQ ID NO: 7413 - protein, 81 aa, Papaver somniferum
MSRSGQPPDLKKYMDKQLQIKLNANRVVVGTLRGFDQFMNLVVDNTVEMNGSDKNDIGMVVIRGNSVVMIEALEPVSKAQQ

SEQ ID NO: 7414 - protein, 81 aa, Solanum tuberosum
MSRSGQPPDLKKYMDKQLQIKLNANRLVTGTLRGFDQFMNLVIDNTVEINGNDKNEIGMVVIRGNSVVTIEALEPVARSQQ

SEQ ID NO: 7415 - protein, 81 aa, Prunus persica
MSRSGQPPDLKKYMDKKLQIKLNANRMVIGTLRGFDQFMNLVVDNTVEVNGNEKNDIGMVVIRGNSVVTVEALEPVAKNMQ

SEQ ID NO: 7416 - protein, 81 aa, Solanum lycopersicum
MSRSGQPPDLKKYMDKQLQIKLNANRLVTGTLRGFDQFMNLVIDNTVEVNGNDKNEIGMVVIRGNSVVTIEALEPVARPQQ

SEQ ID NO: 7417 - protein, 79 aa, Brassica juncea
MSRSGQPPDLKKYMDKKLQIKLNANRMVVGTLRGFDQFMNLVVDNTVEVNGDEKTDIGMVVIRGNSIVTVEALEPVGRS

SEQ ID NO: 7418 - protein, 80 aa, Cicer arietinum
MSRSGQPPDLKKYMDKQLQIKLNANRMIVGTLRGFDQFMNLVVDNTVEVNGNDKTDIGMVVIRGNSVVTVEALEPVNRTS

SEQ ID NO: 7419 - protein, 80 aa, Carpinus betulus
MSRSGQPPDLKKYMDKKLQIKLNANRMVVGTLRGFDQFMNLVVDNTVEVNGNERNDIGMVVIRGNSVVTVEALEPVNRSS

SEQ ID NO: 7420 - protein, 79 aa, Eutrema halophilum
MSRSGQPPDLKKYMDKKLQIKLNANRMVVGTLRGFDQFMNLVVDNTVEVNGDVKTDIGMVVIRGNSIVTVEALEPVGRS

SEQ ID NO: 7421 - protein, 79 aa, Brassica juncea
MSRSGQPPDLKKYMDKKLQIKLNANRMVVGTLRGFDQFMNLVVDNTVEVNGDDKTEIGMVVIRGNSIVTVEALEPVGRS

SEQ ID NO: 7422 - protein, 80 aa, Amorphophallus konjac
MSRSGQPPDLKKYMDKKLQIKLNANRAIVGTLRGFDQFMNLVIDNTVEVNGNERNDIGMVVIRGNSVVMIEALEPVSRAQ

SEQ ID NO: 7423 - protein, 80 aa, Malus domestica
MSRSGQPPDLKKYMDKKLQIKLNANRMVVGTLRGFDQFMNLVVDNTVEVNGNEKNEIGMVVIRGNSVVTVEALEPVAKMQ

SEQ ID NO: 7424 - protein, 80 aa, Malus domestica
MSRSGQPPDLKKYMDKKLQIKMNANRMVVGTLRGFDQFMNLVVDNTVEVNGDEKNEIGMVVIRGNSVVTVEALEPVAKMQ

SEQ ID NO: 7425 - protein, 79 aa, Unknown
  Sequence found in Organisms: Phaseolus coccineus, Vigna unguiculata
MSRSGQPPDLKKYMDKKLQIKLNANRMIVGTLRGFDQFMNLVVDNTVEVNGNEKTDIGMVVIRGNSVVTVEALEPVNRT

SEQ ID NO: 7426 - protein, 80 aa, Theobroma cacao
MSRSGQPPDLKKYMDKKLQIKLNANRMVVGTLRGFDQFMNLVVDNTVEVNGNERTDIGMVVIRGNSVVTVEALEPVGKMQ

SEQ ID NO: 7427 - protein, 80 aa, Cedrus atlantica
MSRSGQPPDLKKYMDKKLNIKLNANRVVVGTLRGFDQFMNLVLDGTVEVNGNDRNEIGMVVIRGNSVVMIEALEPVNRSS

SEQ ID NO: 7428 - protein, 79 aa, Cleome gynandra
MSRSGQPPDLKKYMDKKLQIKLNANRMIVGTLRGFDQFMNLVVDNTVEVNGNERTDIGMVVIRGNSVVTVEALEPVGRS

SEQ ID NO: 7429 - protein, 80 aa, Unknown
  Sequence found in Organisms: Solanum melongena, Capsicum annuum
MSRSGQPPDLKKYMDKQLQIKLNANRLVTGTLRGFDQFMNLVIDNTVEVNGNEKNEIGMVVIRGNSVVTIEALEPVARPQ

SEQ ID NO: 7430 - protein, 80 aa, Solanum melongena
MSRSGQPPDLKKYMDKQLQIKLNANRQVVGTLRGFDQFMNLVIDNTVEVNGNEKNEIGMVVIRGNSVVTIEALEPVARPQ

SEQ ID NO: 7431 - protein, 79 aa, Unknown
  Sequence found in Organisms: Glycine max, Eucalyptus grandis
MSRSGQPPDLKKYMDKKLQIKLNANRMVVGTLRGFDQFMNLVVDNTVEVNGNEKNDIGMVVIRGNSVVTVEALEPVNRT

SEQ ID NO: 7432 - protein, 80 aa, Euonymus alatus
MSRSGQPPDLKKYMDKKLQIKLNANRMIVGTLRGFDQFMNLVIDNTVEVNGNERNDIGMVVIRGNSVVTVEALEPVARSQ

SEQ ID NO: 7433 - protein, 80 aa, Linum usitatissimum
MSRSGQPPDLKKYMDKKLQIKLNANRMVVGTLRGFDQFMNLVIDNTVEVNGEDKTDIGMVVIRGNSVVTVEALEPVNRGI

SEQ ID NO: 7434 - protein, 80 aa, Fraxinus spp
MSRSGQPPDLKKYMDKKLQIKLNANRMVVGTLRGFDQFMNLVVDNTVEVNGNEKNEIGMVVIRGNSVVTVEALEPVSRPQ

SEQ ID NO: 7435 - protein, 80 aa, Panax ginseng
MSRSGQPPDLKKYMDKQLQIKMNANRMVVGTLRGFDQFMNLVIDNTVEVNGNERTDIGMVVIRGNSVVIVEALEPVSRAQ

SEQ ID NO: 7436 - protein, 80 aa, Actinidia deliciosa
MSRSGQPPDLKKYMDKQLQIKLNANRMVIGTLRGFDQFMNLVVDNTLEVNGNEQTDIGMVVIRGNSVVTVEALEPVSRAQ

SEQ ID NO: 7437 - protein, 80 aa, Glycyrrhiza uralensis
MSRSGQPPDLKKYMDKKLQIKLNANRMIVGTLRGFDQFMNLVVDNTVEVNGNEKNDIGMVVIRGNSVVTVEALEPVNRSS

SEQ ID NO: 7438 - protein, 79 aa, Nuphar advena
MSKSGQPPDLKKYMDKKLHIKLNANRVVVGTLRGFDQFMNLVIDNTVEVNGNEKTEIGMVVIRGNSVVMIEALEPVSRG

SEQ ID NO: 7439 - protein, 79 aa, Nuphar advena
MSKSGQPPDLKKYMDKKLHIKLNANRVVVGVLRGFDQFMNLVIDNTVEVNGNEKTEIGMVVIRGNSVVMIEALEPVSRS

SEQ ID NO: 7440 - protein, 67 aa, Olea europaea
MDKKLQIKLNANRMVVGTLRGFDQFMNLVVDNTVEVNGNEKNEIGMVVIRGNSVVTVEALEPVSRPQ

SEQ ID NO: 7441 - protein, 80 aa, Petunia hybrida
MSRSGQPPDLKKYMDKQLQIKLNANRLVTGTLRGFDQFMNLVIDNTVEVNGNEKNEIGMVVIRGNSVVTIEALEPVARAQ

SEQ ID NO: 7442 - protein, 79 aa, Cajanus cajan
MSRSGQPPDLKKYMDKKLQIKLNANRTIVGTLRGFDQFMNLVVDNTVEVNGNEKNDIGMVVIRGNSVVTVEALEPVNRS

SEQ ID NO: 7443 - protein, 80 aa, Plantago ovata
MSRSGQPPDLKKYMDKKLQIKLNANRMVVGTLRGFDQFMNLVIDNTVEVNGDEKTDIGMVVIRGNSVVTVEALEPVQRAQ

SEQ ID NO: 7444 - protein, 80 aa, Populus trichocarpa
MSRSGQPPDLKKYMDKKLQIKLNANRMVVGTLRGFDQFMNLVVDNTVEVNGDEKTDIGMVVLRGNSVVTVEALEPVNRAQ

SEQ ID NO: 7445 - protein, 80 aa, Populus trichocarpa
MSRSGQPPDLKKYMDKKLQIKLNANRMVVGTLRGFDQFMNLVVDNTVDVNGDEKTDIGMVVIRGNSVVTVEALEPVTRTQ

SEQ ID NO: 7446 - protein, 79 aa, Raphanus sativus
MSRSGQPPDLKKYMDKKLQIKLNANRMVVGTLRGFDQFMNLVVYNTVEVNGDDKTDIGMVVIRGNSIVTVEALEPVGRS

SEQ ID NO: 7447 - protein, 79 aa, Rhizophora mangle
MSRSGQPPDLKKYMDKKLQIKLNANRLVVGTLRGFDQFMNLVVDNTVEVNGDEKTDIGMVVIRGNSVVTVEALEPVNKS

SEQ ID NO: 7448 - protein, 67 aa, Sarracenia psittacina
MDKQLQIKLNANRMVVGTLRGFDQFMNLVVDNTVEVNGNEKTDIGMVVIRGNSVVTVEALEPVSRTQ

SEQ ID NO: 7449 - protein, 80 aa, Sarracenia psittacina
MSRSGQPPDLKKYMDKQLQIKLNANRMVVGMLRGFDQFMNLVVDNTVEVNGNEKTDIGMVVIRGNSVVTVEALEPVSRTQ

SEQ ID NO: 7450 - protein, 80 aa, Unknown
  Sequence found in Organisms: Scabiosa columbaria, Valeriana officinalis
MSRSGQPPDLKKYMDKKLQIKLNANRMVVGTLRGFDQFMNLVIDNTVEVNGNERNDIGMVVLRGNSVVTVEALEPVARSQ

SEQ ID NO: 7451 - protein, 80 aa, Camellia sinensis
MSRSGQPPDLKKYMDKKLQIKLNANRMVVGTLRGFDQFMNLVVGNTVEMNGNEKTDIGMVVIRGNSVVTVEALEPVSRAQ

SEQ ID NO: 7452 - protein, 80 aa, Nicotiana tabacum
MSRSGQPPDLKKYMDKQLQIKLNANRLVVGTLRGFDQFMNLVIDNTVEVNGNEKNEIGMVVIRGNSVVTIEALEPVARAQ

SEQ ID NO: 7453 - protein, 80 aa, Utricularia gibba
MSRSGQPPDLKKYMDKKLQIKLNANRTVVGTLRGFDQFMNLVVDNTVEVNGSEKTDIGMVVIRGNSVVTVEALEPVTKAQ

SEQ ID NO: 7454 - protein, 81 aa, Phalaenopsis aphrodite
MSRSGQPPDLKKYMDKKLQIKLNANRTVVGTLRGFDQFMNLVIDNTVDVSGSSEKHDIGMVVIRGNSVVMIEALEPVNRSQ

SEQ ID NO: 7455 - protein, 81 aa, Solanum phureja
MSRSGQPPDLKKYMDKQLQIKLNANRLVTGTLRGFDQFMNLVIDNTVEINGNDKNEIGMVVIRGNSVVTIEALEPVARPQQ

SEQ ID NO: 7456 - protein, 67 aa, Primula obconica
MDKKLQIKLNANRTVVGTLRGFDQFMNLVIDNTVEVNGDDKTDIGMVVIRGNSVVTVEALEPVPRTQ

SEQ ID NO: 7457 - protein, 80 aa, Amborella trichopoda
MSKSGQPPDLKKYMDKKLHIKLNANRVVVGTLRGFDQFMNLVIDNTVEVNGNERNDIGMVVIRGNSVVMIEALEPVSKTQ

SEQ ID NO: 7458 - protein, 80 aa, Brassica juncea
MSRSGQPPDLKKYMDKKLQIKLNADRMVVGTLRGFDQFMNLVVDNTVEVNGDVKTDIGMVVIRGNSIVTVEALEPVGRSS

SEQ ID NO: 7459 - protein, 80 aa, Vaccinium corymbosum
MSRSGQPPDLKKYMDKKLQIKLNANRMVVGTLRGFDQFMNLVIDNTEEVNGNERTDIGMVVIRGNSVVTVEALEPVTRAQ

SEQ ID NO: 7460 - protein, 80 aa, Bupleurum chinense
MSRSGQPPDLKKYMDKKLQIKMNANRMVVGTLRGFDQFMNLVIDNTVEVNGDERNDIGMVVIRGNSVVTVEALEPVSRGQ

SEQ ID NO: 7461 - protein, 80 aa, Unknown
  Sequence found in Organisms: Catharanthus roseus, Catharanthus roseus
MSRSGQPPDLKKYMDKKLQIKLNANRMVVGTLRGFDQFMNLVVDNTVEVNGNEKNEIGMVVIRGNSVVTVEALDPVGRTQ

SEQ ID NO: 7462 - protein, 80 aa, Helianthus annuus
MSRSGQPPDLKKYMDKQLQIKLNANRTVVGTLRGFDQFMNLVIDNTVEVNGDDKHDIGMVVIRGNSVVTVEALEPVSRGQ

SEQ ID NO: 7463 - protein, 80 aa, Abies balsamea
MSRSGQPPDLKKYMDKMLNIKLNANRVVIGTLRGFDQFMNLVLDGTVDVNGNERNEIGMVVIRGNSVVMIEALEPVNRSQ

SEQ ID NO: 7464 - protein, 80 aa, Ambrosia trifida
MSRSGQPPDLKKYMDKQLQIKLNANRTVVGTLRGFDQFMNLVIDNTVEVNGDEKNDIGMVVIRGNSVVTVEALEPVARAQ

SEQ ID NO: 7465 - protein, 80 aa, Manihot esculenta
MSRSGQPPDLKKYMDKKLQIKLNANRMVVGTLRGFDQFMNLVVDNTVEVNGDEKNDIGMVVIRGNSVVTVEALEPVNRAM

SEQ ID NO: 7466 - protein, 80 aa, Unknown
  Sequence found in Organisms: Citrus sinensis, Citrus clementina, Citrus sinensis
MSRSGQPPDLKKYMDKKLQIKLNANRMIVGTLRGFDQFMNLVIDNTVEVNGNEKNDIGMVVIRGNSVVTVEALEPVSKSQ

SEQ ID NO: 7467 - protein, 79 aa, Cleome spinosa
MSRSGQPPDLKKYMDKKLQIKLNANRMIVGTLRGFDQFMNLVVDNTVEVNGNERTDIGMVVIRGNSVVTVEALEPVGKS

SEQ ID NO: 7468 - protein, 80 aa, Cucurbita pepo
MSRAGQPPDLKKYMDKKLQIKLNSNRLVVGTLRGFDQFMNLVVDNTVEVNGNEKNDIGMVVIRGNSVVTVEALEPVNRMQ

SEQ ID NO: 7469 - protein, 80 aa, Euonymus alatus
MSRSGQPPDLKKYMDKKLQIKLNANRMIVGTLRGFDQFMNLVIDNTVEVNGNERNEIGMVVIRGNSVVTVEALEPVARSQ

SEQ ID NO: 7470 - protein, 80 aa, Fraxinus spp
MSRSGQPPDLKKYMDKKPQIKLNANRMVVGTLRGFDQFMNLVVDNTVEVNGNEKNEIGMVVIRGNSVVTVEALEPVSRPQ

SEQ ID NO: 7471 - protein, 79 aa, Mesembryanthemum crystallinum
MSRSGQPPDLKKYMDKKLQIKLNANRMVIGTLRGFDQFMNLVIDNTLEVNGNEKTDIGMVVIRGNSVVTVEALEPVKQN

SEQ ID NO: 7472 - protein, 80 aa, Jatropha curcas
MSRSGQPPDLKKYMDKKLQIKLNANRMVVGTLRGFDQFMNLVVDNTVEVNGDEKNDIGMVVIRGNSVVTVEALEPVNKTQ

SEQ ID NO: 7473 - protein, 79 aa, Unknown
  Sequence found in Organisms: Pinus pinaster, Pinus taeda
MSRSGQPPDLKKYMDKKLNIKLNANRVVVGTLRGFDQFMNLVLDGTVEVNGNERNEIGMVVIRGNSVVMIEALEPVNRS

SEQ ID NO: 7474 - protein, 80 aa, Medicago truncatula
MSRSGQPPDLKKYMDKQLQIKLNANRMIVGTLRGFDQFMNLVVDNTVEVNGNEKNDIGMVVIRGNSVVTVEALEPVNRSI

SEQ ID NO: 7475 - protein, 80 aa, Orobanche aegyptiaca
MSRSGQPPDLKKYMDKKLQIKLNANRMVVGTLRGFDQFMNMVIDNTVEVNGTEKTDIGMVVLRGNSVVTVEALEPVIRSQ

SEQ ID NO: 7476 - protein, 79 aa, Cajanus cajan
MSRSGQPPDLKKYMDKKLQIKLNANRMIVGTLRGFDQFMNLVVDNTVEVNGNEKNDIGMVVIRGNSVVTVEALEPVNRT

SEQ ID NO: 7477 - protein, 80 aa, Platanus occidentalis
MSRSGQPPDLKKYMDKQLQIKLNANRVVVGTLRGFDQFMNLVIDNTVEVNGNEKNEIGMVVIRGNSVVMIDALEPVSKAQ

SEQ ID NO: 7478 - protein, 80 aa, Unknown
  Sequence found in Organisms: Pseudotsuga menziesii, Picea glauca
MSRSGQPPDLKKYMDKKLNIKLNANRVVVGTLRGFDQFMNLVLDGTVEVNGNERNEIGMVVIRGNSVVMIEALEPVNRSS

SEQ ID NO: 7479 - protein, 80 aa, Scabiosa columbaria
MSRSGQPPDLKKYMDKKLQIKLNANRMVVGTLRGFDQFMNLVIDNTVEVNGNERNEIGMVVLRGNSVVTVEALEPVARSQ

SEQ ID NO: 7480 - protein, 80 aa, Sesamum indicum
MSRSGQPPDLKKYMDKKLQIKLNANRMVVGNLRGFDQFMNLVVDNTVEVNGNEKTDIGMVVIRGKSVVTVEAPEPVNRAQ

SEQ ID NO: 7481 - protein, 80 aa, Triphysaria pusilla
MSRSGQPPDLKKYMDKKLQIKLNANRMVVGTLRGFDQFMNLVIDNTVEVSGNENSDIGMVVIRGNSVVTVEALEPVARAQ

SEQ ID NO: 7482 - protein, 81 aa, Phalaenopsis aphrodite
MSRSGQPPDLKKYMDKKLQIKLNANRTVVGTLRGFDQFMNLVIDNTVDVSSSSEKHDIGMVVIRGNSVVMIEALEPVNRSQ

SEQ ID NO: 7483 - protein, 80 aa, Unknown
  Sequence found in Organisms: Centaurea maculosa, Cirsium arvense, Carthamus tinctorius, Tragopogon dubius
MSRSGQPPDLKKYMDKQLQIKLNANRTVVGTLRGFDQFMNLVIDNTVEVNGEEKNDIGMVVIRGNSVVTVEALEPVSRAQ

SEQ ID NO: 7484 - protein, 80 aa, Unknown
  Sequence found in Organisms: Centaurea maculosa, Cirsium arvense
MSRSGQPPDLKKYMDKQLQIKLNANRTVVGTLRGFDQFMNLVIDNTVEVNGEEKNDIGMVVIRGNSVVTVEALEPVSRGQ

SEQ ID NO: 7485 - protein, 80 aa, Helianthus annuus
MSRSGQPPDLKKYMDKQLQIKLNANRTVVGTLRGFDQFMNLVIDNTVEVNGEEKNEIGMVVIRGNSVVTVEALEPVARAQ

SEQ ID NO: 7486 - protein, 79 aa, Eutrema parvulum
MSRSGQPPDLKKYMDKNLQIKLNANRMVVGTLRGFDQFMNLVVDNTVEVKGDEKTDIGMVVIRGNSIVTVEALEPVGRS

SEQ ID NO: 7487 - protein, 77 aa, Aristolochia fimbriata
MSRSGQPPDLKKYMDKKLQIKLNANRVVVGILRGFDQFMNLVIDNTVELKGNEKNDIGMVVIRGNSVVMIEALEPVS

SEQ ID NO: 7488 - protein, 80 aa, Artemisia annua
MSRSGQPPDLKKYMDKQLQIKLNANRTVVGTLRGFDQFMNLVIDNTVEVNGDAKNEIGMVVIRGNSVVTVEALEPVARAQ

SEQ ID NO: 7489 - protein, 78 aa, Bruguiera gymnorhiza
MSRSGQPPDLKKYMDKKLQIKLNANRLVVGTLRGFDQFMNLVVDNTIEVNGDEKTDIGMVVIRGNSVVTVEALEPVNK

SEQ ID NO: 7490 - protein, 67 aa, Cirsium arvense
MDKQLQIKLNANRTVVGTLRGFDQFMNLVIDNTVEVNGEEKNDIGMVVIRGNSVVTVEALEPVSRAQ

SEQ ID NO: 7491 - protein, 79 aa, Cyamopsis tetragonoloba
MSRSGQPPDLKKYMDKQLQIKLNANRMIVGTLRGFDQFMNLVVDNTVEVNGNEKNEIGMVVIRGNSVVTVEALEPVNRS

SEQ ID NO: 7492 - protein, 80 aa, Taraxacum officinale
MSRSGQPPDLKKYMDKQLQIKLNANRTVVGTLRGFDQFMNLVIDNTVEVNGDEKNDIGMVVIRGNSVVTVEALEPVSRGQ

SEQ ID NO: 7493 - protein, 80 aa, Linum usitatissimum
MSRSGQPPDLKKYMDKKLQIKLNANRMVVGTLRGFDQFMNLVIDNTVEVNGEEKTEIGMVVIRGNSVVTVEALEPVNRGI

SEQ ID NO: 7494 - protein, 80 aa, Humulus lupulus
MSRSGQPPDLKKYMDKKLQIKLNGNRMVVGTLRGFDQFMNLVVDNTVEVNGDERNDIGMVVIRGNSVVTVEALEPVTRTQ

SEQ ID NO: 7495 - protein, 94 aa, Ipomoea nil
MSRSGQPPDLKKYMDKKLQIKLNANRMVVGTLRGFDQFMNLVVDNTVEVNGNERTDIGMVVLRGNSVVTIEALEPLPELSHLHHRMVTFNVLCS

SEQ ID NO: 7496 - protein, 80 aa, Liriodendron tulipifera
  misc_feature (10)..(10): Xaa can be any naturally occurring amino acid
  misc_feature (73)..(73): Xaa can be any naturally occurring amino acid
MSRSGQPPDXKKYMDKKLQIKLNANRVVVGTLRGFDQFMNLVIDNTLELNGNEKNDIGMVVIRGNSVVMIEAXEPVSKTQ

SEQ ID NO: 7497 - protein, 80 aa, Olea europaea
MSRSGQPPDLKKYMDKKLQIKLNANRMVVGTLRGFDQFMNLVVDNTVEMNGNEKNEIGMVVIRGNSVVTVEALEPISRPQ

SEQ ID NO: 7498 - protein, 79 aa, Arachis hypogaea
MSRSGQPPDLKKYMDKKLQIKLNANRMIVGTLRGFDQFMNLVVDNTVEVNGNEKNEIGMVVIRGNSVVTVEALEPVNRG

SEQ ID NO: 7499 - protein, 79 aa, Glycine max
MSRSGQPPDLKKYMDKKLQIKLNGNRMIVGTLRGFDQFMNLVVDNTVEVNGNEKNDIGMVVIRGNSVVTVEALEPVNRA

SEQ ID NO: 7500 - protein, 80 aa, Tamarix hispida
MSRSGQPPDLKKYMDKKLQIKLNANRQVVGTLRGFDQFMNLVIDNTVEVNGNEKNEIGMVVIRGNSVVTVEALEPVNRTM

SEQ ID NO: 7501 - protein, 79 aa, Zamia vazquezii
  misc_feature (46)..(46): Xaa can be any naturally occurring amino acid
MSKSGQPPDLKKYMDKKLNIKLNANRVVIGTLRGFDQFMNLVLDGXVEVNGNERNEIGMVVIRGNSVVMIEALEPVNRS

SEQ ID NO: 7502 - protein, 75 aa, Orobanche aegyptiaca
MSRSGQPPDLKKYMDKKLQIKLNANRLVIGTLRGFDQFMNMVIDNTVEVNGNEKTDIGMVCFSFAGHQGEQCGHC

SEQ ID NO: 7503 - protein, 88 aa, Cenchrus ciliaris
MSRSGQPPDLKKYMDKKLQIKLNANRVVIGTLRGFDQFMNLVVDNTVEVNGNDKNDIGMVVIRGNSVVMIEALEPVVFFAPPLPSQSS

SEQ ID NO: 7504 - protein, 80 aa, Unknown
  Sequence found in Organisms: Ambrosia trifida, Senecio madagascariensis
MSRSGQPPDLKKYMDKQLQIKLNANRTVVGTLRGFDQFMNLVIDNTVEVNGEEKNEIGMVVIRGNSVVTVEALEPVSRAQ

SEQ ID NO: 7505 - protein, 80 aa, Artemisia annua
MSRSGQPPDLKKYMDKQLQIKLNANRTVVGTLRGFDQFMNLVIDNTVEVNGEEKNEIGMVVIRGNSVVTVEALEPVSRPQ

SEQ ID NO: 7506 - protein, 79 aa, Fagopyrum esculentum
MSRSGQPPDLKKYMDKNLQIKLNANRMVVGTLRGFDQFMNLVIDNTVEVNGNERNEIGMVVIRGNSVVTVEALEPVNRS

SEQ ID NO: 7507 - protein, 80 aa, Flaveria ramosissima
MSRSGQPPDLKKYMDKQLQIKLNANRTVVGTLRGFDQFMNLVIDNTVEVNGEEKNEIGMVVIRGNSVVTVEALEPVNRAQ

SEQ ID NO: 7508 - protein, 80 aa, Flaveria ramosissima
MSRSGQPPDLKKYMDKQLQIKLNANRTVIGTLRGFDQFMNLVIDNTVEVNGQEKNDIGMVVIRGNSVVTVEALEPISKAQ

SEQ ID NO: 7509 - protein, 80 aa, Humulus lupulus
MSRSGQPPDLKKYMDKKLQIKLNGNRMVVGTPRGFDQFMNLVVDNTVEVNGDERNDIGMVVIRGNSVVTVEALEPVTRTQ

SEQ ID NO: 7510 - protein, 80 aa, Lactuca sativa
MSRSGQPPDLKKYMDKQLQIKLNANRTVAGTLRGFDQFMNLVIDNTVEVNGEEKNEIGMVVIRGNSVVTVEALEPVSRGQ

SEQ ID NO: 7511 - protein, 80 aa, Unknown
  Sequence found in Organisms: Lactuca sativa, Senecio madagascariensis
MSRSGQPPDLKKYMDKQLQIKLNANRTVVGTLRGFDQFMNLVIDNTVEVNGEEKNEIGMVVIRGNSVVTVEALEPVSRGQ

SEQ ID NO: 7512 - protein, 79 aa, Lotus japonicus
MSRSGQPPDLKKYMDKNLQIKLNANRMIIGTLRGFDQFMNLVIDNTVEVNGNEKNDIGMVVIRGNSVVTVEALEPVTKN

SEQ ID NO: 7513 - protein, 76 aa, Orobanche aegyptiaca
MSRSGQPPDLKKYMDKQLQIKLNANRLVVGTLRGFDQFMNLVIDNTVEVNGNEKNEIGMVVIRGNSVVTIEALEPV

SEQ ID NO: 7514 - protein, 79 aa, Arachis hypogaea
MSRSGQPPDLKKYMDMKLQIKLNANRMIVGTLRGFDQFMNLVVDNTVEVNGNEKNEIGMVVIRGNSVVTVEALEPVNRA

SEQ ID NO: 7515 - protein, 79 aa, Arachis hypogaea
MSRSGQPPDLKKYMDMKLQIKLNANRMIVGTLRGFDQFMNLVVDNTVEVNGNEKNEIGMVVIRGNSVVTVEALEPVNRT

SEQ ID NO: 7516 - protein, 79 aa, Silene vulgaris
MSRSGQPPDLKKYMDKKLQIKLNANRMVVGTLRGFDQFMNLVVDNTEEVNGNERNEIGMVVIRGNSVVTVEALEPVRGL

SEQ ID NO: 7517 - protein, 80 aa, Tragopogon dubius
MSRSGQPPDLKKYMDKQLQIKLNANRTVVGTLRGFDQFMNLVIDNTVEMNGEEKNDIGMVVIRGNSVVTVEALEPVSRAQ

SEQ ID NO: 7518 - protein, 80 aa, Trigonella foenum-graecum
MSRSGQPPDLKKYMDKQLQIKLNANRMIVGTLRGFDQFMNMVVDNTVEVNGNEKNDIGMVVIRGNSVVTVEALEPVNRTI

SEQ ID NO: 7519 - protein, 80 aa, Valeriana officinalis
MSRSGQPPDLKKYMDKKLQIKLNANRMVVGTLRGFDQFMNMVIENTVEVNGNEKNEIGMVVIRGNSVITVEALEPVARAQ

SEQ ID NO: 7520 - protein, 64 aa, Platanus occidentalis
MSRSGQPPDLKKYMDKQLQIKLNANRVVVGTLRGFDQFMNLVIDNTVEVNGNEKNEIGMVVSGQ

SEQ ID NO: 7521 - protein, 81 aa, Medicago truncatula
MSRSGQPPDLKKYMDKQLQIKLNANRMIVGTLRGFDQFMNLVVDNTVEVNGNEKNDIGMVVIRGNSVVTVEALEPVVNRIG

SEQ ID NO: 7522 - protein, 81 aa, Trigonella foenum-graecum
MSRSGQPPDLKKYMDKQLQIKLNANRMIVGTLRGFDQFMNLVVDNTVEVNGNEKNDIGMVVIRGNSVVTVEALEPVVNRIS

SEQ ID NO: 7523 - protein, 67 aa, Vaccinium corymbosum
MDKKLQIKLNANRMVVGTLRGFDQFMNLVIDNTEEVIGNERTDIGMVVIRGNSVVTVEALEPVSRAQ

SEQ ID NO: 7524 - protein, 80 aa, Flaveria ramosissima
MSRSGQPPDLKKYMDKQLQIKLNANRTVVGTLRGFDQFMNLVIDNTVEVNGQEKNDIGMVVIRGNSVVTVEALEPISKAQ

SEQ ID NO: 7525 - protein, 80 aa, Flaveria ramosissima
MSRSGQPPDLKKYMDKQLQIKLNANRTVIGMLRGFDQFMNLVIDNTVEVNGQEKNDIGMVVIRGNSVVTVEALEPINKAQ

SEQ ID NO: 7526 - protein, 80 aa, Lotus japonicus
MSRSGQPPDLKKYMDKNLQIKLNANRMIVGTLRGYDQFMNMVVDNTVEVNGNEKNDIGMVVIRGNSVVTVEALEPVTRTS

SEQ ID NO: 7527 - protein, 62 aa, Thalictrum flavum
RSGQPPDLKKYMDKQLQIKLNANRLVTGTLRGFDQFMNLVMENTVEMNGNEKNRDRHGGYQG

SEQ ID NO: 7528 - protein, 75 aa, Tripterygium wilfordii
QPPDLKKYMDKKLQIKLNANRMIVGTLRGFDQFMNLVVDNTVEVNGNERNDIGMVVIRGNSVVTVEALEPVARSQ

SEQ ID NO: 7529 - protein, 81 aa, Adiantum capillus-veneris
MSKSGQPPDLKKYMDKKLNIKLNANRVVVGTLRGYDQFMNLVLDGTVEMNGNDRNEIGMVVIRGNSVVMIEALEPVNRPGA

SEQ ID NO: 7530 - protein, 81 aa, Pteridium aquilinum
MSKSGQPPDLKKYMDKKLNIKLNANRVVVGTLRGYDQFMNLVLDGTVEMNGNDRNEIGMVVIRGNSVVMIEALEPVSRPGP

SEQ ID NO: 7531 - protein, 61 aa, Cichorium intybus
MKLNANRTVIGTLRGFDQFMNLVIDNTVKVNGEEKNDIGMVVIRGNRVVTVEALEPVSRAQ

SEQ ID NO: 7532 - protein, 63 aa, Cajanus cajan
MDKKLQIKLNANRMIVGTLRGFDLVYEFWLLTTLWNDGMKKNDIGMVVIRGNSVVTVEKRLNL

SEQ ID NO: 7533 - protein, 65 aa, Senecio madagascariensis
MSRSGQPPDLKKYMDKQLQIKLNANRTVVGTLRGFDQFMNLVIDNTVEVNGEEKNEIGMVGHKRE

SEQ ID NO: 7534 - protein, 67 aa, Nicotiana tabacum
  misc_feature (16)..(16): Xaa can be any naturally occurring amino acid
  misc_feature (50)..(50): Xaa can be any naturally occurring amino acid
  misc_feature (61)..(61): Xaa can be any naturally occurring amino acid
  misc_feature (65)..(65): Xaa can be any naturally occurring amino acid
MDKQLQIKLNANRLVXGTLRGFDQFMNLVIDNTVEVNGNEKNEIGMVVIXGNSVVTIEALXPVAXAQ

SEQ ID NO: 7535 - protein, 79 aa, Cephalotaxus harringtonia
MSKSGQPPDLKKYMDKKLNIKLNANRMVVGTLRGFDQFMNLVLDGTVEINGNDRNEIGMVVIRGNSVVMIEALEPVNKG

SEQ ID NO: 7536 - protein, 79 aa, Unknown
  Sequence found in Organisms: Cryptomeria japonica, Sequoia sempervirens
MSKSGQPPDLKKYMDKKLNIKLNANRMVVGTLRGFDQFMNLVLDGTVEINGNERNEIGMVVIRGNSVVMIEALEPVNRG

SEQ ID NO: 7537 - protein, 80 aa, Flaveria ramosissima
MSRSGQPPDLKKYMDKQLQIKLNANRTVVGTLRGFDQFMNLVIDNIVEVNGQEKNDIGMVVIRGNSVVTVEALEPISKAQ

SEQ ID NO: 7538 - protein, 80 aa, Guizotia abyssinica
MSRSGQPPDLKKYMDKQIQIKLNANRTVVGTLRGFDQFMNLVIDNTVEMNGEEKNEIGMVVIRGNSVVTVEALEPVSRAQ

SEQ ID NO: 7539 - protein, 80 aa, Carthamus tinctorius
MSRSCLPPDLKKYMDKQLQIKLNANRTVVGTLRGFDQFMNLVIDNTVEMNGEEKNDIGMVVIRGNSVVTVEALEPVSRGQ

SEQ ID NO: 7540 - protein, 84 aa, Artemisia annua
MSRSGQPPDLKKYMDKQLQIKLTRVSNANRTVVGTLRGFDQFMNLVIDNTVEVNGDAKNEIGMVVIRGNSVVTVEALEPVARAQ

SEQ ID NO: 7541 - protein, 81 aa, Tropaeolum majus
MSRSGQPPDLKKYMDKKLQIKLNANRMIVGTLRGFDQFMNLVVDNTVEVNGDERTEIGMVVLRGNSVVTVEALEPIAKTYG

SEQ ID NO: 7542 - protein, 81 aa, Selaginella moellendorffii
MSKSGQPPDLKKYMDLKLMIKLNANRVVVGVLRGFDQFMNLVLDNTMEISGNERTEIGMVVIRGNSVAMIEALEPVAPRAQ

SEQ ID NO: 7543 - protein, 79 aa, Ambrosia trifida
MSRSGQPPDLKKYMDKQLQIKLNANRTVVGTLRGFDQFMNLVIDNTVDDGEEKNEIGMVVIRGNSVVTVEALEPVSRAQ

SEQ ID NO: 7544 - protein, 77 aa, Flaveria ramosissima
SGQPPDLKKYMDKQLQIKLNANRTVIGTLRGFDQFMNLVIDNTVEVNGQEKNDIGMVVIRGNSVVTVEALEPISKAQ

SEQ ID NO: 7545 - protein, 68 aa, Lolium multiflorum
MDKKLQIKMNANRVVIGTLRGFDQFMNLVVDNTVEVNGDERTDIGMVVVRGNSVVMIEALEPIAKSQQ

SEQ ID NO: 7546 - protein, 79 aa, Podocarpus macrophillus
MSKSGQPPDLKKYMDKKLNIKLNANRMVVGTLRGFDQFMNLVIDGTVEINGNERNEIGMVVIRGNSVVMIEALEPVNKT

SEQ ID NO: 7547 - protein, 79 aa, Sciadopitys verticillata
MSKSGQPPDLKKYMDKKLNIKLNGNRMVIGTLRGFDQFMNLVLDGTLEVIGNDRNEIGMVVIRGNSVVMIEALEPVNKA

SEQ ID NO: 7548 - protein, 366 aa, Zea mays
MALSDRSRESLLPSFLYGSSARSFAATGAAARLPVSSPAPAAAGAGGGVPFSIQAPKEKIEMYSPAFYAACTAGGIASCGLTHMAVTPLDLVKCNMQIDPAKYKSISSGFGILLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGVLGLYKGIVPLWGRQIPYTMMKFASFETIVELIYKHAVPVPKSECSKTTQLGISFAGGYVAGVFCAIVSHPADNLVSFLNNAKGATVGDAVKKLGLWGLFTRGLPLRIVMIGTLTGAQWGIYDAFKVMVGLPTTGGVTPAPAAEAELKASA

SEQ ID NO: 7549 - protein, 366 aa, Zea mays
MALSDRSRESLLPSFLYASSARSFAATGAAARLHASAPAPAAAGAGGAVPFSIQAPNEKIEMYSPAFYAACTVGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAIVSHPADNLVSFLNNAKDATVGDAVKKLGLWGLFTRGLPLRIVMIGTLTGAQWGIYDAFKVMVGLPTTGGVTPAPAAKAELKASA

SEQ ID NO: 7550 - protein, 371 aa, Sorghum bicolor
MALSDRSRESLLPSFLYSSSARSFAATGAAAARLPVSAPAPAAAGAGGRVPFSIQAPSEKIEMYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAIVSHPADNLVSFLNNAKGATVGDAVKKLGLWGLFTRGLPLRIVMIGTLTGAQWGIYDAFKVMVGLPTTGGPAPAAVAAPAAEAESKASA

SEQ ID NO: 7551 - protein, 372 aa, Saccharum officinarum
MALSDRSRESLLPSFLYSSSARSFAATGAAARLPVSSPAPAAAGAGGGVPFSIQAPNEKIEMYSPAFYAACTAGGIASCGLTHTAVTPLDLVKCNMQIDPAKYKSISSGFGVLLKEQGARGLFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAVVSHPADNLVSFLNNAKGATVGDAVKKLGLWGLFTRGLPLRIVMIGTLTGAQWGIYDAFKVMVGLPTTGGVTPAPAVEAVSAAEAESKAIA

SEQ ID NO: 7552 - protein, 367 aa, Setaria italica
MALSDRSRESLLPSFLYASSARSFAASSPARSFAASAPAPAAAAGAGGGGAPFSIQAPNEKIELYSPAFYAACTAGGIASCGLTHMAVTPLDLVKCNMQIDPAKYKSISSGFGILLKEQGARGFFRGWVPTLLGYSAQGACKFGFYEFFKKYYSDIAGPEYAHKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAIVSHPADNLVSFLNNAKGATVGDAVKKIGLLGLFTRGLPLRIVMIGTLTGAQWGIYDAFKVMVGLPTTGGVTPAPAEAESKASA

SEQ ID NO: 7553 - protein, 366 aa, Panicum virgatum
MALSDRSRESLLPSFLYASSSARSFAATPSRLSVPVPAPAPAAAGAGGGAPITIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGLVPLWGRQIPYTMMKFASFETIVELIYKHAVPVPKSECSKLTQLGISFAGGYIAGVFCAIVSHPADNLVSFLNNAKGATVGDAVKKFGLWGLFTRGLPIRIVMIGTLTGAQWGIYDAFKVMVGLPTTGGVTPAPAEAESKASA

SEQ ID NO: 7554 - protein, 368 aa, Oryza sativa
MALSDRSRESLLPSFLYTSSAARSFATGATRFPSPVSPASPAPGAVGGGAPISIQAPREKIEMYSPAFYAACTAGGIASCGLTHMAVTPLDLVKCNMQIDPAKYKSITSGFGVLLKEQGPRGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVEMIYKHAVPVPKSECSKSFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPGAAEKALQASA

SEQ ID NO: 7555 - protein, 365 aa, Setaria italica
MALSDRSRESLLPSFLYAPSAARSFAGASRFPSSPAAAPGSGGAPSFPIQAPKEKIEMYSPAFYAACTAGGIASCGLTHMAVTPLDLVKCNMQINPAKYKSITSGFGVLAQEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIRSEGALGLYKGIVPLWGRQIPYTMMKFASFETIVELIYKHAVPVPKSECSKSFQLGISFAGGYVAGVFCAIVSHPADNLVSFLNNAKGATVGDAVKKLGLWGLFTRGLPLRIVMIGTLTGAQWGIYDAFKVMVGLPTTGGVTPAPAPTTEEAALKASA

SEQ ID NO: 7556 - protein, 365 aa, Panicum virgatum
MALSDLSRESLLPSFLYAPAAARSFAGASRLPASPAAAPGGAGAPSFPIQAPKEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIKSEGALGLYKGIVPLWGRQIPYTMMKFASFETIVELIYKHAVPVPKSECSKPFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAPTAEEAALKASA

SEQ ID NO: 7557 - protein, 365 aa, Panicum virgatum
MALSDLSRESLLPSFLYAPAAARSFAGASRLPASPAAAPGGAGAPSFPIQAPKEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIKSEGALGLYKGIVPLWGRQIPYTMMKFASFETIVELIYKHAVPVPKSECSKSFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAPTAEEAALKASA

SEQ ID NO: 7558 - protein, 366 aa, Cenchrus ciliaris
  misc_feature (36)..(36): Xaa can be any naturally occurring amino acid
MALSDRSRGSLLPSFLYAPSAARSFAGASRFPASPXAAPAGGRAPSFPIQAPNEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIRSEGALGLYKGIVPLWGRQIPYTMMKFASFETIVELIYKHAVPVPKSECSKPFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAPIAEEEAALKASA

SEQ ID NO: 7559 - protein, 371 aa, Sorghum bicolor
MALSDRSRESLLPSFLYSPAATRSFAGASRFPASPAAAAASAPSVAGGGALPFTIQAPNEKIEMYSPAFYAACTAGGIASCGLTHMAVTPLDLVKCNMQIDPAKYKSISSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIKSEGALGLYKGIVPLWGRQIPYTMMKFASFETIVELIYKHAVPVPKSECSKPFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAPATEEAALKASA

SEQ ID NO: 7560 - protein, 370 aa, Saccharum officinarum
MALSDRSRESLLPSFLYSPAAARSFAGASRFPASPAAAAPAPSLAGGAPLPFTIQAPNEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIKSEGALGLYKGIVPLWGRQIPYTMMKFASFETIVELIYKNAVPVPKSECSKPFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAPTTEEATLKASA

SEQ ID NO: 7561 - protein, 368 aa, Oryza sativa
MALSDRSRESLLPSFLYSTAGARPYTAGGGGAAFRLPAAAAPGGVGGGAPIEIQAPREKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLGDGLPKFIKSEGALGLYKGIVPLWGRQIPYTMMKFASFETIVEQIYKHAVPVPKSECSKSFQLGISFAGGYIAGVFCAIVSHPADNLVSFLNNAKGATVGDAVKKLGLWGLFTRGLPLRIVMIGTLTGAQWGIYDAFKVMVGLPTTGGVTPAPSTSDAGLKAVSA

SEQ ID NO: 7562 - protein, 366 aa, Brachypodium distachyon
MALSDLSRESLLPSFLYTSTAARSFAGASRFPSSSSPQAPSFGGGSAGGRKPFSLQAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENALKYKTLIYLAGSASAEVIADIALCPFEAVKVRVQTQPGFARGLSDGLPKFIKAEGAGGLYKGIVPLWGRQIPYTMMKFASFETIVELIYKHAVPVPKSECSKPFQLGISFAGGYIAGVFCAIVSHPADNLVSFLNNAKGATMGDAVKKIGVLGLFTRGLPLRIVMIGTLTGAQWGIYDAFKVMVGLPTTGGVAPAPPVEAAPVA

SEQ ID NO: 7563 - protein, 370 aa, Avena sativa
MALSDLTRESLLPSFLYSASPFGAAASRLASSSAAPAPPAFGLGGGVGVGGGKPFSIRAPSEKIEMYSPAFYAACTAGGIASCGLTHMAVTPLDLVKCNMQINPEKYKSISSGFGVLLKEQGARGFFRGWVPTLLGYSAQGACKFGFYEFFKKTYSDMAGPENAIKYKTLIYLAGSASAELIADVALCPMEAVKVRVQTQPGFARGLSDGLPKFVKAEGVAGLYKGLVPLWGRQIPYTMMKFASFETIVELIYKHAVPVPKSECSKPFQLGISFAGGYIAGVFCAIVSHPADNLVSFLNNAKGATMGDAVKQIGVLGLFTRGLPLRIVMIGTLTGAQWGIYDAFKVMVGLPTTGGVAPVPAAAEEAKANA

SEQ ID NO: 7564 - protein, 377 aa, Pseudoroegneria spicata
MALSDLSRDSLLPSFLYSSPAARSFAAASPRFPSSPSPYQAPAAAPAVGIVGAGRVGGGRPFSIRAPNEKIEMYSPAFYAACTAGGIASCGLTHMAVTPLDLVKCNMQIDPAKYKSITSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKAIA

SEQ ID NO: 7565 - protein, 375 aa, Triticum aestivum
MALSDLSRDSLLPSFLYSPRSFAAAASPRFPSSPSPYQAPAAAPAARLVGAGGVGGGRPFSIRAPNEKIEMYSPAFYAACTAGGIASCGLTHMAVTPLDLVKCNMQIDPAKYKSITSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKAIA

SEQ ID NO: 7566 - protein, 377 aa, Secale cereale
MALSDLSRDSLLPSFLYSPRSFAAAASPRFPSSPSPYQAPAAAPAPAVGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVRDAVNKIGMLGLFTRGLPLRIVMIGTLTGAQWGIYDAFKVMVGLPTTGGAPPVAPVEEAAKASA

SEQ ID NO: 7567 - protein, 378 aa, Triticum aestivum
MALSDLSRDSLLPSFLYSPRSFAAAASPRFPSSPSPYQAPASPAAAPAAGLVGAGGVGGGRPFSIRAPNEKIEMYSPAFYAACTAGGIASCGLTHMAVTPLDLVKCNMQIDPAKYKSISSGFGVLFKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVNKIGMLGLFTRGLPLRIVMIGTLTGAQWGIYDAFKVMVGLPTTGGAPPVAPVEEAAKASA

SEQ ID NO: 7568 - protein, 378 aa, Triticum aestivum
MALSDLSRDSLLPSFLYSPRSFAAAASPRFPSSPSPYQAPASPAAAPAAGLVGAGGVGGGRPFSIRAPNEKIEMYSPAFYAACTAGGIASCGLTHMAVTPLDLVKCNMQIDPAKYKSITSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKAIA

SEQ ID NO: 7569 - protein, 380 aa, Secale cereale
MALSDLSRDSLLPSFLYSPRSFAAAAAPRFPSSPSPYQAPASPAAAAAPAVGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVRDAVNKIGMLGLFTRGLPLRIVMIGTLTGAQWGIYDAFKVMVGLPTTGGAPPVAPVEEAVKASA

SEQ ID NO: 7570 - protein, 375 aa, Avena sativa
MALSDLTRESLLPSFLYSASPFGAAATRLASSSSYQAPAAAPAPPAFGLGGGVGVGGGKPFSIRAPSEKIEMYSPAFYAACTAGGIASCGLTHMAVTPLDLVKCNMQINPEKYKSISSGFGVLLKEQGARGFFRGWVPTLLGYSAQGACKFGFYEFFKKTYSDMAGPENAIKYKTLIYLAGSASAELIADVALCPMEAVKVRVQTQPGFARGLSDGLPKFVKAEGVAGLYKGLVPLWGRQIPYTMMKFASFETIVELIYKHAVPVPKSECSKPFQLGISFAGGYIAGVFCAIVSHPADNLVSFLNNAKGATMGDAVKQIGVLGLFTRGLPLRIVMIGTLTGAQWGIYDAFKVMVGLPTTGGVAPVPASEEVKAVA

SEQ ID NO: 7571 - protein, 377 aa, Triticum aestivum
MALSDLSRDSLLPSFLYSSRSFAAAAPRFPSSPSPYQAPASPAAAPAAGLVGAGGVGGGRPFSIRAPNEKIVMYSPAFYAACTAGGIASCGLTHMAVTPLDLVKCNMQIDPAKYKSITSGFGVLFKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVNKIGMLGLFTRGLPLRIVMIGTLTGAQWGIYDAFKVMVGLPTTGGAPPVAPVEEAAKASA

SEQ ID NO: 7572 - protein, 1429 aa, Pennisetum glaucum
SSCLAAIFLSIKQNKEVAAIGRDALTPMVSLSNSSVIEVAEQATRALANLFLDQELSLQVSFEEILFRVTRVLKEGTIDGRTHAAAAIARLLQCRTINQLLSDTINRSGCVLALAGLLEAANGEAAATSEVLDALVLLSRSKASSGHTKAPWAVLAENPHTILPLVSCIADAAPSLQDKAIEVVSRLCSDQHDVVGGLVSETPGCIASITRRVIGSNMLRVKVGGCALLVCAAKEHCQKQIEILNDSSLYIQLIHSLIGMIHMTNTHAESDISDSIADIRISRYCKENNSDGETVCRTAVISGNMIPLWLLAVFSRHDSKTRAEILEAGAVEMLTEKISQNAFQYVGEEDSTSWVCSLLLALLFQEREINRSNSALHSIPVLSNLLRSDEPAYRYFAAQALSSLVCNGSRGTLLAVANSGAAIGLISLLGCADVDIADLLELSEEFMLVPNPDQIALERMFRVDDIRVGSTSRKSIPLLVDLLKPIPERPGAPFLALCLLTQLAVDCPPNMLLMAEAGILEALTKYLSLSPQDATEEATTELLGILFSSAEIRHHESALGVVNQLVAVLRLGARNSRYSAAKALESLFSADHVRNSESARQAIQPLVEILSTGMEREQHAAISALVRLLCDNPSRALAVADVEMNAVDVLCRILSSDCSAELKGDAAELCCVLFANTRIRSTMAAARCVEPLVGLLVSEANPAQLSVVRALDRLLDDEQLAELVAAHGAVVPLVGLLYGRNYMLHEAVARALVKLGKDRPACKLEMVKAGVIESILEILHDAPDFLCIALAEMLRILTNNASIAKGPSAAKVVQPLFSLLSKADMGPEGQYSALQVLVNILEHPECRADYNLTPRQTIEPVITLLNSSPPAVQQLAAELLSHLLLEDHLQKDTITEQAITPLIQVLSSGLPNLQQRAIKALANLAIAWPNTIAKEGGVFELSKVLLQSDPPLPHVVWESAASVLSSILQYSTEFFLEVPVAVLVQLLRSGTENTVVGALNALLVLESDDSTSAEAMAESGAVEALLDLLRSHQCEETAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTEPATLCIPHLVTSLKTGSEATQEAALDSLYLLRQAWSACPAEVFKAQSVAASEAIPLLQYLIQSGPPRFQEKAELLLQCLPGTLTVTIKRGNNLKQSVGNPSAFCKLTLGNNTPRLTKIVSTGTTPEWDEAFAWAFDSPPKGQKLHISCKNNSKFGKKSFGKVTIQIDRVVMLGSVAGEYTLLPESKSGPNRNLEIEFQWSNK

SEQ ID NO: 7573 - protein, 380 aa, Secale cereale
MALSDLSRDSLLPSFLYSPRSFAAAASPRFPSSPSPYQAPASPAAAAAPAVGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVRDAVNKIGMLGLFTRGLPLRIVMIGTLTGAQWGIYDAFKVMVGLPTTGGAPPVAPVEEAVKASA

SEQ ID NO: 7574 - protein, 380 aa, Secale cereale
MALSDLSRDSLLPSFLYSPRSFAAAASPRFPSSPSPYQAPSHASPAAAPAVGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVRDAVNKIGMLGLFTRGLPLRIVMIGTLTGAQWGIYDAFKVMVGLPTTGGAPPVAPVEEAAKASA

SEQ ID NO: 7575 - protein, 380 aa, Secale cereale
MALSDLSRDSLLPSFLYSPRSFAAAASPRFPSSPSPYQAPASPAAAAAPAVGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVRDAVNKIGMLGLFTRGLPLRIVMIGTLTGAQWGIYDAFKVMVGLPTTGGAPPVAPVEEAAKASA

SEQ ID NO: 7576 - protein, 377 aa, Triticum aestivum
MALSDLSRDSLLPSFLYSSRSFAAAAPRFPSSPSPYQAPASPAAAPAAGLVGAGGVGGSRPFSIRAPNEKIVMYSPAFYAACTAGGIASCGLTHMAVTPLDLVKCNMQIDPAKYKSITSGFGVLFKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKAIA

SEQ ID NO: 7577 - protein, 366 aa, Musa acuminata
MDLTERSHQSLLPTFLYSPTPASGTRALDRILGRTTASPVTAGIAASPAPVVAQAPNEPGKIEMYSPMFYAACTAGGIASCGLTHMAVTPLDLVKCNMQIDPAKYKSISSGFGVLLKEQGIRGFFRGWVPTLLGYSAQGACKFGFYEYFKKYYSDIAGPEYAAKYKTLIYLAGSASAEVIADVALCPFEAVKVRVQTQPGFARGLSDGLPKFVKSEGVMGLYKGIVPLWGRQIPYTMMKFASFETVVEMIYKYAIPTPKDQCSKTRQLGISFAGGYIAGIFCAIVSHPADNLVSFLNNAKGATVGDAVKKLGLWGLFTRGLPLRIVMIGTLTGAQWGIYDAFKVMVGLPTTGGVSPAPELAKLKAA

SEQ ID NO: 7578 - protein, 371 aa, Hordeum vulgare
MALSDLSRDSLLPSFLYSSPAARSFTAPRFPSSPSPYQAPAAAPAAGIVGAGGAGGGRPFSIRAPNEKIVMYSPAFYAACTAGGIASCGLTHMAVTPLDLVKCNMQIDPAKYKSITSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEESA

SEQ ID NO: 7579 - protein, 396 aa, Leymus cinereus x Leymus triticoides
  misc_feature (11)..(11): Xaa can be any naturally occurring amino acid
  misc_feature (41)..(42): Xaa can be any naturally occurring amino acid
  misc_feature (52)..(52): Xaa can be any naturally occurring amino acid
  misc_feature (63)..(63): Xaa can be any naturally occurring amino acid
  misc_feature (66)..(66): Xaa can be any naturally occurring amino acid
  misc_feature (207)..(207): Xaa can be any naturally occurring amino acid
LRKHRQPPRIXTRISRPGGDGALRPLPRLAPPQLPLLLPRXXLLRRRLPLPXLPVALPGARRXPGXGLGLGAGGVGGGRPFSIRAPNEKIEMYSPAFYAACTAGGIASCGLTHMAVTPLDLVKCNMQIDPAKYKSITSGFGVLLKEQGARGFFKGWVPTLLGYSAQGACKFGFYEFFKKTYSDMAGPENAVKYKTLIYLAGSASAEXIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKASA

SEQ ID NO: 7580 - protein, 371 aa, Musa acuminata
MDLAERSRQSFLPSFLYSPSPAARTLAVDRILGRSLVSPAAEVGSTSPTPIVAQAPNEPGKIEMYSPMFYAACTAGGIASCGLTHMAVTPLDLVKCNMQIDPAKYKSISSGFGVLLKEQGVRGFFRGWVPTLLGYSAQGACKFGFYEFFKKYYSDIAGPEYAAKYKTLIYLAGSASAEVIADVALCPFEAVKVRVQTQPGFARGLSDGLPKFVRSEGVSGLYKGIVPLWGRQIPYTMMKFASFETVVEMVYKYAIPTPKEQCTKTLQLGVSFAGGYIAGIFCAIVSHPADNLVSFLNNAKGATVGDAVKKLGMWGLFTRGLPLRIVMIGTLTGAQWGIYDAFKVMVGLPTTGGVAPAAAPASEVGKLKAAA

SEQ ID NO: 7581 - protein, 366 aa, Ricinus communis
MAFSDSSKQSLIPSFLYSSSSSSKTLTLSKLLHSNQQSPSPSLMRKSSGNFVIPAPSEPGKIEMYSPAFYAACTAGGILSCGLTHMTVTPLDLVKCNMQIDPAKYKSISSGFGILLKEQGVRGFFRGWVPTLLGYSAQGACKFGFYEFFKKYYSDIAGPEHAAKYKTLIYLAGSASAEVIADVALCPFEAVKVRVQTQPGFARGLSDGLPKFVKSEGALGLYKGIVPLWGRQIPYTMMKFASFETIVEMIYKHAIPTPKDQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAAPAAELAKA

SEQ ID NO: 7582 - protein, 372 aa, Elaeis guineensis
MDLSEKSRQSLLPNFLYSSSATRSLALERVVSRNPGSPAPPPSNGGASQGSFLIQAPSEPRKIALYSPAYYAACTAGGIASCGLTHTAVTPLDLVKCNMQIDPSKYKSITSGFGVLLREQGLRGFFKGWVPTLLGYSAQGACKFGFYEFFKKYYSDIAGPEFAAKYKTLIYLAGSASAEVIADVALCPMEAVKVRVQTQPGFARGLSDGFPKFVKSEGYLGLYKGLVPLWGRQIPYTMMKFASFETIVELLYKYSIPTPKDECSKTLQLGVSFAGGYIAGVFCAVVSHPADNLVSFLNNAKGATVGDAVKKLGLWGLFTRGLPLRIVMIGTLTGAQWGIYDAFKVMVGLPTTGGVAPAAAPAPEPAQLKASA

SEQ ID NO: 7583 - protein, 360 aa, Ocimum basilicum
MALSSDRQSLIPSFLYTSSFTSKSLNLHKNVAPSSSPAAASSPNGGFMIQAPSEPGKIEMYSPQFYAACTVGGILSCGLTHMAVTPLDLVKCNMQIDPAKYKSISSGFGVLLKEQGARGFFRGWVPTLLGYSAQGACKFGFYEFFKKYYSDLAGAENAAKYKTLIYLAGSASAEVIADIALCPFEAVKVRVQTQPGFARGLGDGLPKFVKSEGALGLYKGLVPLWGRQIPYTMMKFASFETIVELLYKHAIPTPKNECSKSLQLGVSFAGGYIAGVFCAIVSHPADNLVSFLNNAKGATVGDAVKKLGLWGLFTRGLPLRIVMIGTLTGAQWGIYDAFKVFVGLPTTGGPAPVAPEAAKA

SEQ ID NO: 7584 - protein, 365 aa, Citrus sinensis
MALTESYRKNSLIPSYLYSSQTSFPSTAAFNGAAAAATSPATPSTARRSFVVAAPSEPGKIEMYSPAFYAACTVGGILSCGLTHTAVTPLDLVKCNMQIDPVKYKSISSGFGVLLKEQGIRGFFRGWVPTLLGYSAQGACKFGFYEFFKKYYSDIAGPEYAAKYKTLIYLAGSASAEFIADVALCPFEAVKVRVQTQPGFARGLGDGLPKFVKSEGALGLYKGIVPLWGRQIPYTMMKFASFETIVEMIYKHAVPTPKDQCSKPLQLGISFAGGYVAGVFCAIVSHPADNLVSFLNNAKGATVGDAVKKLGLWGLFTRGLPLRIVMIGTLTGAQWGIYDAFKVFVGLPTTGGVAPAPAAAELAKV

SEQ ID NO: 7585 - protein, 373 aa, Musa acuminata
MDLSDRSRQSLIPSFLYSTAASRTIGLERNILGRSPVSKAAPAATANDGALMGSVVAQAPNEPGKIKLYSPMFYAACTAGGIASCGLTHTAVTPLDLVKCNMQIDPSKYKSISSGFGVLLKEQGVRGFFRGWVPTLLGYSAQGACKFGFYEFFKKYYSDIAGPEYAAKYKTLIYLAGSASAEVIADVALCPFEAVKVRVQTQPGFARGLSDGLPKFVRSEGALGLYKGLVPLWGRQIPYTMMKFASFETIVEMIYKYSIPRPKDQCSKELQLGVSFAGGYIAGVFCAIVSHPADNLVSFLNNAKGATVGDAVKKLGLWGLFTRGLPLRIVMIGTLTGAQWGIYDAFKVMVGLPTTGGVTPAVPATGLDKLKAA

SEQ ID NO: 7586 - protein, 368 aa, Citrullus lanatus
MALSDKPSRQSLIPSFLYSSPSSTRTLPLKKMLQSSPTLDGVSSPTKSFVIPAPTEPSKKIELYSPAFYAACTFGGILSCGLTHMAVTPLDLVKCNMQIDPAKYKSISSGFGVLLKEQGARGFFRGWVPTLLGYSAQGACKFGFYEFFKKYYSDIAGPEYAAKYKTLIYLAGSASAEVIADVALCPFEAVKVRVQTQPGFARGLSDGLPKFVRSEGALGLYKGIVPLWGRQIPYTMMKFASFETIVEMLYKYAIPTPKDQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGPAPAAPAPAAAELAKA

SEQ ID NO: 7587 - protein, 371 aa, Elaeis guineensis
MDLSEKSRQSRLPSFLYSPSATRTLGLQRVLSRNPSSPSPPPSNGASSPGSFLIQAPREPGKIEMYSPMFYAACTAGGIASCGLTHMAVTPLDLVKCNMQIDPSKYKSITSGFGVLLREQGPRGFFRGWVPTLLGYSAQGACKFGFYEFFKKYYSDIAGPEYAAKYKTLIYLAGSASAEVIADVALCPMEAVKVRVQTQPGFARGLSDGFPKFVKSEGYLGLYKGLVPLWGRQIPYTMMKFASFETIVELIYKYSIPTPKDQCSKPLQLTVSFAGGYIAGVFCAVVSHPADNLVSFLNNAKGATVGDAVKKLGLWGLFTRGLPLRIVMIGTLTGAQWGIYDAFKVFVGLPTTGGVAPAAATPELAQLKASA

SEQ ID NO: 7588 - protein, 368 aa, Unknown
  Sequence found in Organisms: Citrus sinensis, Citrus clementina
MALTESYRKNSLIPSYLYSSQTSFPSTAAFNGAAAAATSPATPSTARRSFVVAAPSEPGKIEMYSPAFYAACTVGGILSCGLTHTAVTPLDLVKCNMQIDPVKYKSISSGFGVLLKEQGIRGFFRGWVPTLLGYSAQGACKFGFYEFFKKYYSDIAGPEYAAKYKTLIYLAGSASAEFIADVALCPFEAVKVRVQTQPGFARGLGDGLPKFVKSEGALGLYKGIVPLWGRQIPYTMMKFASFETIVEMIYKHAVPTPKDQCSKPLQLGISFAGGYVAGVFCAIVSHPADNLVSFLNNAKGATVGDAVKKLGLWGLFTRGLPLRIVMIGTLTGAQWGIYDAFKVFVGLPTTGGVAPVAPAPAAAELAKV

SEQ ID NO: 7589 - protein, 363 aa, Setaria italica
MALSESSRNALLPGFLYAAPAAASPFAAAGGVGGLAVAAPSAASAAGPAVWARAPSEPGRRIEMYSPAFYAACTAGGVASCGLTHMTVTPLDLVKCNMQIDPAKYKSISSGFGVLLKEQGAKGFFRGWVPTLLGYSAQGACKFGFYEFFKKYYSDIAGPEYAAKYKTLIYLAGSASAEVIADVALCPMEAVKVRVQTQPGFARGLSDGLPKFVKSEGYSGLYKGIVPLWGRQIPYTMMKFASFETVVEMIYKYAIPSPKSECSKNLQLGVSFAGGYIAGVFCAIVSHPADNLVSFLNNAKGATVGDAVKKIGLVGLFTRGLPLRIVMIGTLTGAQWGIYDAFKVMVGLPTTGGVAPTPAPAKA

SEQ ID NO: 7590 - protein, 319 aa, Arachis hypogaea
MIPSPSEPGKIEMYSPAFYAACTAGGILSCGLTHMAVTPLDLVKCNMQIDPAKYKSISSGFGVLLKEQGLRGFFRGWVPTLLGYSAQGACKFGFYEFFKKYYSDLAGPEYATKYKTLIYLAGSASAEVIADIALCPFEAVKVRVQTQPGFARGLADGLPKFVRSEGTLGLYKGLVPLWGRQIPYTMMKFASFETIVEMIYKHAIPTPKNECSKSLQLGVSFAGGYVAGVFCAIVSHPADNLVSFLNNAKGATVGDAVQKLGLWGLFTRGLPLRIVMIGTLTGAQWGIYDAFKVFVGLPTTGGPAPSAVPTPTSAELAKA

SEQ ID NO: 7591 - protein, 368 aa, Cucurbita pepo
MALSDRPSRQSLIPSFLYSSPSSTRTLPIKKMLQSSSTFDAVSSSPKTFVIPAPSEPSKKIELYSPAFYAACTFGGILSCGLTHMTVTPLDLVKCNMQIDPAKYKSISSGFGILLKEQGVRGFFRGWVPTLLGYSAQGACKFGFYDFFKKYYTDIAGPEYAAKYKTLIYLAGSASAEVIADVALCPFEAVKVRVQTQPGFARGLADGLPKFVKSEGTLGLYKGIVPLWGRQIPYTMMKFASFETIVEMIYKYAVPAPKDQCSKSLQLGISFAGGYVAGVFCAIVSHPADNLVSFLNNAKGATVGDAVKKLGLWGLFTRGLPLRIVMIGTLTGAQWGIYDAFKVFVGLPTTGGVAPAAPTPSASELANA

SEQ ID NO: 7592 - protein, 327 aa, Pennisetum glaucum
ASGSAPSFPIQAPNEKIEMYSPAFYAACTAGGIASCGLTHMAVTPLDLVKCNMQIDPAKYKSITSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIRSEGALGLYKGIVPLWGRQIPYTMMKFASFETIVELIYKHAVPVPKSECSKSSQLGISFAGGYVAGVFCAIVSHPADNLVSFLNNAKGATVGDAVKKLGVWGLFTRGLPLRIVMIGTLTGAQWGIYDAFKVMVGLPTTGGVTPAPAPTAEEEAALKASA

SEQ ID NO: 7593 - protein, 371 aa, Cajanus cajan
MALPDSSSRRNSLIPSFIYSSSSKTLPLHQMLNSAAASSLAPPPASAAGSRGLIIPSPSESRKIELYSPAFYAACTAGGILSCGLTHMAVTPLDLVKCNMQIDPAKYKSISSGFGVLLKEQGVKGFFRGWVPTLLGYSAQGACKFGFYEFFKKYYSDIAGPEYASKYKTLIYLAGSASAEVIADIALCPFEAVKVRVQTQPGFARGLSDGLPKFVRSEGTLGLYKGLVPLWGRQIPYTMMKFASFETIVELIYKHAIPTPKNECSKGLQLGVSFAGGYIAGVLCAIVSHPADNLVSFLNNAKGATVGDAVNKLGLWGLFTRGLPLRIVMIGTLTGAQWGIYDAFKVSVGLPTTGGPAPAAAPAPGSELAKA

SEQ ID NO: 7594 - protein, 360 aa, Oryza sativa
MAVVSESSRKALLPSFLYAAPAASSSPSFAAAAAVGVRGVPAPSLAGPAVWARSPREPAGKIEMYSPAFYAACTAGGIASCGLTHMTVTPLDLVKCNMQIDPAKYKSISSGFGVLLKEQGARGFFRGWVPTLLGYSAQGACKFGFYEFFKKYYSDIAGPEYAAKYKTLIYLAGSASAEVIADIALCPMEAVKVRVQTQPGFARGLSDGLPKFVKAEGYAGLYKGIVPLWGRQIPYTMMKFASFETVVEMIYKYAIPAPKSECSKPLQLGVSFAGGYIAGVFCAIVSHPADNLVSFLNNAKGATVGDAVNKLGMWGLFTRGLPLRIVMIGTLTGAQWGLYDAFKVMVGLPTTGGVAPTPAK

SEQ ID NO: 7595 - protein, 370 aa, Hordeum vulgare
MALSDSSRHALLPSFLYAAPSAAATTTPFSAAAGIGGRGLVAPADAAATRPAVWTRAPSEPSRKIEMYSPAFYAACTAGGIASCGLTHMTVTPLDLVKCNMQINPAKYKSISSGFGVLLKEQGAKGFFRGWVPTLIGYSGQGACKFGFYEFFKKYYSDIAGPEYAAKYKTLIYLAGSASAEVIADVTLCPMEAVKVRVQTQPGFAKGLSDGLPKFVKAEGYAGLYKGIVPLWGRQIPYTMMKFASFETIVEMIYKYTIPVPKSECSKSLQLGVSFAGGYVAGVFCAIVSHPADNLVSFLNNAQGATVGDAVKKLGLWGLFTRGLPLRIVMIGTLTGAQWGIYDAFKVMVGLPTTGGVAPTPAAAGEQLKG

SEQ ID NO: 7596 - protein, 363 aa, Vitis vinifera
MATSENSRHSLIPCFLYSSSSKKSLILEKMAASPSPANGGVPKSFFVPAPSEPGKIEMYSPAFYAACTAGGILSCGLTHMAVTPLDLVKCNMQIDPAKYKSISSGFGVLLKEQGVRGFFRGWVPTLLGYSAQGACKFGFYEFFKKYYSDIAGPEYAAKYKTLIYLAGSASAEVIADVALCPMEAVKVRVQTQPGFARGLSDGFPKFVKSEGALGLYKGIVPLWGRQIPYTMMKFASFETIVEMLYKYAIPTPKDQCSKTLQLGVSFAGGYVAGVFCAIVSHPADNLVSFLNNAKGATVGDAVKNLGLWGLFTRGLPLRIVMIGTLTGAQWGLYDAFKVFVGLPTTGGIAPAPPASTTSELAKA

SEQ ID NO: 7597 - protein, 370 aa, Cucumis melo
MALSDKPSRQSLIPSFLYSSPSSTRTLPLMKMLQSSPTLDSVSSPSPKTFVIPSPTEPSKKIEMYSPAFYTACTFGGILSCGLTHMAVTPLDLVKCNMQIDPAKYKSISSGFGVLLKEQGVRGFFRGWVPTLLGYSAQGACKFGFYEFFKKYYSDIAGPEYAAKYKTLIYLAGSASAEVIADIALCPFEAVKVRVQTQPGFARGLADGLPKFVRSEGTLGLYKGIVPLWGRQIPYTMMKFASFETIVEMLYKYAIPTPKDQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGPAPAAAPAPAAAELAKA

SEQ ID NO: 7598 - protein, 372 aa, Glycine max
MALPDSSSRRNSLIPSFIYSSSSKTLPLHHMLNSASAAAPSQPPENLHAGSRGLMIPSPSESRKIEMYSPAFYAACTAGGILSCGLTHMAVTPLDLVKCNMQIDPAKYKSISSGFGVLLKEQGFRGFFRGWVPTLLGYSAQGACKFGFYEFFKKYYSDIAGPEYASKYKTLIYLAGSASAEVIADIALCPFEAVKVRVQTQPGFARGLSDGLPKFVRSEGTLGLYKGLVPLWGRQIPYTMMKFASFETIVELIYKHAIPTPKNECTKGLQLGVSFAGGYIAGVLCAIVSHPADNLVSFLNNAKGATVGDAVKKLGLWGLFTRGLPLRIVMIGTLTGAQWGIYDAFKVSVGLPTTGGPAPAAALASDAELAKA

SEQ ID NO: 7599 - protein, 370 aa, Cucumis sativus
MALSDKPSRQSLIPSFLYSSPSSTRTLPLMKMLQSSPTLDSVSSSSPKSFVIPSPTEPSKKIEMYSPAFYTACTFGGILSCGLTHMTVTPLDLVKCNMQIDPAKYKSISSGFGILLKEQGVRGFFRGWVPTLLGYSAQGACKFGFYEFFKKYYSDIAGPEYAAKYKTLIYLAGSASAEVIADIALCPFEAVKVRVQTQPGFARGLADGLPKFVRSEGTLGLYKGIVPLWGRQIPYTMMKFASFETIVEMLYKYAIPTPKDQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGPAPAAAPAPAAAELAKA

SEQ ID NO: 7600 - protein, 367 aa, Curcuma longa
MDLSERSRQSLLPSFLYSSGTLGVDRMILGRSAAAVPNVAPSGPASIGSVVVQAPNEPGKIKLYSPMFYAACTAGGIASCGLTHTAVTPLDLVKCNMQIDPAKYKSISSGFGVLLKEQGVKGFFRGWVPTLLGYSAQGACKFGFYEFFKKYYSDIAGPEYATKYKTLIYLAGSASAEVIADVALCPFEAVKVRVQTQPGFARGLSDGLPKFVKSEGALGLYKGLVPLWGRQIPYTMMKFASFETIVEMVYKYAIPKPKDQCSKELQLGVSFAGGYIAGVFCAIVSHPADNLVSFLNNAKGATVGDAVNKLGVWGLFTRGLPLRIVMIGTLTGAQWGIYDAFKVMVGLPTTGGVTPPATVTDKLKAIA

SEQ ID NO: 7601 - protein, 377 aa, Musa acuminata
MDLSEQSRRSVLPSFLYSPTSPTSRTLGLEQILGRATPASPAPPASAPGGGAPTGSFVIQAPSEPGKIEMYSPMFYAACTAGGIASCGLTHTAVTPLDLVKCNMQIDPAKYKSISSGFGVLLKEQGFRGFFRGWVPTLLGYSAQGACKFGFYEYFKKYYSDIAGPEFAAKYKTLIYLAGSASAEVIADVALCPFEAVKVRVQTQPGFARGLSDGLPRFVKSEGALGLYKGIVPLWGRQIPYTMMKFASFETVVEMVYKYAIPTPKDQCSKQLQLGVSFAGGYIAGVFCAIVSHPADNLVSFLNNAKGATVGDAVKKLGVWGLFTRGLPLRIVMIGTLTGAQWGIYDAFKVMVGLPTTGGVAPAAASSPELAELKSAA

SEQ ID NO: 7602 - protein, 370 aa, Aristolochia fimbriata
MDLMEGSRRSLLPGHLYTSSSAHSLSLDGLLSKAQTSFAPPLSNGTPKPSSFVIPAPSEPGKIQMYSPAFYAACTAGGILSCGLTHMAVTPLDLVKCNMQIDPAKYKSISSGFGVLLKEQGVRGFFRGWVPTLIGYSAQGACKFGFYEFFKKYYSDLAGPEFAVKYKTLIYLAGSASAEVIADVALCPMEAVKVRVQTQPGFARGLSDGLPKFVRSEGALGLYKGLVPLWGRQIPYTMMKFATFETIVEMIYKYSIPRPKSECSNSLQLGVSFGGGYIAGVFCAIVSHPADNLVSFLNNAKGATVGDAVKKLGLWGLFTRGLPLRIVMIGTLTGAQWGIYDAFKVFVGLPTTGGVAPAAPATELAGKAAA

SEQ ID NO: 7603 - protein, 372 aa, Manihot esculenta
MALTDSSRQSLIPSFLYASSSPKTLTLSKLLHSNSTLPSPSPSPSLMRNTSSFVIPAPSEPGKIQMYSPAFYAACTAGGILSCGLTHMAVTPLDLVKCNMQIDPAKYKGISSGFGVLLKEQGLRGFFRGWVPTLLGYSAQGACKFGFYEFFKKYYSDIAGPENAAKYKTLIYLAGSASAEVIADVALCPFEAVKVRVQTQPGFARGMADGLPKFIKSEGALGLYKGIVPLWGRQIPYTMMKFASFETIVELIYKHAIPTPKDQCSKPLQLGISFAGGYVAGVFCAIVSHPADNLVSFLNNAKGATVGDAVKKLGLWGLFTRGLPLRIVMIGTLTGAQWGIYDAFKVFVGLPTTGGAAPAAAPAVAATELAKV

SEQ ID NO: 7604 - protein, 367 aa, Platanus occidentalis
MAFSDNSRQSLVPSFLYSTSLSKKTLDLDGLLHKNRSLPSSPSNGTSKSFVIPAPSEPGKIEMYSPAFYAACTAGGILSCGLTHMTVTPLDLVKCNMQIDPAKYKSISSGFGVLLKEQGARGFFRGWVPTLLGYSAQGACKFGFYEFFKKYYSDIAGPEYAAKYKTLIYLAGSASAEVIADIALCPMEAVKVRVQTQPGFARGLSDGLPKFVRSEGYLGLYKGLVPLWGRQIPYTMMKFASFETIVEMLYKYAIPSPKDQCSKSLQLGVSFAGGYVAGVFCAIVSHPADNLVSFLNNAKGATVGDAVKKLGVWGLFTRGLPLRIVMIGTLTGAQWGIYDAFKVFVGLPTTGGVAPAAAPAATELAKV

SEQ ID NO: 7605 - protein, 375 aa, Glycine max
MALPDSSSRRNSLIPSFIYSSSSKTLPLHHMLNTASAAAAAAPSPPPANLDAGSRGLMIPSPSESRKIELYSPAFYAACTAGGILSCGLTHMTVTPLDLVKCNMQIDPAKYKSISSGFGVLLKEQGFRGFFRGWVPTLLGYSAQGACKFGFYEFFKKYYSDIAGPEYASKYKTLIYLAGSASAEVIADIALCPFEAVKVRVQTQPGFARGLSDGLPKFVRSEGTLGLYKGLVPLWGRQIPYTMMKFASFETIVELIYKHAIPTPKNECTKSLQLGVSFAGGYVAGVLCAIVSHPADNLVSFLNNAKGATVGDAVKKLGLWGLFTRGLPLRIVMIGTLTGAQWGIYDAFKVFVGLPTTGGPAPAAAPAPGSELAKA

SEQ ID NO: 7606 - protein, 369 aa, Brachypodium distachyon
MAVSESSRNALLPSFLYAVPAAATSPFSSAAGVAGSGLVVPSSAAVATRPAVWARAPSEPSGKIEMYSPAFYAACTAGGIASCGLTHMTVTPLDLVKCNMQIDPAKYKSISSGFGVLLKEQGARGFFRGWVPTLIGYSGQGACKFGFYEFFKKYYSDIAGPEYAAKYKTLIYLAGSASAEVIADIALCPMEAVKVRVQTQPGFARGLSDGLPKFVKAEGYAGLYKGIVPLWGRQIPYTMMKFASFETIVEMIYKYAIPAPKSECSKSLQLGVSFAGGYVAGVFCAIVSHPADNLVSFLNNAQGGTVGDAVKKLGLWGLFTRGLPLRIVMIGTLTGAQWGIYDAFKVMVGLPTTGGAAPPPAAAGEQLKA

SEQ ID NO: 7607 - protein, 377 aa, Vigna unguiculata
MAISDSSSGRNSLIPSFLYSSSSKTLPLHRMLHSTAAAAAAAPSAPPANLDAGSRGIMIPSPSESRKIELYSPAFYAACTAGGILSCGLTHMAVTPLDLVKCNMQIDPSKYKNITSGFGVLLKEQGFRGFFRGWVPTLLGYSAQGACKFGFYEFFKKYYSDIAGPEYASKYKTLIYLAGSASAEVIADVALCPFEAVKVRVQTQPGFARGLADGLPKFVRSEGTLGLYKGIVPLWGRQIPYTMMKFASFETIVELIYKHAIPTPKNECSKNLQLGVSFAGGYIAGVLCAIVSHPADNLVSFLNNAKGATVGDAVSKLGLWGLFTRGLPLRIVMIGTLTGAQWGIYDAFKVFVGLPTTGGPAPAAAPAAAPDSGLAKA

SEQ ID NO: 7608 - protein, 374 aa, Olea europaea
MAFLSENTRRQSLIPSFLYSSSLTSNKLALDKMASNSNPSFSPSPSSPSASAPNKSFLIPAPSEPGKIEMYSPQFYAACTAGGILSCGLTHMAVTPLDLVKCNMQIDPAKYKGISSGFGVLLKEQGVKGFFRGWVPTLLGYSAQGACKFGFYEYFKKYYSDLAGPENAVKYKTLIYLAGSASAEVIADIALCPFEAVKVRVQTQPGFARGLSDGLPKFVKSEGALGLYKGLVPLWGRQIPYTMMKFASFETIVEMIYKHAIPTPKSECSKPLQLGVSFAGGYVAGVFCAIVSHPADNLVSFLNNAKGATVGDAVKNLGLWGLFTRGLPLRIVMIGTLTGAQWGIYDAFKVFVGLPTTGGVTPAAAPVAAELAKV

SEQ ID NO: 7609 - protein, 366 aa, Nicotiana tabacum
MENSRRQSLLPSFLYTPSSFSSFTPKTFAVPENTASVLPAAQPSSTNKSFVIPAPSEPGKIEMYSPQFYAACTFGGILSCGLTHMAVTPLDLVKCNMQIDPAKYKSISSGFGVLLKEQGAKGFFRGWVPTLLGYSAQGACKFGFYEFFKKYYSDLAGAENAAKYKTLIYLAGSASAEVIADIALCPFEAVKVRVQTQPGFARGLSDGLPKFVRSEGTMGLYKGLVPLWGRQIPYTMMKFASFETIVELIYKHAVPKPKNECSKSMQLGISFAGGYIAGVFCAIVSHPADNLVSFLNNAKGATVGDAVKKIGVVGLFTRGLPLRIVMIGTLTGAQWGIYDAFKVFVGLPTTGGVAPSAPAASEVAKV

SEQ ID NO: 7610 - protein, 377 aa, Eucalyptus grandis
MAFADGSSSRQSLIPSFLYASSASSRSLYLEKMLASSGPRSAAPTAAAAASPAAADRSGFLIPAPQEPSKKIAMYSPEFYAACTFGGILSCGLTHMTVTPLDLVKCNMQIDPAKYKSISSGFGILLKEQGVRGFFRGWVPTLLGYSAQGACKFGFYEFFKKYYSDIAGPEFSAKYKTLIYLAGSASAEVIADVALCPFEAVKVRVQTQPGFARGLSDGLPKFVKSEGALGLYKGIVPLWGRQIPYTMMKFASFETIVEMIYKYAMPQPKDQCSKGLQLGVSFAGGYVAGVFCAIVSHPADNLVSFLNNAKGATVGDAVKKLGLWGLFTRGLPLRIVMIGTLTGAQWGIYDAFKVFVGLPTTGGVTPAPAPTTELAKV

SEQ ID NO: 7611 - protein, 370 aa, Triticum aestivum
MAVSDRSRNALLPSFLYAAPSAAASHTPFSAAAGIGGRGLVAPSHAAATRPAAWARAPSEPSRKIEMYSAAFYAACTDGGITSCGLTHMTVTPLDLVKCNMQIDPAKYKSISSGFGVLLKEQGAKGFFRGWVPTLIGYSGQGACKFGFYEFFKKYYSDIAGPENAVKYKTLIYLAGSASAEVIADVALCPMEAVKVRVQTQPGFAKGLSDGLPKFVKAEGYAGLYKGIVPLWGRQIPYTMMKFSSFETIVEMIYKYTIPAPKSECSKSLQLGVSFAGGYVAGVLCAIVSHPADNLVSFLNNAKGATVGDAVKKLGLWGLFTRGLPLRIVMIGTLTGAQWGIYDAFKVMVGLPTTGGVAPTPAAAGEQLKG

SEQ ID NO: 7612 - protein, 374 aa, Phaseolus coccineus
MDFSDSSSGRNSLIPSFLYSSSSKTLPLHRMLHSTAVSAAAPSPPPANLDAGSRGLMIPSPSESRKIELYSPAFYAACTAGGILSCGLTHMTVTPLDLVKCNMQIDPAKYKNISSGFGVLLKEQGFKGFFRGWVPTLLGYSAQGACKFGFYEFFKKYYSDIAGPEYASKYKTLIYLAGSASAEVIADVALCPFEAVKVRVQTQPGFARGLADGLPKFVKSEGTLGLYKGIVPLWGRQIPYTMMKFASFETIVELIYKHAIPTPKNECSKNLQLGVSFAGGYIAGVLCAIVSHPADNLVSFLNNAKGATVGDAVKKFGVWGLFTRGLPLRIVMIGTLTGAQWGIYDAFKVFVGLPTTGGPAPAAAPAPGSELVKA

SEQ ID NO: 7613 - protein, 375 aa, Castanea mollissima
MALSDKSSRQSLIPSFLYSSSSTVYTSHKSLALDKTMLGAAAAPARSNSGVSSPARNFVVPAPSEPGKIEMYSPAFYAACTAGGILSCGLTHMAVTPLDLVKCNMQIDPAKYKSISSGFGVLYKEQGFRGFFRGWVPTLLGYSAQGACKFGFYEFFKKYYSDLAGPENAAKYKTLIYLAGSASAEVIADIALCPFEAVKVRVQTQPGFARGLSDGLPKFVKSEGYGGLYKGLVPLWGRQIPYTMMKFASFETIVENIYKHAIPTPKNECSKTLQLGVSFAGGYVAGVFCAIVSHPADNLVSFLNNAKGATVGDAVKKLGVLGLFTRGLPLRIVMIGTLTGAQWGIYDAFKVFVGLPTTGGVAPAAASAATELAKA

SEQ ID NO: 7614 - protein, 366 aa, Nicotiana tabacum
MENSRRQSLLPSFLYTPSSFSSFTPKTFAVTENTTSVLPAAQPSSTNKSFVIPAPSEPGKIEMYSPQFYAACTFGGILSCGLTHMAVTPLDLVKCNMQIDPAKYKSISSGFGVLLKEQGAKGFFRGWVPTLLGYSAQGACKFGFYEFFKKYYSDLAGAENAAKYKTLIYLAGSASAEVIADIALCPFEAVKVRVQTQPGFARGLSDGLPKFVRSEGTMGLYKGLVPLWGRQIPYTMMKFASFETIVEMIYKHAVPKPKNECSKSMQLGISFAGGYIAGVFCAIVSHPADNLVSFLNNAKGATVGDAVKKIGVVGLFTRGLPLRIVMIGTLTGAQWGIYDAFKVFVGLPTTGGVAPAAPAASEVAKV

SEQ ID NO: 7615 - protein, 365 aa, Tripterygium wilfordii
MAFPDNARQSLIPSFLYSSTSGSKRISGLESFANSTHGSHQSPSRAGSVGAASNFVIPAPNEKIEMYSPSFYAACTAGGILSCGLTHMAVTPLDLVKCNMQIDPAKYKSITSGFGVLLKEQGVKGFFRGWVPTLLGYSAQGACKFGFYEFFKKYYSDIAGPENAAKYKTLIYLAGSASAELIADVALCPMEAVKVRVQTQPGFARGLSDGLPKFIKSEGALGLYKGIVPLWGRQIPYTMMKFASFETIVEMIYKHAIPTPKDQCTKSLQLGVSFAGGYVAGVLCAIVSHPADNLVSFLNNAKGATVGDAVKKLGLWGLFTRGLPLRIVMIGTLTGAQWGIYDAFKVFVGLPTTGGVTPAPAVAKA

SEQ ID NO: 7616 - protein, 360 aa, Flaveria ramosissima
MTLVNLSSLTSFTLLPFLPAVYSWPTHQTPTLLPSTSSAKHHNSFVIPAPNEPLGKIDMYSPRFYAACTVGGILSCGLTHMAVTPLDLVKCNMQIDPVKYKSISSGFGVLLKEQGLRGFFRGWVPTLLGYSAQGACKFGFYEFFKKYYSDIAGPEYAAKYKTLIYLAGSASAEVIADVALCPMEAVKVRVQTQPGFARGLGDGLPKFVRSEGALGLYKGLVPLWGRQIPYTMMKFASFETIVEMLYKYAIPTPKNECSKSLQLGVSFAGGYVAGVFCAVVSHPADNLVSFLNNAKGASVGDAVKKFGLWGLFTRGLPLRIVMIGTLTGAQWGIYDAFKVFVGLPTTGGAAPAPVAEVAEA

SEQ ID NO: 7617 - protein, 378 aa, Euonymus alatus
MAFPENARQSLIPSFLYSSTSGSKRIAGLESFANASHGSHQSPFFSSPSRAGSVGADSNFVIPSPNEKIEMYSPSFYAACTAGGILSCGLTHMTVTPLDLVKCNMQIDPAKYKSITSGFGVLLKEQGARGFFRGWVPTLLGYSAQGACKFGFYEFFKKYYSDIVGPEYAAKYKTLIYLAGSASAELIADVALCPMEAVKVRVQTQPGFARGLSDGLPKFVKSEGALGLYKGIVPLWGRQIPYTMMKFASFETIVEMIYKHAIPTPKDQCSKSLQLGVSFAGGYVAGVLCAIVSHPADNLVSFLNNAKGATVGDAVKKLGLWGLFTRGLPLRIVMIGTLTGAQWGIYDAFKVFVGLPTTGGVTPAPAVTLAPAVAKAEA

SEQ ID NO: 7618 - protein, 368 aa, Euonymus alatus
MALSDSSRQSMIPSFLYSSSSSKSFSLEKWLHANHNSNIEVPSPAPSVTTTKSHFTIPAPSEPGKIEMYSPAFYAACTVGGILSCGLTHMAVTPLDLVKCNMQIDPAKYKSISSGFGVLLKEQGVRGFFRGWVPTLLGYSAQGACKFGFYEFFKKYYSDIAGPAYAAKYKTLIYLAGSASAEVIADIALCPFEAVKVRVQTQPGFARGISDGLPKFVKSEGALGLYKGLVPLWGRQIPYTMMKFASFETIVELIYKHAIPMPKDQCSKPLQLGVSFAGGYVAGVFCAIVSHPADNLVSFLNNAKGATVGDAVKKLGLWGLFTRGLPIRIVMIGTLTGAQWGLYDAFKVFVGLPTTGGVAPAAAPLAKV

SEQ ID NO: 7619 - protein, 171 aa, Phalaenopsis aphrodite
MAFSDSSRREAFLPSFLYSPVLKSSGLERILLRNSSSQVGQTAPSTGSPPPTSFLVEAPSEPARKIEMYSPAFYAACTAGGILSCGLTHMAVTPLDLVKCNMQIDPAKYKSISSGFGVLLREQGARGFFRVGYRPCSATALRELASSAFTNFLRNIIRTLLGRSMQPSIRR

SEQ ID NO: 7620 - protein, 369 aa, Euonymus alatus
MAFPENARQSLIPSFLYSSTSGSKRISGLESFANVTHGSHQSPSRAGSVGAASNFVIPSPNEKIEMYSPTFYAACTAGGILSCGLTHMSVTPLDLVKCNMQIDPAKYKSITSGFGVLLKEQGVKGFFRGWVPTLLGYSAQGACKFGFYEFFKKYYSDIAGPEYAAKYKTLIYLAGSASAEVIADVALCPMEAVKVRVQTQPGFARGLSDGFPKFVKSEGALGLYKGLVPLWGRQIPYTMMKFASFETIVEMIYKHAIPTPKDQCSKNLQLGVSFAGGYVAGVLCAIVSHPADNLVSFLNNAKGATVGDAVKKFGLVGLFTRGLPLRIVMIGTLTGAQWGIYDAFKVFVGLPTTGGVTPAPAPAPALAKA

SEQ ID NO: 7621 - protein, 364 aa, Pennisetum glaucum
MALSESSRNALLPGFLYAAPAAASPFGAAGGVGGLAVAAPPAASATGPAVWARAPSEPGRRIEMYSPAFYAACTAGGVASCGLTHMTVTPLDLVKCNMQIDPAKYKSISSGFGVLLKEQGAKGFFRGWVPTLLGYSAQGACKFGFYEFFKKYYSDIAGPEYAAKYKTLIYLVGSASAEVIADIALCPMEAVKVRVQTQPGFARGLSDGLPKFVKSDGYSGLYKGIVPLWGRQIPYTMMKFASFETVVEMIYKYAIPAPKSECSKNLQLGVSFAGGYVAGVFCAIVSHPADNLVSFLNNAKGATVGDAVKKIGLVGLFTRGLPLRIVMIGTLTGAQWGIYDAFKVMVGLPTSGGVAPTRAAAAKA

SEQ ID NO: 7622 - protein, 364 aa, Capsicum annuum
MENFPRQSLLPSFLYSPSSSSSFFTNSKTLSAAAPETTNVLPSSNKSFLVPAPNEPGKIEMYSPQFYAACTFGGILSCGLTHMAVTPLDLVKCNMQIDPAKYKSISSGFGVLLKEQGARGFFRGWVPTLLGYSAQGACKFGFYEFFKKYYSDLAGAENAAKYKTLIYLAGSASAEVIADVALCPFEAVKVRVQTQPGFARGLSDGLPKFVRSEGPLGLYKGLVPLWGRQIPYTMMKFASFETIVELIYKHAVPKPKNECSKPMQLGISFAGGYIAGVFCAIVSHPADNLVSFLNNAKGATVGDAVQKMGVVGLFTRGLPLRIVMIGTLTGAQWGIYDAFKVFVGLPTTGGVAPAAPADSEVAKV

SEQ ID NO: 7623 - protein, 363 aa, Helianthus annuus
MAFSDKSRHSLIPNFLYSPSSSTNLLISRATNHSSFSAPSPVTDGSNFVVPAPSEPFGKIEMYSPRFYAACTAGGILSCGLTHMAVTPLDLVKCNMQIDPVKYKSISSGFGVLLKEQGVRGFFRGWVPTLLGYSAQGACKFGFYEFFKKYYSDIAGPEYATKYKTLIYLAGSASAEVIADVALCPMEAVKVRVQTQPGFARGLGDGLPKFVRSEGALGLYKGLVPLWGRQIPYTMMKFASFETIVEMFYKYAIPTPKNECSKSFQLGVSFAGGYVAGVLCAIVSHPADNLVSFLNNAKGASVGDAVKKLGVWGLFTRGLPLRIVMIGTLTGAQWGIYDAFKVFVGLPTTGGAAPPAAIEVAKS

SEQ ID NO: 7624 - protein, 378 aa, Gossypium hirsutum
MATNSDSFKQSLLPSFLYSSSPNSFSLDRLLNANSPAFSASRSTIPDAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGALGLYKGIVPLWGRQIPYTMMKFASFETIVEMIYKYGIPTPKEQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVELAKA

SEQ ID NO: 7625 - protein, 366 aa, Nicotiana benthamiana
  misc_feature (310)..(310): Xaa can be any naturally occurring amino acid
  misc_feature (354)..(354): Xaa can be any naturally occurring amino acid
MENSRRQSLLPNFLYTPSSFSSFTPKTFAVPENTTSLLPAALPSPTNKSFVIPAPSEPGKIEMYSPQFYAACTFGGILSCGLTHMAVTPLDLVKCNMQIDPAKYKSISSGFGVLLKEQGAKGFFRGWVPTLLGYSAQGACKFGFYEFFKKYYSDLAGAENAAKYKTLIYLAGSASAEVIADIALCPFEAVKVRVQTQPGFARGLSDGLPKFVRSEGTMGLYKGLVPLWGRQIPYTMMKFASFETIVEMIYKHAVPKPKNECSKSMQLGISFAGGYIAGVFCAIVSHPADNLVSFLNNAKGATVGDAVKKXGVVGLFTRGLPLRIVMIGTLTGAQWGIYDAFKVFVGLPTTGGVXPAAPAATEVAKV

SEQ ID NO: 7626 - protein, 366 aa, Euphorbia esula
MASSDSSRQSLIPSFLYSSSASSKSLSLSKVLHSNPASQNSSMMKASSHFAIPSPSEPGKIEMYSPAFYAACTAGGILSCGLTHMAVTPLDLVKCNMQIDPAKYKSISSGFGVLLKEQGARGFFRGWVPTLLGYSAQGACKFGFYEFFKKYYSDLAGPEYATKYKTLIYLAGSASAEVIADIALCPMEAVKVRVQTQPGFARGLSDGFPKFVKAEGALGLYKGLVPLWGRQIPYTMMKFASFEAIVEQLYKNVIPTPKSECSKPLQLGVSFAGGYIAGVLCAIVSHPADNLVSFLNNAKGATVGDAVKKLGVLGLFTRGLPLRIVMIGTLTGAQWGIYDAFKVFVGLPTTGGVAPVASPEAGLAKA

SEQ ID NO: 7627 - protein, 370 aa, Malus domestica
MALSDKQSRQALIPSFLYRSSSSIALEKMLYARPNGGFTPNATVEGVSARKGLVIPSPSEPLGKIEMYSPSFYAACTFGGILSCGLTHMAVTPLDLVKCNMQIDPAKYKSITSGFGILLKEQGVKGFFRGWVPTLLGYSAQGACKFGFYEFFKKYYSDLAGPEFAAKYKTLIYLAGSASAEVIADVALCPFEAVKVRVQTQPGFARGLSDGLPKFVRSEGALGLYKGLVPLWGRQIPYTMMKFASFETIVEMIYKYAIPRPKSECSKSLQLGVSFAGGYVAGVFCAIVSHPADNLVSFLNNAKGATVGDAVKKIGVVGLFTRGLPLRIVMIGTLTGAQWGIYDAFKVFVGLPTTGGAPPPVAAASELSKV

SEQ ID NO: 7628 - protein, 371 aa, Humulus lupulus
MAFSDKSSRQSLIPSFLYSSTSTKAMAVEKMLQSRPTTAVSPPDVEAVAPRKAFVVPSPAESGLKIEMYSPAFYAACTAGGILSCGLTHMSVTPLDLVKCNMQIDPAKYKSISSGFGILLKEQGVRGFFRGWVPTLLGYSAQGACKFGFYEFFKKYYSDIAGPEYAAKYKTLIYLAGSASAEVIADIALCPFEAVKVRVQTQPGFARGLSDGLPKFVKSEGALGLYKGIVPLWGRQIPYTMMKFASFETIVEMIYKYGIPTPKDQCSKELQLGVSFAGGYVAGVFCAIVSHPADNLVSFLNNAKGATVGDAVKKMGMLGLFTRGLPLRIVMIGTLTGAQWGIYDAFKVFVGLPTTGGVSPAAPAPTELAKA

SEQ ID NO: 7629 - protein, 366 aa, Cicer arietinum
MAQQSESYSGRKNMIPSFLYGSSTKTLPIHQILSNGPAPSLPGTGSAGFMIPSPKESGKIEMYSPAFYAACTAGGIFSCGLTHMTVTPLDLVKCNMQIDPAKYKSISSGFGVLLKEQGVKGFFRGWVPTLLGYSAQGACKFGFYEFFKKYYSDIAGPEYASKYKTLIYLAGSASAEVIADIALCPFEAVKVRVQTQPGFARGLGDGLPKFIKSEGTLGLYKGLVPLWGRQIPYTMMKFASFETIVEQIYKHAIPRPKNECSKSLQLGVSFAGGYIAGVLCAIVSHPADNLVSFLNNAKGATVGDAVKKFGVVGLFTRGLPLRIVMIGTLTGAQWGIYDAFKVFVGLPTTGGAAPAPVAAPAENATA

SEQ ID NO: 7630 - protein, 365 aa, Sesamum indicum
MALSSDRQSLIPNFLYSTSFTSKTLPLHNMAGHSNPRVTPSPSPSAPKSNFLIPAPGEPGKIEMFSPQYYAACTVGGILSCGLTHMAVTPLDLVKCNMQIDPAKYKSISSGFGVLLKEQGVKGFFRGWVPTLLGYSAQGACKFGFYEFFKKYYSDLAGPENASKYKTLIYLAGSASAEVIADIALCPFEAVKVRVQTQPGFARGLADGLPKFVRSEGALGLYKGLVPLWGRQIPYTMMKFASFETIVELIYKHAIPTPKNECSKNLQLGVSFAGGYVAGVFCAVVSHPADNLVSFLNNAKGATVGDAVKKLGLWGLFTRGLPLRIVMIGTLTGAQWGIYDAFKVFVGLPTTGGVTPAPTAEVAKA

SEQ ID NO: 7631 - protein, 364 aa, Flaveria ramosissima
MAVSGDSRQSLIPNFIYTSSVSPSSLLMNNTSSFTSFSSASNAKQQNKFVIPAPSEPAGKIEMYSPRFYAACTAGGILSCGLTHMAVTPLDLVKCNMQIDPAKYKSISSGFGVLLKEQGLRGFFRGWVPTLLGYSAQGACKFGFYEFFKKYYSDIAGPEYAAKYKTLIYLAGSASAEVIADVALCPMEAVKVRVQTQPGFARGLGDGLPKFVRSEGVLGLYKGLVPLWGRQIPYTMMKFASFETIVELMYKYAIPTPKNECSKSLQLGVSFAGGYVAGVLCAVVSHPADNLVSFLNNAKGASVGDAVNKLGLWGLFTRGLPLRIVMIGTLTGAQWGIYDAFKVFVGLPTTGGAAPAPVAETAKA

SEQ ID NO: 7632 - protein, 356 aa, Lotus japonicus
MAFPDSSSRRNNNLIPSFLYGSSSPKTLPLNQILSSSSTAAAAPSKLMIPAPNEKIEMYSPAFYAACTVGGILSCGLTHMTVTPLDLVKCNMQIDPTKYKSISSGFGVLLKEQGVKGFFRGWVPTLLGYSAQGACKFGFYEFFKKYYSDIAGPEYATKYKTLIYLAGSASAEVIADVALCPFEAVKVRVQTQPGFARGLSDGLPKFVKAEGTLGLYKGLVPLWGRQIPYTMMKFASFETIVEMIYKHAVPVPKSECSKNLQLGISFAGGYVAGVFCAIVSHPADNLVSFLNNAQGATVGDAVKKLGMWGLFTRGLPLRIVMIGTLTGAQWGIYDAFKVFVGLPTTGGAAPAAPAKA

SEQ ID NO: 7633 - protein, 374 aa, Amorphophallus konjac
LPPIPHPRLPLRPTSAAAVAGSPGLEKLILAGGGGAQRLLAPTPSPSPFPADGGSPKPFLIPAPKEKIQLYSGQYYAACTAGGIASCGLTHMAVTPLDLVKCNMQIDPAKYKSISSGFGVLLKEQGVRGFFRGWVPTLLGYSAQGACKFGFYEFFKKYYSDIAGPEFAAKYKTLIYLAGSASAEVIADVALCPMEAVKVRVQTQPGFARGLSDGFPKFIKSEGVLGLYKGIVPLWGRQIPYTMMKFSSFENIVEMLYKYAIPSPKDQCSKSLQLGVSFAGGYIAGVFCAIVSHPADNLVSFLNNAKGATVGDAVKKLGLWGLFTRGLPLRIVMIGTLTGAQWGIYDAFKVFVGLPTTGGVTPAPAAVKAPAPAA

SEQ ID NO: 7634 - protein, 367 aa, Fagus grandifolia
MALSDKSSRQSLIPSFLYSSSSSTILHKTFSLEKPMLGATSNNGLSSPSRNVVVPAPNEPGRKIEMYSPAFYAACTAGGILSCGLTHTAVTPLDLVKCNMQIDPSKYKSISSGFGVLLKEQGVRGFFRGWVPTLLGYSAQGACKFGFYEFFKKYYSDIAGPEFATKYKTLIYLAGSASAEVIADIALCPFEAVKVRVQTQPGFARGLSDGFPKFVKSEGALGLYKGIVPLWGRQIPYTMMKFASFETIVENIYKHAIPRPKDECSKTLQLGVSFAGGYVAGVFCAIVSHPADNLVSFLNNAKGATVGDAVKKMGVLGLFTRGLPLRIVMIGTLTGAQWGIYDAFKVFVGLPTTGGVAPAAATELAKV

SEQ ID NO: 7635 - protein, 332 aa, Triticum aestivum
PAAGLVGAGGVGGGRPFSIRAPNEKIEMYSPAFYAACTAGGIASCGLTHMAVTPLDLVKCNMQIDPAKYKSISSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEEAAKAIA

SEQ ID NO: 7636 - protein, 378 aa, Gossypium hirsutum
MATNSDSFKQSLLPSFLYSSSPNSFSLDRLLNANSPAFSASRSTIPDAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGAVGLYKGIVPLWGRQIPYTMMKFASFETIVEMIYKYGIPTPKEQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVELAKA

SEQ ID NO: 7637 - protein, 375 aa, Theobroma cacao
MASVSDSSKQSLIPSFLYASSAKSFSLDRLLSANNPAFGASHAATLDAPAVSSSPSIKTRTFMIASPNEPGKKIEMYSPQFYAACTFGGILSCGLTHMAVTPLDLVKCNMQIDPAKYKSITSGFGVLLKEQGVRGFFRGWVPTLLGYSAQGAGKFGFYEFFKKYYSDLAGPEYFSKYKTLIYLAGSASAEVIADVALCPFEAVKVRVQTQPGFARGLSDGLPKFVKSEGVLGLYKGIVPLWGRQIPYTMMKFASFETIVEMIYKYGIPTPKDQCSKSLQLGISFAGGYIAGVFCAIVSHPADNLVSFLNNAKGATVGDAVKKLGLWGLFTRGLPLRIVMIGTLTGAQWGIYDAFKVFVGLPTTGGVAPAVEVVKA

SEQ ID NO: 7638 - protein, 374 aa, Linum usitatissimum
MAFSDSSKNSLIPSFLYSSTISPKSVTLSKLLLHSNPTESVLPQSPRKPSLGSRGFAIPAPSEPFGKIELYSPAFYAACTAGGILSCGLTHMAVTPLDLVKCNMQIDPVKYKGISSGFGVLFKEQGFRGFFRGWVPTLLGYSAQGACKFGFYEFFKKYYSDIAGPEYAAKYKTLIYLAGSASAEVIADIALCPFEAVKVRVQTQPGFARGLSDGLPKFVRSEGALGLYKGIVPLWGRQIPYTMMKFASFEMVVEMIYKYAVPRPKSECSKGQQLGISFAGGYIAGVLCAIVSHPADNLVSFLNNAKGATVGDAVKKIGMVGLFTRGLPLRIVMIGTLTGAQWGIYDAFKVFVGLPTTGGAPPPAAIADSGVAKA

SEQ ID NO: 7639 - protein, 362 aa, Plantago ovata
MASDRRQSLIPNFLYSTSKFSTYSPSSAATGNSSAPPMKATAAGNGNFMIPSPSEPPLGKIEMYSPQFYAACTAGGILSCGLTHMAVTPLDLVKCNMQIDPAKYKSISSGFGVLLKEQGVRGFFRGWVPTLLGYSAQGACKFGFYEFFKKYYSDLAGPENAAKYKTLIYLAGSASAEVIADVALCPMEAVKVRVQTQPGFARGLSDGLPKFVRSEGALGLYKGIVPLWGRQIPYTMMKFASFETIVELLYKHAIPTPKNECSKPFQLGVSFAGGYVAGVLCAVVSHPADNLVSFLNNAKGSTVGDAVKKLGVWGLFTRGLPLRIVMIGTLTGAQWGIYDAFKVFVGLPTTGGAAPAEVPAKA

SEQ ID NO: 7640 - protein, 361 aa, Solanum tuberosum
MENSRRQSLLPSFLYSPTSSFSSLTPKTLAVPETTNVLPPANNNLLIPAPTEPGKIEMYSPQFYAACTFGGILSCGLTHMAVTPLDLVKCNMQIDPAKYKSISSGFGILLKEQGPRGFFRGWVPTLLGYSAQGACKFGFYEFFKKYYSDLAGAENAAKYKTLIYLAGSASAEVIADIALCPFEAVKVRVQTQPGFARGLSDGLPKFVRSEGPMGLYKGLVPLWGRQIPYTMMKFASFETIVEMIYKHAVPKPKNECSKSMQLGISFAGGYIAGVFCAIVSHPADNLVSFLNNAKGATVGDAVKKIGVLGLFTRGLPLRIVMIGTLTGAQWGIYDAFKVFVGLPTTGGVAPAVPADSEVAKV

SEQ ID NO: 7641 - protein, 378 aa, Gossypium hirsutum
MAIDSDSFKQSLLPSFLYSSAPNSFSLDRLLNANSPAFSASRSTIPGAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGALGLYKGIVPLWGRQIPYTMMKFASFETIVEMIYKYGIPTPKEQCSKNLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVEPAKA

SEQ ID NO: 7642 - protein, 370 aa, Eschscholzia californica
MTMSDNNRQSLIPSFLYSSPRRSDLVNGNRSCFPSPSSSSSSEGGVSRKSFVVAAPNEPGKIEMYSPTFYAACTVGGILSCGLTHMTVTPLDLVKCNMQIDPAKYKSISSGFGVLLKEQGARGFFRGWVPTLLGYSAQGACKFGFYEFFKKYYSDLAGPENAAKYKTLIYLAGSASAEVIADIALCPMEAVKVRVQTQPGFARGLSDGFPKFVKAEGYGGLYKGLVPLWGRQIPYTMMKFASFETIVENIYKHAIPVPKDQCSKSLQLGVSFAGGYVAGVFCAIVSHPADNLVSFLNNAKGATVGDAVKNLGLWGLFTRGLPLRIVMIGTLTGAQWGIYDAFKVFVGLPTTGGAAPAAAAAIAASEVVTA

SEQ ID NO: 7643 - protein, 377 aa, Amorphophallus konjac
MALPDRSHRQSLVPSFLYSPSSAIAAGARSTALEKLVPGRNGAAPAPMPLSPMPDGGSAANFLIPAPKEKIQLYSPQFYAACTAGGIASCGLTHMAVTPLDLVKCNMQIDPVKYKSISSGFGVLLKEQGLRGFFRGWVPTLLGYSAQGACKFGFYEYFKKYYSDLAGPENAVKYKTLIYLAGSASAEVIADVALCPMEAVKVRVQTQPGFARGLMDGLPKFVKSEGTLGLYKGIVPLWGRQIPYTMMKFASFETIVEMVYKYAIPTPKDQCSKSLQLGVSFAGGYIAGVFCAIVSHPADNLVSFLNNAKGASVGDAVKKLGLWGLFTRGLPLRIVMIGTLTGAQWGIYDAFKVFVGLPTTGGVAPAPTTPPAPAPAT

SEQ ID NO: 7644 - protein, 365 aa, Eucalyptus grandis
MALVENPSRSLIPSFLYASPSSSRGLAAEVSPAAAPSFPASVAEKRRSFVVPSPSEPGRKIEMHSPAYYAACTAGGILSCGLTHTAVTPLDLVKCNMQIDPLKYKSVTSGFGVLLKEQGVRGFFRGWAPTLLGYSAQGACKMGFYEFFKKYYSDIAGPEYASKYKTLIYLAGSASAEVIADVALCPFEAVKVRVQTQPGFARGLSDGFPKFVKSEGALGLYKGIVPLWGRQIPYTMMKFASFETIVELMYKHAIPRPKDECSKSLQLGVSFAGGYVAGVFCALVSHPADNLVSFLNNAKGATVGDAVQKLGLWGLFTRGLPLRIAMIGTLTGAQWGIYDAFKVFVGLPTTGGVAPAAAPAVLAKA

SEQ ID NO: 7645 - protein, 364 aa, Flaveria ramosissima
MAISDDSRQSLIPKFLYTSSVSPSSLLMTYTSNPTLLPSTSPAKQHNSLVIPAPNEPLGKIEMYSPRFYAACTVGGILSCGLTHMAVTPLDLVKCNMQIDPVKYKSISSGFGVLLKEQGLRGFFRGWVPTLLGYSAQGACKFGFYEFFKKYYSDIAGPEYAAKYKTLIYLAGSASAEVIADVALCPMEAVKVRVQTQPGFARGLGDGLPKFVRSEGALGLYKGLVPLWGRQIPYTMMKFASFETIVEMLYKYAIPTPKNECSKSLQLGVSFAGGYVAGVFCAVVSHPADNLVSFLNNAKGASVGDAVKKLGLWGLFTRGLPLRIVMIGTLTGAQWGIYDAFKVFVGLPTTGGAAPAPVAEVAEA

SEQ ID NO: 7646 - protein, 369 aa, Cichorium intybus
MAFSDNSRQSLIPNFLYTSSVSTSSLLMGNTSNPTLFPSTSPAKQQNNFVIPAPNEPLGKIEMYSPRFYAACTAGGILSCGLTHMTVTPLDLVKCNMQIDPVKYKSISSGFGILLKEQGVRGFFRGWVPTLLGYSAQGACKFGFYEFFKKYYSDIAGPEYATKYKTLIYLAGSASAEVIADVALCPMEAVKVRVQTQPGFARGLGDGLPKFVRSDGVLGLYKGLVPLWGRQIPYTMMKFASFETIVEMMYKYAIPTPKNECSKSLQLGVSFAGGYVAGVLCAIVSHPADNLVSFLNNAKGASVGDAVKKLGVWGLFTRGLPLRIVMIGTLTGAQWGIYDAFKVFVGLPTTGGAAPVAEVAKRRARFSIE

SEQ ID NO: 7647 - protein, 378 aa, Gossypium hirsutum
MAIDSDSFKQSLLPSFLYSSAPNSFSLDRLLNANSPAFSASRSTIPDAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGAVGLYKGIVPLWGRQIPYTMMKFASFETIVEMIYKYGIPTPKEQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVEPAKA

SEQ ID NO: 7648 - protein, 378 aa, Gossypium hirsutum
MATKSDSFKQSLLPSFLYSSSPNSFSLDRLLNANSPAFSASRSTIPDAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGALGLYKGIVPLWGRQIPYTMMKFASFETIVEMIYKYGIPTPKEQCSKNLQLGVSFAGGYVAGVFCAIVSHPADNLVSFLNNAKGATVGDAVKKLGLWGLFTRGLPLRIVMIGTLTGAQWGIYDAFKVFVGLPTTGGVAPVPAAVELAKV

SEQ ID NO: 7649 - protein, 378 aa, Gossypium raimondii
MATNSDSFKQSLLPSFLYSSSPNSFSLDRLLNANSPAFSASRSTIPDAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGALGLYKGIVPLWGRQIPYTMMKFASFETIVEMIYKYGIPTPKEQCSKNLQLGVSFAGGYVAGVFCAIVSHPADNLVSFLNNAKGATVGDAVKKLGLWGLFTRGLPLRIVMIGTLTGAQWGIYDAFKVFVGLPTTGGVAPVPAAVELAKV

SEQ ID NO: 7650 - protein, 378 aa, Gossypium raimondii
MAIDSDSFKQSLLPSFLYSSAPNSFSLDRLLNANSPAFSASRSTIPGAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGAVGLYKGIVPLWGRQIPYTMMKFASFETIVEMIYKYGIPTPKEQCSKSLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVEPAKA

SEQ ID NO: 7651 - protein, 378 aa, Gossypium hirsutum
MAIDSDSFKQSLLPSFLYSSAPNSFSLDRLLNANSPAFSASRSTIPGAPAASSSPSIKARTFMIPSPNEPGKKIEMYSPQFYAACTFGGILSCGLTHMAVTPLDLVKCNMQIDPAKYKSISSGFGVLLKEQGVRGFFRGWVPTLLGYSAQGACKFGFYEFFKKYYSDLAGPEYFAKYKTLIYLAGSASAEVIADVALCPFEAVKVRVQTQPGFARGLSDGLPKFVRSEGAVGLYKGIVPLWGRQIPYTMMKFASFETIVEMIYKYGIPTPKEQCSKNLQLGVSFAGGYVAGVFCAIVSHPADNLVSFLNNAKGATVGDAVKKLGLWGLFTRGLPLRIVMIGTLTGAQWGIYDAFKVFVGLPTTGGVAPAPAAVEPAKA

SEQ ID NO: 7652 - protein, 366 aa, Triticum aestivum
MAVSDRSRNALLPSFLYAAPSAAATSTPFSAVAGIGARGLVAPSHASATRPAAWARAPSEPSRKIEMYSPAFYAACTAGGITSCGLTHMTVTPLDLVKCNMQIDPAKYKSISSGFGVLLKEQGAKGFFRGWVPTLIGYSGQGACKFGFYEFFKKYYSDIAGPENAAKYKTLIYLAGSASAEVIADVALCPMEAVKVRVQTQPGFAKGLSDGFPKFVKAQGYAGLYKGIVPLWGRQIPYTMMKFASFETIVENIYKYAIPAPKSECSKSLQLGVSFAGGYVAGVFCAIVSHPADNLVSFLNNAQGATVGDAVKKLGLWGLFTRGLPLRIVMIGTLTGAQWGIYDAFKVMVGLPTSGGVAPPAPLESS

SEQ ID NO: 7653 - protein, 370 aa, Quercus alba
MALSDKSSRQSLIPSFLYSSSSTVSTSHKSFALDKTMLGAAAPASSNSGVSSPARNFVVPAPNEPGKIEMYSPAFYAACTAGGILSCGLTHTAVTPLDLVKCNMQIDPAKYKSISSGFGVLYKDQGVRGFFRGWVPTLLGYSAQGACKFGFYEFFKKYYSDLAGPENAAKYKTLIYLAGSASAEFIADIALCPFEAVKVRVQTQPGFARGLSDGLPKFVRSEGYGGLYKGLVPLWGRQIPYTMMKFASFETIVENIYKHAIPTPKNECSKTLQLGVSFAGGYVAGVFCAIVSHPADNLVSFLNNAKGATVSDAVNKLGVMGLFTRGLPLRIVMIGTLTGAQWGIYDAFKVFVGLPTTGGVAPAATELAKA

SEQ ID NO: 7654 - protein, 361 aa, Solanum phureja
MENSRRQSLLPSFLYSPTSSFSSLTPKTLAVPETTNVLPPANNNLLIPAPTEPGKIEMYSPQFYAACTFGGILSCGLTHMAVTPLDLVKCNMQIDPAKYKSISSGFGILLKEQGPRGFFRGWVPTLLGYSAQGACKFGFYEFFKKYYSDLAGAENAAKYKTLIYLAGSASAEVIADIALCPFEAVKVRVQTQPGFARGLSDGLPKFVRSEGPMGLYKGLVPLWGRQIPYTMMKFASFETIVEMIYKHAVPKPKNECSKSMQLGISFAGGYIAGVFCAIVSHPADNLVSFLNNAKGATVGDAVKKIGVLGLFTRGLPLRIVMIGTLTGAQWGIYDAFKVFVGLPTTGGVAPVVPADSEVAKV

SEQ ID NO: 7655 - protein, 358 aa, Solanum lycopersicum
MENSRRQSLLPSFLYSPTSSFSSLTPKTLAVPETTSVPNNNLIIPAPNEPGKIEMYSPQFYAACTFGGILSCGLTHMAVTPLDLVKCNMQIDPAKYKSISSGFGVLLKEQGPRGFFRGWVPTLLGYSAQGACKFGFYEFFKKYYSDLAGAENAAKYKTLIYLAGSASAEVIADIALCPFEAVKVRVQTQPGFARGLSDGLPKFVRSEGPMGLYKGLVPLWGRQIPYTMMKFASFETIVEMIYKHAVPKPKNECSKSMQLGISFAGGYIAGVFCAIVSHPADNLVSFLNNAKGATVGDAVKKIGVLGLFTRGLPLRIVMIGTLTGAQWGIYDAFKVFVGLPTTGGVAPAVPADSEVAKV

SEQ ID NO: 7656 - protein, 365 aa, Ambrosia trifida
MAITDNTSRQSLIPNFIYTSSVSPSSFLMPKTSNHNMFNSTAPVKQDNKFVIPAPNEPLGKIEMYSPRFYAACTAGGILSCGLTHMAVTPLDLVKCNMQIDPAKYKSISSGFGILLKEQGVRGFFRGWVPTLLGYSAQGACKFGFYEFFKKYYSDIAGPEYAARYKTLIYLAGSASAEVIADVALCPMEAVKVRVQTQPGFARGLGDGLPKFVRSEGVLGLYKGLVPLWGRQIPYTMMRFASFETIVEMMYKYAIPTPKNECSKSLQLGVSFAGGYVAGVLCAVVSHPADNLVSFLNNAKGASVGDAVKKLGVWGLFTRGLPLRIVMIGTLTGAQWGIYDAFKVFVGLPTTGGAAPAPVAETAEA

SEQ ID NO: 7657 - protein, 375 aa, Elaeis guineensis
MANTENSSLHSLLPGFLYSSSSTRSLALERLLRRSSRSPVPSSPSPAVPSIGRLPSGPFLAQAPREPGKIELYSPLYYAACTAGGIASCGLTHMAVTPLDLVKCNMQIDPAKYKSITSGFGVLLREQGLRGFFKGWVPTLLGYSAQGACKFGFYEFFKKYYSDIAGPEYAAKYKTLIYLAGSASAEVIADVALCPMEAVKVRVQTQPGFARGLADGFPKFVKSEGALGLYKGLVPLWGRQIPYTMMKFASFETIVELMYKHLIPTPKDQCSKPIQLGVSFAGGYIAGVFCAVVSHPADNLVSFLNNAKDATVGDAVKKLGLWGLFTRGLPLRIVMIGTLTGAQWGIYDAFKVFVGLPTTGGVAPPPTPSEHSKES

SEQ ID NO: 7658 - protein, 329 aa, Hordeum vulgare
APAAGIVGAGGAGGGRPFSIRAPNEKIVMYSPAFYAACTAGGIASCGLTHMAVTPLDLVKCNMQIDPAKYKSITSGFGVLLKEQGARGFFRGWVPTLLGYSAQGACKFGFYEFFKKTYSDMAGPENAVKYKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVKKIGMLGLFTRGLPLRIVMIGTLTGAQWGIYDAFKVMVGLPTTGGAPPVAPVEESA

SEQ ID NO: 7659 - protein, 364 aa, Helianthus annuus
MAVSDTSRQSLIPNFIYTSSSSPSSLLMTKTSNPSLFPSTSPAKQQNSFVIPAPNEPLGKIEMYSPRFYAACTVGGILSCGLTHMTVTPLDLVKCNMQIDPAKYKSISSGFGVLLKEQGVRGFFRGWVPTLLGYSAQGACKFGFYEFFKKYYSDIAGPEYAAKYKTLIYLAGSASAEVIADVALCPMEAVKVRVQTQPGFARGLGDGLPKFVRSEGALGLYKGLVPLWGRQIPYTMMKFASFETIVEMMYKYAIPTPKNECSKSLQLGVSFAGGYVAGVLCAVVSHPADNLVSFLNNAKGASVGDAVKKLGVWGLFTRGLPLRIVMIGTLTGAQWGIYDAFKVFVGLPTTGGAAPAPVAETAEA

SEQ ID NO: 7660 - protein, 365 aa, Euphorbia peplus
MASSDSSRQSLIPSFLYSSSASSKSLLLSKALHSNPAASQNSSTMKTTSSSHFAIPSPSEPRKIEMYSPAFYAACTAGGILSCGLTHMTVTPLDLVKCNMQIDPAKYKSISSGFGVLLKEQGARGFFRGWVPTLLGYSAQGACKFGFYEFFKKYYSDLAGPENAAKYKTLIYLAGSASAEVIADIALCPMEAVKVRVQTQPGFARGLSDGFPKFVKAEGALGLYKGLVPLWGRQIPYTMMKFASFEAIVEQIYKNVIPTPKSECSKPLQLGVSFAGGYIAGVLCAIVSHPADNLVSFLNNAKGATVGDAVKKLGVVGLFTRGLPLRIVMIGTLTGAQWGIYDAFKVFVGLPTTGGVAPVAAPDAK

SEQ ID NO: 7661 - protein, 372 aa, Thalictrum flavum
MAISENTRQSLLPSYLYSSSAYTKTLDLESFQGRNPSLPSSSPSPSSNGNVSSKSFLIQAPSEPGKIEMYSPSFYAACTAGGILSCGLTHMTVTPLDLVKCNMQIDPAKYKSISSGFGVLFKEQGVRGFFRGWVPTLLGYSAQGACKFGFYEFFKKYYSDLAGPENAAKYKTLIYLAGSASAELIADVALCPMEAVKVRVQTQPGFARGLSDGLPKFVRSEGYSGLYKGLVPLWGRQIPYTMMKFASFETIVEMMYKYAIPTPKDQCSKQLQLGVSFAGGYVAGVLCAIVSHPADNLVSFLNNAKGATVGDAVKKMGLLGLFTRGLPLRIVMIGTLTGAQWGIYDAFKVFVGLPTTGGAAPAAPASTELAKV

SEQ ID NO: 7662 - protein, 449 aa, Pennisetum glaucum
MAAGGRSVACCAAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAAASFQISVGLAGTTNKTVKVPKNFTLKTPGPGYTCGRALVGRPTKFFSPDGRRATQALMTWNVTCTYSQFLAQKTPTCCVSMSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSKDFTFEKGWAFPRRVYFNGDNCVMPSPENYPWLPNASPLTKQPLTLPLLVFWVVLATLLAYA

SEQ ID NO: 7663 - protein, 457 aa, Hordeum vulgare
MAPVGGVAGGSRSAACCAVLLAAVLFFSAPATTEAYDSLDPNGNITIKWDIISWTPDGYVATVTMFNYQQFRHISAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLKAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNLVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 7664 - protein, 457 aa, Pseudoroegneria spicata
MAPVGGVAGSSRSAACCAVLLAAVLFFSAPATTEAYDSLDPNGNITIKWDIISWTPDGYVATVTMFNYQQFRHISAPGWQLGWSWAKKEVIWSMVGAQATEQGDCSKFKSAPPHCCKRDPTVVDLLPGTPFNQQIANCCKAGVIKTFNQDPGNAASSFQISVGLAGTTNKTVKMPKNFTLKAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNLVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 7665 - protein, 451 aa, Festuca arundinacea
  misc_feature (26)..(26): Xaa can be any naturally occurring amino acid
  misc_feature (344)..(344): Xaa can be any naturally occurring amino acid
  misc_feature (376)..(376): Xaa can be any naturally occurring amino acid
MAAVGGSAAACCAVLLAAVLLFSAPXTTEAYDSLDPNGNITIKWDIISWTPDGYVATVTMFNYQQFRHIQAPGWQLGWAWAKKEVIWSMVGAQATEQGDCSKFKSSPPHCCKKEPNIVDLLPGTPFNQQIANCCKAGVIKTFNQDPANAASSFQISVGLAGTTNKTVKVPKNFTLKAPGPGYTCGRALVGKPTRFYSSDGRRATQALMTWNVTCTYSQFLAQKTPTCCVSLSSFYNDTIVNCPTCSCGCQNNVTHPGSCVNDNSPYLQSAINGPGKITGQPLVQCTSHMCPIRVHWHVKLNYKDYWRVKVTITNFNYRMNYSDWNLVAQHPNFNNITKLFSFNXKPLTPYGGRINDTAMFWGMKFYNDFLNQAGPXGNAQSEVLMQKDSETFTLDKGWAFPRRVYFNGDNCVMPSPDSYPWLPNASPLTKQPLTLPVLVFSIVLATLLAYV

SEQ ID NO: 7666 - protein, 457 aa, Triticum aestivum
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 7667 - protein, 457 aa, Secale cereale
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSTDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLATLLAYYV

SEQ ID NO: 7668 - protein, 457 aa, Triticum aestivum
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLATLLAYYV

SEQ ID NO: 7669 - protein, 457 aa, Triticum aestivum
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTAMATLLAYYV

SEQ ID NO: 7670 - protein, 457 aa, Secale cereale
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSTDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVFATLLAYYV

SEQ ID NO: 7671 - protein, 457 aa, Triticum aestivum
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLSTLLAYYV

SEQ ID NO: 7672 - protein, 447 aa, Hordeum vulgare
MAAVGGCAVLLAAALLLSAPAATEAYDSLDPTGNITIKWDIISWTPDGYVAAVTMYNYQQFRHISAPGWQLGWTWAKKEVIWSMVGAQTTEQGDCSKFKTNPPHCCKRDPTVIDLLPGTPYKDQVANCCKGGVISTFNQDPGNAASSFQISVGLAGTTNKTVKVPKNFTLKTPGPGYTCSRAIVGRPTKFLSSDRRRTTQALMTWSVTCTYSQFLAQKTPTCCVALSSFYNNTIVRCPTCSCGCQNNNTHPGSCVNANSPYLQSAIDGPGKYTGQPLVQCTSHMCPVTVHWHVKLNYKDYWRVKVTITNFNYRMNYTDWNLVVQHPNFNNITKLFSFNYKPLAPYGGRINDSAMFWGMKFYNDLLNQAGPFGNAQTEILLQKDPEIFTFEKGWAFPRRVYFNGDNCVMPPPDAYPWLPNASPLMKKPWTLELLVFWTALATLLAYYV

SEQ ID NO: 7673 - protein, 424 aa, Secale cereale
EAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSTDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLATLLAYYV

SEQ ID NO: 7674 - protein, 425 aa, Sorghum bicolor
MATGGRLAVTCSAAVLLAVALLISAPDAAEAYDSLDPNGNITIKWDVMQWTPDGYVAVVTMYNYQQFRHIGPPGWQLGWTWAKKEVIWSMVGAQATEQGDCSKFKGNIPHSCKKDPVIVDLLPSTPYDMQIANCCKAGVISTISQDPANAASSFQLSVGLSGSTTKTVKVPKNFTLRTPGPGYTCGRAIVGKPTIFFSADGRRATKALMTWNVTCTYSQFLAQKTPSCCVSLSSFYNNTTVNCPTCSCGCQNPSGSNCVNKGSPRLRSAIDGPGKWSGEPLVECTSHMCPVKINWHVKQNSKDYWRVKITITNLNFRMNYSEWNLVVQHPNFDNITQLFGLNYKPLTPYGGDINDTAMFWGVKSYNDVLMQDGKLGMVQSELLLRKDSRTFTFEKGWAFPRRVYFNGDNCVMPAPENYPSLPMQA

SEQ ID NO: 7675 - protein, 447 aa, Secale cereale
MAALSGCALLLAAALLLSAPAATEAYDSLDPNGNITIKWDLKEWTPDGYVAMVTIYNYQQFRHISAPGWQLGWTWAKKEVIWSMVGAQTTEQGDCSKFKTNPPHCCKRDPTVIDLLPGTPYKDQVGNCCKGGVISTFNQDPANAASSFQISVGLAGTTNKTVKLPKNFTLKTPGPGYTCGRAIVVRPTKFPSPDGRRMTQALMTWNVTCMYSQFLAQKTPTCCVALSSFYNNTIVSCPTCSCGCQNNNTHPGSCVNPNSPYLQSAIDGPGKYTGQPLVQCTSHMCPVKVHWHVKLNYKDYWRVKVTITNFNYRMNYTDWNLVVQHPNFNNITKLFSFNYKPLSPYGGRINDSAMFWGMKFYNDLLNQAGPFGNAQTEILLQKDPETFTFEKGWAFPRRVYFNGDNCVMPPPDAYPWLPNASPPMKQPWTLELLVFWTALATLLAYYV

SEQ ID NO: 7676 - protein, 133 aa, Saccharum officinarum
MAAAVINAPAAARCSAAGPPQLLPPRGAASSFPPSMMRKRTTGAAGRLVAVSAVGDVAAEGNTYLIAGAVAVALVGTAFPILFSRKDTCPECDGAGFIRKAGATLRANAARKDEAQIVCPNCNGLGKLGQIDK

SEQ ID NO: 7677 - protein, 136 aa, Sorghum bicolor
MAAVVNAPAATARCSAAGPQLLPVPPRGAFLLPPSMMRKRTTTGAPAGGRLVAVSAVGDVAAEGNTYLIAGAVAVALVGTAFPILFSRKDTCPECDGAGFIRKAGVRLRANAARKDQAQIVCPNCNGLGKLGQIDK

SEQ ID NO: 7678 - protein, 522 aa, Sorghum bicolor
MEMVECSLVATLAPRPLPGRVRKALPRPAVLGGRARLRVLSAGLGREQPPPPQQAGVRASGPDHGGRTLGHAAVGLAAAAVVSLTGFSGDVSPLPAPPARAESLTVAFPVSKAREVNRVQKTLVETWGLIRETFVDPTFNHQDWDQKLQQTMVEIFPLKSADAAYSKISGMLSTLGDPFTRIISPMEYQSFRIGSDGNVQGVGVFINKEPSSGRLLVMDCIQGGPADRAGIHEGDELVEIDGKSVSGLDGEAAAQRLRGRVGTTVKVKLLDGTDSERGGSLRQKEVQLSREIINLSPVSTAIISHRSDDGHECKTGYVRLASFSQTAAAEMENAVKRMEDVGVQSYILDLRNNPGGLVKAGLDVAQIWLDGDETLVNTIDRDGNVLPINMIQGHSLTHDPLVVLVNEGSASASEILAGALHDNGRAILVGHRTFGKGKIQSVTELDDGSALFITVAKYLSPALHEIDQVGIQPDIQCSPDVLSLPRAPSLKENSEATSLEMDSCIMVAEQALEIEQTKGSAS

SEQ ID NO: 7679 - protein, 523 aa, Setaria italica
MEMVECSLAATLAPRPLPGWVRKAPPRPAVLEAGRARLRVRSARREQPPLPEPVAVRSPSGTEHGGRALGQAAAGFAAAAVVSLTGFAGDMSPLPTPPPARAESLTVAFPVAKAREVNRVQKTLVEAWGLIRETFVDPTFNHQDWDQKLQQTMVEMFPLKSADAAYGKISGMLSTLGDPFTRIISPTEYQSFRIGSDGNVQGVGVFINREPSSGRLLVMDCIQGGPADRAGIHEGDELVEIDGKSVSGLDGEAAAQRLRGRVGTTVKVKLLDGADNDRGGRIRQKEVQLSREIINLSPLSTTIISHRSDDGHECKTGYVRLAAFSQTAAAEMENAVKRMEDEGVESYILDLRNNPGGLVKAGLDVAQIWLDGDETLVNTIDREGNVLPINMIQGHSLTHDPLVVLVNEGSASASEILAGALHDNGRAILVGHRTFGKGKIQSVTELDDGSALFITVAKYLSPALHEIDQVGIQPDIQCSPDILSLPRAPQLRENSEATSLEMDSCIMVAEQALGIEQTKGSAS

SEQ ID NO: 7680 - protein, 525 aa, Panicum virgatum
MEMAVECSLAATLAPRTLPGRVRKASPRPAVLAGRARLRVRSTARREHPPPPEPVALRGASGTGHGCRAVRQAAAGLAAAAVVSLTGFAGDVSTLLPPTPPARAESLTVAFPVAKAREVNRVQRTLVEAWGLIRETFVDPTFNHQDWDQKLQQTMVEMFPLKSADAAYSKISGMLSTLGDPFTRIISPMEYQSFRIGSDGNVQGVGVFINREPSSGRLLVMDCIQGGPADRAGIHEGDELVEIDGKSVSGLDGEAAAQRLRGRVGTTVKVKLLDGTENDRGGRSRQKEVQLSREIINLSPLSTTIISHRSDDGHECKTGYVRLAAFSQTAAAEMENAVKRMEDEGVESYILDLRNNPGGLVKAGLDVAQIWLDGDETLVNTIDREGNVLPINMIQGHSLTHDPLVVLVNEGSASASEILAGALHDNGRAILVGHRTFGKGKIQSVTELDDGSALFITVAKYLSPALHEIDQVGIQPDIQCSPDILSLPRAPTLRENSEATRLEMDSCIMVAEHALEIEQMKGSAS

SEQ ID NO: 7681 - protein, 523 aa, Oryza sativa
MEMVECSLPAARAPRPLPRRLPPLPGGRPALGAAGRSGSRLRVRSERTRRRDSPTMPTAASERDGGGRAALGKAAAGLAAAAVVSLTGLAAEPLSPPPPARAESLTVAFPVSKAREVNRVQRTLVEAWGLIRETFVDPTFNHQDWDMRLQQTMVEMFPLKSEDAAYGKISGMLSTLGDPFTKIISPKEYQSFRIGSDGSVQGVGVFINKEPSSGRLLVMDCIEGGPADRAGLHGGDELVEIDGKSVSGLDGEAAAQRLRGRVGTTVKVKVLDGTENERNGRIRQKEVQLSREVINLSPLSTAIISHRSDDGRECKTGYVRLAAFSQTAAAEMESAIKKMEDEGVQSYILDLRNNPGGLVKAGLDVAQMWLDGNETLVNTVDREGNVLPINMARGHSLTHDPLVVLVNEGSASASEILAGALHDNGRAILVGHRTFGKGKIQSVTELDDGSALFITVAKYLSPALHEIDQVGIQPDIQCTPEMLSLPRAPSLKEDDKATNLEMDSCIMVAEQALEIEKSKGSAS

SEQ ID NO: 7682 - protein, 515 aa, Triticum aestivum
MEMVECSLAASRAARPVPGRVPRSPAPVLGVGAGRARLRVRSERREQPPPVIRASAPPEHDGGALAKAAAGLAAAAVVSLTGFAGDLAPPPALAESLTVAFPVSKAREVNRVQRTLVEAWGLIRETFVDPTFNHQDWDQKLQQTMVEMFPLKSADAAYGKISGMVSTLGDPFTRIITPKEYQSFRIGSDGNLQGVGIFINRDPASGRLLVMNCIEGGPADRAGIREGDELVEINGNSVLGLDVEAVAQRLRGRAGTTVEVKLLDGTGNERSGRIKQKEVQLSREVINLSPLSTAIISHRSGDGHEGKTGYVRLAAFSQTAAAEMERAIKKMEDQGVQSYILDLRNNPGGLVTAGLDVAQIWLDGDETLVNTVDREGNVQAINMVQGQSLTHDPLVVLVNEESASASEILAGALHDNGRAILVGHKTFGKGRIQSVTELDDGSALFITVAKYLSPALHEIDHVGIQPDIQCTADTLSLPRAPSLTGNNEAASLEMDSCIMVAEQALEIQQSKGSAS

SEQ ID NO: 7683 - protein, 515 aa, Triticum aestivum
MEMVECSLAASRAARHVPGRVPRSPAPVLGVGAGRARLRVRSERREQPPPVVRASAPPERDGGALGKAAAGLAAAAVVSLTGFAGDLAPPPALAESLTVAFPVSKAREVNRVQRTLVEAWGLIRETFVDPTFNHQDWDQKLQQTMVEMFPLKSADAAYGKISGMVSTLGDPFTRIITPKEYQSFRIGSDGNLQGVGIFINRDPASGRLLVMNCIEGGPADRAGIREGDELVEINGNSVLGLDVEAVAQRLRGRAGTTVEVKLLDGTGNERSGRIKQKEVQLSREVINLSPLSTAIISHRSGDGHEGKTGYVRLAAFSQTAAAEMERAIKKMEDQGVQSYILDLRNNPGGLVTAGLDVAQIWLDGDETLVNTVDREGNVQAINMVQGQSLTHDPLVVLVNEESASASEILAGALHDNGRAILVGHKTFGKGRIQSVTELDDGSALFITVAKYLSPALHEIDHVGIQPDIQCTADALSLPRAPSLTGNNEAASLEMDSCIMVAEQALEIQQSKGSAS

SEQ ID NO: 7684 - protein, 512 aa, Avena sativa
MEMVECSFVAARAPRRMLPKTPPAVLGIGRARLRVRSEGLEQPPPVIRTSSPPEHDGRALGKAAAGLAAAAVVSLTGFAGDIITPPPAWAESLTVAFPVSKAREVNRVQRTLVEAWGLIRETFVDPTFNHQDWDQKLQQTMVEMFPLKSADAAYGKISGMVSTLGDPFTKIISPKEYQSFRIGSDGNLQGVGIFINTEPGSGRLLVMNCVQGGPADRAGIREGDELVEIDGNSVLGLDGEAVAQRLRGRAGTTVQVKLLDGTEIERSGRTKQKEVQLSREVINISPLSTAIISHRSGDGLEGKTGYVRLAAFSQTAAAEMESAVQRMEDEGVQSYILDLRNNPGGLVKAGLDVAQIWLDGDETLVNTVDREGNVRAINMVQGQSLTHDPLVVLVNEESASASEILAGALHDNGRAILVGHKTFGKGRIQSVTELDDGSALFITVAKYLSPALHEIDHIGIQPDIQCTPDMLSLPRVPPLSENSEAATSLEMDSCIMVAEQALEIQQSKGSVS

SEQ ID NO: 7685 - protein, 509 aa, Hordeum vulgare
MEMVECSLAASRAARPVLGRVPRSPAPFLGAGRARLRVRSERREQPPPVVRAERDGGALGKAAAGLAAAAVVSLSGFAGDFTPPPARAESLTVAFPVSKAREVNRVQRTLVEAWGLIRETFVDPTFNHQDWDQKLQQTMVEMFPLKSADAAYGKISGMVSTLGDPFTKIITPKEYQSFKIGSDGNLQGVGIFINRDPATGRLLVMNCIDGGPADRAGIHEGDELVEINGNSVLGLDVEAVAQRLRGRAGTTVEVKLLDGTGIERSGRIKQKEVQLSREVINLSPLSTTIISHRSGDGHEGKTGYVRLAAFSQTAAAEMESAIKKMEDQGVQSYILDLRNNPGGLVTAGLDVAQIWLDGDETLVNTVDREGNVQAINMVQGQSLTHDPLVVLVNEESASASEILAGALHDNGRAILVGHKTFGKGRIQSVTELDDGSALFITVAKYLSPALHEIDHIGIQPDIQCTADALSLPRAPSLTESNEAASLEMDSCIMVAEQALEIQQSKGSAS

SEQ ID NO: 7686 - protein, 528 aa, Brachypodium distachyon
MEMVECSLAAARGPRGPRALLGRVPRPSPAVLGAGRTKLRVRSERRGQPPPVVRASPPPEHDGRALGKAAVGLAAAAVVSLNGLAGDFSPPPALAESLTVAFPVSKAREVNRVQRTLVEAWGLIRETFVDPTFNHQDWDQKLQQTMVEMFPLKSADAAYGKISGMVSTLGDPFTKIISPKEYQSFRIGSDGNLQGVGIFINKEPGSGRLLVMNCIEGGPADRAGIREGDELVDIDGNSVFGLDGETVAQRLRGRAGTTVEVKLLDGTGNDRSGRTRQKEVQLRREVINLSPVSTAIISHSSGDGHEEKTGYVRLAAFSQTAAAEMESAIKKMEDEGVQSYILDLRNNPGGLVKAGLDVAQIWLDGDETLVNTVDREGNVRPINMVQGQSLTHDPLVVLVNEESASASEILAGALHDNGRAILVGHKTFGKGRIQSVTELDDGSALFITVAKYLSPALHEIDQVGIQPDIQCTPDMLSLPRAPLLSENGEAPSLEMDSCIMVAEQALEIQQSKGSASYMVSQIVALMPC

SEQ ID NO: 7687 - protein, 757 aa, Panicum virgatum
MAHEREPLLQQQQSGGGNAAGAKGSPTAAPAAAPLPSLARTVLKFLMWAVFLTWAAGIFFYPTKPVQAVFKKWVGLTRDSTFGIAGTIFLTFSAPILIIALLAYVYISFFPSDHMEKRKLRSLSFQLWTFPVLVDGPFGVVSAVEFIGIVLFIVYVVYSMTYYALESVSLVSKFDTPSKTDSELILHVIGLRLGSVGLFCMLFLFLPVARGSVLLRLIDIPFEHATRYHVWLGHLTMALFTLHGLCYVIEWSMQGLLLKKMAGWKEVGIANFPGVISLAAGLLMWVTSLHPVRKKFFELFFYTHQLYVIFVVFLALHVGDFIFSISAGAVFLFMLDRFLRFWQSRAKVDIISAACRPCGTVELVFSKPASLRYNALSFIFIQVRELSFLQWHPFSVSSSPMDGRYHMSVLIKVLGTWTEKLRSIITDVQEQNRGDSELQCGRITACVEGPYGHESPYHLMYENLILVAGGIGISPFLAILSDIIHRIEEGKQCMPKNVLVLWSVKKSKELSLLSAVDAQTISSSVSDKLRLDIQAFVTQETQAPLEDGIVGDDQKVPGMFVKNGTTMSGLVGTGDNFWAAMYFLASTLGFLLAYALVQVYYVKPHNVVAWWYLGLLFMLCMAAGVALPGGLVVLLWHLSEKRRLEDEKWDAAASQSPRAAAPAAGGDAADADAAPGVGLAALRTTRYGCRPDFEAEFAAFAERAGDAADVGVLVCGPQGLQTSVARECRARNLRRGGGAGKSGSRAVFHFNSHSFDL

SEQ ID NO: 7688 - protein, 743 aa, Setaria italica
MAHEREPLLRQQSGGGGAAAPLPSLARTVLKFLMWAVFLTWAAGIFFLPTKPVQTVFRKWISLTRDSTFGLAGGVFLTFSAPILIIALLAYVYISFFPSDHMEKRKLRSLSFRLWTLPVLVDGPFGVVSAVEFIGIVLFIIYVVYSMTYYAVESVSLIQEFHIPSMTNSELMLHIIGLRLGSVGLFCMLFLFLPVARGSVLLRLIDIPFEHATRYHVWLGHLTMALFTLHGLCYVIEWSMQGRLLEEMAEWKEIGVANLPGVISLVAGLLMWVTSLHPVRKRFFELFFYTHQLYIIFIVFLALHVGDYIFSFSAGAVFLFMLDRFLRFWQSRAKVDIISAACRPCGTVELVFSKPASLRYNALSFIFIQVRELSFLQWHPFSVSSSPMDGRYHMSVLIKVLGTWTEKLRSTITGVQEQNRGDSELQCGRITACVEGPYGHESPYHLMYENLILVAGGIGISPFLAILSDIIHRIEEGKQCMPKNVLVLWSVKKSKELSLLSAVDAQTITSFVSEKLHLDIQAFVTQESQAPLEDGIVGDEQKAPGMFVKNGTTMSGLVGTGDNFWAAMYFLASTLGFLLAYALVRVYYVKPHNVVAWWYLGLLLMLCMAAGVALPGGLVVLLWHFSEKRRLENDKWDAAASQSPRAAEQTPAGGGDDDAVPGVSLAAMRTTRYGCRPNFEAEFAAFAERAGDAADVGVLVCGPPGLQTSVARECRARNLRRGAAAEKGSSRAVFHFNSHSFDL

SEQ ID NO: 7689 - protein, 76 aa, Sorghum bicolor
MGLCSCCCRCLELLCSVLLPPLGVCLRHGCCSLEFWISVLLTILGYLPGVLYAVYVICSVDPHRHRDPDDDYVYVA

SEQ ID NO: 7690 - protein, 75 aa, Setaria italica
MGLCSCCCRCLELLCSVLLPPLGVCLRHGCCSLEFWISVLLTILGYLPGVLYAIYVICSVDPHRHDDPDDYVYVA

SEQ ID NO: 7691 - protein, 75 aa, Panicum virgatum
MGLCSCCCRCLELLCSVLLPPLGVCLRHGCCSMEFWISVLLTILGYLPGVLYAIYVICSVDPHSRRDPDDYVYVA

SEQ ID NO: 7692 - protein, 79 aa, Saccharum officinarum
MGLCSCCCRCLELLCSVLLPPLGVCLRHGCCSLEFWISVLLTILGYLPGVLYAVYVICSVDSHRHRHRDPDDDDYVYVA

SEQ ID NO: 7693 - protein, 75 aa, Panicum virgatum
MGLCSCCCRCLELLCSVLLPPLGVCLRHGCCSMEFWISVLLTILGYLPGVLYAIYVICSVDPNGRHDPDDYVYIA

SEQ ID NO: 7694 - protein, 76 aa, Triticum aestivum
MGLCSCCCRCLEILCAILLPPLGVCLRHGCCSMEFWISVLLTILGYLPGVLYAAYVICSVDPDRVRRRDDDYIYVA

SEQ ID NO: 7695 - protein, 72 aa, Pennisetum glaucum
MGCCCRCLELLCSVLLPPLGVCLRHGCCSLEFWISVVLTILGYLPGVLYAIYVICSVDPHRHDDPDDYVYVA

SEQ ID NO: 7696 - protein, 164 aa, Triticum aestivum
GDMSHIGEKGLNLSGGQRARLALARALYHDSDVYLFDDILSAVDSQVASWILEKAIMGPQMKRKTRLLSTHNLQAIYAADMIVVMANGFVKWFGTLDSFLATPYSKISNPDSSSAVSATSSQKIKDQAPLNSTLKMCLTMVQWLIRRNKEIRLKQRAGKKAWLR

SEQ ID NO: 7697 - protein, 93 aa, Triticum aestivum
MGLCSCCCRCLEIMCAILLPPLGVCLRHGCCSMEFWISVLLTILGYLPGVLYAAYVICSVDPDRVRRRDDDYIYVAEQHSSPPPPCGLSVGLG

SEQ ID NO: 7698 - protein, 76 aa, Triticum aestivum
MGLCSCCCRCLEIMCAILLPPLGVCLRHGCCSMEFWISVLLTILGYLPGVLYAAYVICSVDPDRVRRHDDDYIYVA

SEQ ID NO: 7699 - protein, 77 aa, Cynodon dactylon
MGLCSCCCRCLELLCSVLLPPLGVCLRHGCCSLEFWISVVLTVLGYVPGVLYAVYVILTVDPRGRDRDPDDDYYYVA

SEQ ID NO: 7700 - protein, 77 aa, Avena sativa
MGLCSCCCRFLEILCAILLPPLGVCLRHGCCSMEFWISVLLTILGYLPGVLYAAYVILSVDPERVRRGDPDDYIYVA

SEQ ID NO: 7701 - protein, 74 aa, Secale cereale
MCSCCCRCLEILCAILLPPLGVCLRHGCCSMEFWISVLLTILGYLPGVLYAAYVICSVDPDRVRRRDDDYIYVA

SEQ ID NO: 7702 - protein, 79 aa, Triticum aestivum
MGLCSCCCRCLEIMCAILLPPLGVCLRHGCCSMEFWISVLLTILGYLPGVLYAAYVICSVDPDRVRRRGDSDDDYIYVA

SEQ ID NO: 7703 - protein, 80 aa, Brachypodium distachyon
MGLGSCCCRCLEILCAILLPPLGVCLRHGCCSMEFWISVLLTILGYLPGVLYAAYVILSVDPDRVRRRGHDDDDDYIYVA

SEQ ID NO: 7704 - protein, 77 aa, Hordeum vulgare
MCSCCCRCLEIMCAILLPPLGVCLRHGCCSMEFWISVLLTILGYLPGVLYAAYVICSVDPERVRRRGDSDDDYIYVA

SEQ ID NO: 7705 - protein, 543 aa, Saccharum officinarum
MAGYRGGSSTAASAGGAAAAAFATRMLLLLTLLPLALAAFAFALQWRGGMRDPAGAAWPADTQRFPGMENSPLGSSSSSSHGGGGSYFAVSSSSSSPGADCAEILGRSAASSNGISLYRGWSFDSESSITPKICITGSTSAGLHQILPWLYYHKVIGVSHFFLFVEGEAAKPAVTSVLESIRGVKIIYRTKELKEKQDKSRIWNETWLSGFFYKPCNFELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKSPNEIKLEEAAILHYTYTKFSDLTSRRDRCGCKPTKEDVKRCFILEFDRLAFIIASTATEEEMRNWYREHVVWTDKDTNLKLLRKGVLTRIYAPMAIIRGLKESGVFTNAVTSAKAQSKTKSSNMGLGNEAIQLNGTGGQSTLEGGHEKLQATVRKILEMVDAQEEAMPPMSPPGFLELTESTTALS

SEQ ID NO: 7706 - protein, 547 aa, Sorghum bicolor
MAGYRGGSSTAASAGGGGGASAAAFATRMLLLLTLLPLALAAFAFALQWRGGMRDPAGAAWPADTQRFPGMENSPLGSSSSSHGGGASYFAVSSSSSSSPGADCAEILGRSAASSSNGISLYRGWNFDSESSITPKICITGSTSAGLHQILPWLYYHKVIGVSHFFLFVEGEAAKPAVTSVLESIRGVKIIYRTKELKEKQDKSRIWNETWLSGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKSPNEIKLEEAAILHYTYTKFSDLTSRRDRCGCKPTKEDVKRCFILEFDRLAFIIASTATEEEMRNWYREHVVWTDKDTNLKLLRKGVLTRIYAPMAIIRGLKESGVFTNAVTSAKAQSKTKSSNTGFGNEAIQLNGTAGQSTLEGGHEKLQATVRKILEMVDAQEEAMPPMSPPGFLELTESATALS

SEQ ID NO: 7707 - protein, 543 aa, Setaria italica
MAGYRGGSSSASSAGGGGASAAAFATRMLLLLTLLPLALAAFAFVLQWRGGMRDPAGAAWPDDTQRFPGMENSPLGSSSSSSSTRGKGSYFAVSSSSSAAADCAEILGRSASSHGVSLYGGWSFDSESSITPKICITGSTSAGLHQILPWLYYHKVIGVSHFFLFVEGEAAKPAVTSVLESIRGVKIIYRTKELKERQDKSRIWNETWLGGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKTPNEIKLEEAAILHYTYTKFSDLTSRRDRCGCKPTKEDVKRCFILEFDRLAFIIASTATEEEMRNWYREHVVWTDKDTNLKLLRKGVLTRIYAPMAIIRGLKESGIFTSAVTSAKVQSKTKSSNMGLENKESILPNVTAGQSTLEGGHEKLQATVRKILEMVDAQEEAMPPMSPPGFVELIESALS

SEQ ID NO: 7708 - protein, 530 aa, Panicum virgatum
MAGYRGASSAAGGGAGAAAFATRILLLLTLLPLALAAFAFVLQWRGGMGDPAAAAWPANKQSFPGMENSPLGSSSSSPGGGGSYFAVSSSSSAAADCAEILGRSASSNGISLYRGWNFDSESSITPKICITGSTSAGLHQILPWLYYHKVIGVSHFILFVEGEAAKPAVTSVLESIRGVKIIYRTKELKEKQDKSRIWNETWLAGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKTPNEIKLEEAAILHYTYTKFSDLTSRRDRCGCKPTKEDVKRCFILEFDRLAFIIASTATEEEMRNWYKEHVVWTDKDTNLKLLRKGVLTRIYAPMAIIRGLKESGVFTSAVTSAKAQSETKSSNMGLGGKESIIPNTTAGHEKLQATARKILEMVDAQEEAMPPLSPPGFVELTESALS

SEQ ID NO: 7709 - protein, 315 aa, Brachypodium distachyon
MEMAIVMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHMRPNGAHRWHNYMKTPNEIKLEEAAILHYTYTKFSDLTSRRDRCGCKPTKEDVKRCFILEFDRLAFIIASTATEEEMRNWYREHVVWTDKDTNLKLLRKGVLTRIYAPMAIIRGLKESGIFTAAVTSAKANSKVKSSNSLENKSVHANVTAARSTTLNERGSHNSQATARKVLEMVDIQEGAMPPMSPPGFLELVESALS

SEQ ID NO: 7710 - protein, 520 aa, Pennisetum glaucum
MLLLLTLLPLALAAFAFALQWRGGMRDPAGAAWPDDAQRFPGMENSPLGSSSSSSSARGRGSYFAVTSSSSSAAADCAEILGRSSSSSSGISLYRGWSFDSESAAVTPKICITGSTSAGLHQILPWLYYHKVIGVSHFFLFVEGEAAKPAVTSVLESIRGVKIIYRTKELKERQDKSRIWNETWLGGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKTPNEIKLEEAAILHYTYTKFSDLTSRRDRCGCKPTKEDVKRCFILEFDRLAFIIASTATEEEMRNWYREHVVWTDKDTNLKLLRKGVLTRIYAPMAIIRGLKESGVFTSAVTSAKAQSKRKSSNIMGVENKDSMLPNVTAGQSTLEGGHENLQATVRKILEMVDAQEEAMPPMSPPGFVELTESALS

SEQ ID NO: 7711 - protein, 542 aa, Oryza sativa
MAGYRGGGSASGGGGGGASSASAFATRVLLLLTLLPMALAAFAFALQWRGGMRDPAGAAWPAETQRFPGMENSPLGSSSSSSGGGGGGGSYFAVTSSQSSSAAADCAEILGRSAASSSHGGISLYRGWGFDSDAGLTPKICITGSTSAGLHQILPWLYYHKVIGVSHFFLFVEGEAAKPAVTSVLESIRGVKIIYRTKELKEKQDRSRIWNETWLAGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKTPNEIKLEEAAILHYTYTKFSDLTSRRDRCGCKPTKEDVKRCFILEFDRLAFIIASTATEEEMRNWFREHVLWNDKDTNLKLLRKGVLTRIYAPMAIIRGLKESGVFTTAVTSAKAHAKFKSSNTDLKNKESIHPNITQGDHLQATVRKILEMVDAQEEAMPPMSPPGFLHQTVETALS

SEQ ID NO: 7712 - protein, 539 aa, Triticum aestivum
MAGYRSASSSSAAGAGGAAVFAMRVLLLLTLLPLALAAFAFALQWRGGMRDPTGTVWPADTQRFPGMENSPLGSSSSSTGGRGSYFAVSSASASSAAADCAEILGRSASSHGISLYRGWSFDSDTAITPKICITGSTSASLHQILPWLYYHKVIGVSHFILFVEGEAAKPAVTSVLESIRGVKIIYRTKELKEQQDRSRIWNETWLSGFFYKPCNYELFVKQSLNMEMAIVMAREAGMDWIIHLDTDELIHPAGAREYSLRRLLLDVPDNVDMVIFPNYESSVERDDIKDPFTEVSMFKKNYDHLPKDTYFGLYKEATRGNPNYFLTYGNGKSAARVQEHMRPNGAHRWHNYMKSPNEIKLEEAAILHYTYTKFSDLTSRRDRCGCKPTKEDVKRCFILEFDRLAFIIASTATEQEMRNWYREHVVWTDKDTNLKLLRKGVLTRIYAPMAIIRGLKESGIFIDAVTSAKAHPKANIGLENNESIHTNVTAAQSTTLKEGGNDNSQATARKILEMIDVQEEAMPPMSPPGFLELMESALS

SEQ ID NO: 7713 - protein, 537 aa, Hordeum vulgare
MAGYRSTSSSAAGGGGAAVFAMRVLLLLTLLPLALAAFAFALQWRGGMRDPTGAVWPADTQRFPGMENSPLGSSSSTGGRGSYFAVSSASASSAAADCAEILGRSASSHGISLYRGWSFDSDTAITPKICITGSTSASLHQILPWLYYHKVIGVSHFILFVEGEAAKPAVTSVLESIRGVKIIFRTKELKEQQDRSRIWNETWLSGFFYKPCNYELFVKQSLNMEMAIVMAREAGMDWIIHLDTDELIHPAGAREYSLRRLLLDVPDNVDMVIFPNYESSVERDDIKDPFTEVSMFKKNYDHLPKDTYFGLYKEATRGNPNYFLTYGNGKSAARVQEHMRPNGAHRWHNYMKTPNEIKLEEAAILHYTYTKFSDLTSRRDRCGCKPTKEDVKRCFILEFDRLAFIIASTATEQEMRNWYREHVVWTDKDTNLKLLRKGVLTRIYAPMAIIRGLKESGIFINAVTSAKAHPTANIALENNKSIHTNVTAAQSTTLKEGGNDNSQATARKILEMIDVQEEAMPPMSPPGFLELIESALS

SEQ ID NO: 7714 - protein, 538 aa, Secale cereale
YSQWRLRSALPRARGGRRCSRCACSSSSLCCRSCSPRFAFALQWRGGMRDPTGTVWPADTQRFPGMENSPLGSSSSSTGGRGSYFAVSSASASSAAADCAEILGRSASTHGISLYRGWSFDSDTAITPKICITGSTSASLHQILPWLYYHKVIGVSHFILFVEGEAAKPVVTSVLESIRGVKIIYRTKELKEQQDRSRIWNETWLSGFFYKPCNYELFVKQSLNMEMAIVMAREAGMDWIIHLDTDELIHPAGAREYSLRRLLLDVPDNVDMVIFPNYESSVERDDIKDPFTEVSMFKKNYDHLPKDTYFGLYKEATRGNPNYFLTYGNGKSAARVQEHMRPNGAHRWHNYMKSPNEIKLEEAAILHYTYTKFSDLTSRRDRCGCKPTKEDVKRCFILEFDRLAFIIASTATEQEMRNWYREHVVWTDKDTNLKLLRKGVLTRIYAPMAIIRGLKESGIFIDAVTSAKAHPKANIGLESNESIHTNVTATQSTTLKEGGHDISQATARKILEMIDVQEEAMPPMSPPGFLELMESALS

SEQ ID NO: 7715 - protein, 272 aa, Sorghum bicolor
MSSLRAISSLLHIYYSSAAVRRGAGRLGFAPALGGSFRVPSNSGPPAFVLDEVARAAGGVRRRASTRAASWDSEKSPYETLELGRDADEETIKTAYRRLAKFYHPDVYDGKGTLEEGETAEARFIKIQAAYELLIDNERRRAYDRDHHVNPMKASQAWMEWVMKKRKAFDQRGDMAVAAWAEQQQREMTLRARRLSRSKVDPEEERKLFAKEKKASMEFYSTTLKRHTLVLRKRDIMRKKAEEERDNEISRLLAAEGLELDTDEDENKTFLG

SEQ ID NO: 7716 - protein, 272 aa, Saccharum officinarum
MSSLRAISSLLHIYYASAAVRRGDGRLGFATALGGSFRVPSNSAPPAFVLDEVARAAGGVRRRASTRAASWDSEKSPYETLELGRDADEETIKTAYRRLAKFYHPDVYDGKGTLEEGETAEARFIKIQAAYELLIDDERRRAYDREHHVNPMKASQAWMEWVMKKRKAFDQRGDMAVAAWAEQQQREMTLRARRLSRSKVDPEEERKLFAKEKKASMEFYSTTLKRHTLVLRKRDIMRKKAEEERDNEISRLLAAEGLELDTDEDENKTFLG

SEQ ID NO: 7717 - protein, 272 aa, Setaria italica
MNSLRAISSLLHIYSSSAAAGRSARRLGFVPALGGSFRVPSSPGPPAFVLDEVARAAGGARRRASTRAASWDSEKSPYETLELGRDADEETIKTAYRRLAKFYHPDVYDGKGTLEEGETAEARFIKIQAAYELLIDDERRRAYDREHHVNPMKASQAWMEWVMKKRKAFDQRGDMAVAAWAEQQQREMTLRARRLSRSKVDPEEERKLFAKEKKASMEFYSTTLKRHTLVLRKRDIMRKKAEEERNNEISRLLAAEGLELDTDEDEDKTFLG

SEQ ID NO: 7718 - protein, 272 aa, Brachypodium distachyon
MSSLRAISILLHTYYCSSAGRGARRLWFAPPLGGSFRAPSKAPPAFVLDEVARAAGGARKRAASTRATASWDSEKSPYETLELDRDADEDTIKTSYRRLAKFYHPDVYDGKGTLEEGETAEARFIKIQAAYELLIDDERRKAYDKEHFVNPLKASQAWMEWVMKKRKAFDKRGDMAVAAWAEQQQRELTLRARRLSRSKVDPEEERRLLAKERKASMEFYSTTLKRHTLVLRKRDLMRKKAEEDRKDEISRLLAAEGLELDTDEDDNKTFLK

SEQ ID NO: 7719 - protein, 268 aa, Secale cereale
MSSLRATSALLHTYYTSSAAAGRVGARRLGGSFRVPSKAPSAFVLDEVARAAGGVRRRAATRAASWDSEKSPYETLELERDADEETIKVAYRRLAKFYHPDVYDGKGTLEEGETAEARFIKIQAAYELLIDDERRKAYDKEHFVNPLKASQAWMEWVMKKRKAFDKRGDMAVAAWAEQQQRELTLRARRLSRSKVDPEEERRLLAKERKASMEFYSTTLKRHTLVLRKRDIMRKREEEDKMSEISRLLAAEGLELDTDEDDDDTTFLK

SEQ ID NO: 7720 - protein, 270 aa, Oryza sativa
MSGLRAISTLLHTCAAAAAGGSSRRVALAPPLGRSFRVPWRAPSAFVFDEVARAAGGERRRVSTRAASWDSEKSPYETLELDRDADEETIKTAYRRLAKFYHPDVYDGKGTLEEGETAEARFIKIQAAYELLIDDQRRKSYDREHHVNPMKASQAWMEWVMKKRKAFDQRGDMAVAAWAEQQHREMTLRARRLSRSKIDPEEERKLFAKEKKASMEFYSTTLKRHTLVLRKRDIMRKKAEEDKKKEISRLLALEGLELDTDEDDNINFLK

SEQ ID NO: 7721 - protein, 268 aa, Triticum aestivum
MSSLRATSALLHTYYTSSAAACRVGARRLGGSFRVPSKAPSAFVLDEVARAAGGVRRKAATRAASWDSEKSPYETLELERDADEETIKVAYRRLAKFYHPDVYDGKGTLEEGETAEARFIKIQAAYELLIDDERRKAYDKEHFVNPMKASQAWMEWVMKKRKAFDKRGDMAVAAWAEQQQRELTLRARRLSRSKVDPEEERRLLAKERKASMEFYSTTLKRHTLVLRKRDIMRKREEEDKMSEISRLLAAEGLELDTDEDDDDTTFLK

SEQ ID NO: 7722 - protein, 269 aa, Hordeum vulgare
MSSLRAISALLHTEYYSSSAAAGRVGPRRLGGSFRVPSKATSALVLDEVARAAGGVRRRAATRAASWDSEKSPYETLELERDADDETIKVAYRRLAKFYHPDVYDGKGTLEEGETAEARFIKIQAAYELLIDDERRKAYDKEHFVNPLKASQAWMEWVMKKRKAFDKRGDMAVAAWAEQQQRELTLRARRLSRSKVDPEEERRLLAKERKASMEFYSTTLKRHTLVLRKRDILRKREEEDKMNEISRLLAAEGLELDTDEDDDDTTFLK

SEQ ID NO: 7723 - protein, 265 aa, Avena sativa
MSGLRAISTLLHTYYYSSAAAGRGARRLVFAPRLGGGFRVPSKASVAGPAGSVRRRASTRAESWDSEKSPYETLELDRDADEDTIKTAYRRLAKFYHPDVYDGKGTLEEGETAEARFIKIQAAYELLIDDERKRAYDKDHYVNPMKASQAWMEWVMKKRKAFDKRGDMAVAAWAEQQQRELTLRARRLSRSKVDPEEERRLIAKERKSSMEFYNTTLKRHTLVLRKRDLMRKREEEDKNNEISRLLAAEGLELDTEEEDNKTFLE

SEQ ID NO: 7724 - protein, 155 aa, Sorghum bicolor
MASLSSATITAPSAFAAPAARAVARRSSFTVRASLGKAAGTAAVAVAASALLAGGAMAQEVLLGANGGVLVFEPSEFTVKAGDTITFKNNAGYPHNVVFDEDEVPSGVDATKISQEEYLNAPGETYSVTLTVPGTYGFYCEPHQGAGMVGKVTVN

SEQ ID NO: 7725 - protein, 153 aa, Saccharum officinarum
MASLSSATITAPSFAAPAARAVARRSFTVRASLGKAAGTAAVAVAASALLAGGAMAQEVLLGANGGVLVFEPSEFTVKAGDTITFKNNAGYPHNVVFDEDEVPSGVDATKISQEEYLNAPGETYSVTLTVPGTYSFYCEPHQGAGMVGKVTVN

SEQ ID NO: 7726 - protein, 153 aa, Pennisetum glaucum
MASLSSAAVTAPSFAAARPARAARRSSVVVRASLKAAGTAAVAVAASALLAGGAMAQEVLLGATGGVLVFEPSDFTVKAGDTITFKNNAGFPHNVVFDEDEVPSGVDAAKISKEEYLNAPGETFSVTLTVPGTYGFYCEPHQGAGMVGKVTVN

SEQ ID NO: 7727 - protein, 156 aa, Panicum virgatum
MASLSSAAVTAPSFAASRPARAAARRSAAFTVRASLGKAAGTAAVAVAASALLAGGAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 7728 - protein, 157 aa, Setaria italica
MASLSSAAVTAPSFAAARPARAAVASRRSSVVVRASLGKAAGTAAVAVAASALLAGGAMAQEVLLGANGGVLVFEPSEFSVKAGDTITFKNNAGYPHNVVFDEDEVPSGVDAAKISQEEYLNAPGETYSVTLTVPGTYSFYCEPHQGAGMVGKVTVN

SEQ ID NO: 7729 - protein, 807 aa, Setaria italica
MEFVEETKKRSLTVAPFECAWGEELRFREPGRGCVSFEASAHNDVTLVFRHHPGSHHYHYKMDTSRHYTVILGSHRNKRLRIQVDGATVADVAAPGLCCSNSFQAFWITICDGLITIGQGRHPNTNLLFQWLDPDPNPDVQYVGLSSWDKHVGYRNISILPAAPQYSILWTQKLLCCGKPGTADDSDQRLLADFLESWDLSDAVFVVGTERKLVPAHRIVLCASGDFPFQIADHGATIQLPSVSYPLLHSLLEYIYTGSTQIAECLLSSLLELSSHFKVKPLIKCCEEIIDCSGVDKKLSESGKILKLSSSGFQQDHKFGSFPLKDPVDAQKIGQFLANGKHSDINIYVNGHGLVAKAHKLILSLWSVPFAKMFTNGMKESSASDVFFKDVPPEAFFLLLQFMYNGELKVDTQDITSVLVQLLLLSDQFAITVLQFECCKRIMECLSEDTVCSVLQAVSSIPSCKLLEEVCKRNFATHFDYCTTACTDFVLLDEATFKDILQAIILQHGDMTVTSEERVLDAILTWCMGTCETFYWTSVDKLLRTSTPEQLFGERLSAIDTLLPFVRFPLMQLSMLKRMEISNLANHIQVFRQLVAEAIEFSHAGQWTPTSYECERFQHRRSSYKELQYISDGDSNGVIYYAGTSFGKHQWMNPVLAKNITVVASSPNSRHTDPKALVSKNYQGTCFAGPCIEDGKKISWWMVDIGQDHQLMCNYYTVRQDGSTTFMRSWVLQGSMDGRNWTSLRVHEEDATICHPGQFASWPVVGPPALLPFRFFRVALTGPAAGGSVSNAWNLCICFLELYGYLR

SEQ ID NO: 7730 - protein, 153 aa, Cynodon dactylon
MASLSSAAVTAPSFAAPARAVSRRSSLTVRASLGKVAGTAAVAVAASAMLAGGAMAQEVLLGANGGVLVFEPSEFTVKSGETITFKNNAGFPHNVVFDEDEVPSGVDISKISQEEYLNAPGETFSVTLTVPGTYGFYCEPHQGAGMVGKVTVN

SEQ ID NO: 7731 - protein, 155 aa, Panicum virgatum
MASLSSAAVTAPSFAAAARPAPRRSAAFTVRASLGKAAGTAAVAVAASALLAGGAAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 7732 - protein, 154 aa, Eragrostis curvula
MASLSSAAVTAPSFAAPARAVARRASSLSVRASLGKAAGTAAVAVAASALLAGGAMAQEVLLGANGGVLVFEPNEFSVKSGETITFKNNAGYPHNVVFDEDEVPSGVDVNKISQEEYLNAPGETFSVTLTVPGTYSFYCEPHQGAGMVGKVTVN

SEQ ID NO: 7733 - protein, 153 aa, Eragrostis curvula
MASLSSAAVTAPSFAPARAVARRASSLSVRASLGKAAGTAAVAVAASALLAGGAMAQEVLLGANGGVLVFEPNEFSVKSGETITFKNNAGYPHNVVFDEDEVPSGVDATKISQEEYLNGPGETFSVTLTVPGTYSFYCEPHQGAGMVGKVTVN

SEQ ID NO: 7734 - protein, 154 aa, Oryza sativa
MAALSSAAVTIPSMAPSAPGRRRMRSSLVVRASLGKAAGAAAVAVAASAMLAGGAMAQEVLLGANGGVLVFEPNDFTVKSGETITFKNNAGFPHNVVFDEDAVPSGVDVSKISQEEYLNAPGETFSVTLTVPGTYGFYCEPHAGAGMVGKVTVN

SEQ ID NO: 7735 - protein, 65 aa, Allium cepa
MTGSSLGMVDRLSRFSTKRQKLLRRLCSNCSVRVASITHRKQSRDASILRLEETKRAREHLCFKL

SEQ ID NO: 7736 - protein, 68 aa, Secale cereale
SAFGGGGALLVFSPRRALLPSTRRRRLGPTAASAAMVNVPKTKKTYCKNKECKKHTLPQGYPVQERQG

SEQ ID NO: 7737 - protein, 129 aa, Secale cereale
MVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGEGDISFLECFHLSGVVGGQELLLLVLRVCC

SEQ ID NO: 7738 - protein, 175 aa, Triticum aestivum
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLLRLSMTGLAWLRV

SEQ ID NO: 7739 - protein, 69 aa, Triticum aestivum
MVNVPKTKKTYCKNKECKKHTLHKVTQYKKGKDTCLPRESAVMTASSQDMVVRPSLSSTRRPRPPRRLF

SEQ ID NO: 7740 - protein, 573 aa, Triticum aestivum
MLAPLDGALGVVLAALALQLQHNLLGGFCLLVENGLGLTTVSRLLPVITTLSLGRQAVLTLLVLSDLVKGVLLALLVFAVGLLGLRNVHHGGGGGGAVLALGRLASSSAAAAVTSGWAPDSWRARPARQIPKYPDAAALGEAERTLASFPPLVFAGETRTLEERLGEAAMGRAFLLQGGDCAESFKEFGANNIRDTFRLMLQMAVVLTFGGQMPIIKVGRMAGQFAKPRSNPIETRDGVTLPSYQGDIINNDDFDEKSRAPNPQRLIRAYSQSASTLNLLRAFAHGGYADLQRVTEWNLDFLRHSTQGDRYVELAQRVHDAIGFMLAAGLPPQHPMMTTAEFWTSHECLHLPYEQALTREDSTSGLYYDCSAHMLWVGERTRQLDGAHVEFLRGISNPVGIKVSDKLDSSELVKLCEILNPHNKPGRLTLITRMGAENMRAKLPHMIRAVRQAGLIVTWVSDPMHGNTISAPCGLKTRSFDAIRAELRAFFDVHEQEGSYPGGVHLEMTGQNVTECIGGSNTVTFDDLSSRYRTHCDPRLNASQSLELAFAIAERLRKKRDRTWTSLISKVEA

SEQ ID NO: 7741 - protein, 105 aa, Unknown
  Sequence found in Organisms: Hordeum vulgare, Brachypodium distachyon, Avena sativa, Pseudoroegneria spicata, Secale cereale, Triticum aestivum
MVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7742 - protein, 105 aa, Allium cepa
MVNVPKTKKTYCKNKECKKHTLHKVTQYKKGKDSLSAQGKRRYDRKQSGYGGQTKPVFHKKAKTTKKIVLKLQCQSCKHYSQKAIKRCKHFEIGGDKKGKGTSLF

SEQ ID NO: 7743 - protein, 105 aa, Unknown
  Sequence found in Organisms: Cynodon dactylon, Saccharum officinarum
MVNVPKTKKTYCKNKECRKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7744 - protein, 133 aa, Hordeum vulgare
MWSYDGMKSLRPDYSNDDNHKHVSENLIEVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7745 - protein, 91 aa, Allium cepa
MTESSLVMVVRLSPSFTRRLKPQRKLCSSCNVRAASITLKKPSRGASILKSVETRRAREHHSSKYVFHPFCLANDLCCGFIFIVEICSVAE

SEQ ID NO: 7746 - protein, 133 aa, Allium cepa
MVNVPKTKKTYCKNKECKKHTLHKVTQYKKGKDSLSAQGKRRYDRKQSGYGGQTKPVFHKKAKTTKKIVLKLQCQSCKHYSQKAIKRCKHFEIGGDKKGKGHHSSKYVFHPFCLANDLCCGFIFIVEICSVAE

SEQ ID NO: 7747 - protein, 129 aa, Allium cepa
MVNVPKTKKTYCKNKECKKHTLHKVTQYKKGKDSLSAQGKRRYDRKQSGYGGQTKPVFHKKAKTTKKIVLKLQCQSCKHYSQKAIKRCKHFEIGGDKKGKGHHSSKYVFHSFLFSERFVLWFYLLLLNL

SEQ ID NO: 7748 - protein, 105 aa, Unknown
  Sequence found in Organisms: Zea mays, Oryza sativa, Cenchrus ciliaris, Setaria italica, Panicum virgatum
MVNVPKTKKTYCKNKECRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7749 - protein, 104 aa, Secale cereale
VNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7750 - protein, 105 aa, Picea glauca
MVNVPKTKKTFCKNKACKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7751 - protein, 128 aa, Triticum aestivum
MVNVPKTKKTYCKNKECKKHTLHKVTQYKKGKDSLSAQGKRRYDRKQSGYGGQTKPVFHKKAKTTKKIVLKLQCQSCKHYSQRAIKRCKHLRSAETRRARGHLFSRLLSPIWSGGGHEVLLLVLRVRC

SEQ ID NO: 7752 - protein, 105 aa, Leymus cinereus x Leymus triticoides
  misc_feature (3)..(3): Xaa can be any naturally occurring amino acid
MVXVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7753 - protein, 105 aa, Eragrostis curvula
  misc_feature (8)..(9): Xaa can be any naturally occurring amino acid
MVNVPKTXXTYCKNKECKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7754 - protein, 105 aa, Avena sativa
MVNVPKTRKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7755 - protein, 105 aa, Avena sativa
MVNVPKTKRTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7756 - protein, 69 aa, Avena sativa
MVNVPKTKKTYCKNKECKKHTLHKVTQYKKGKDSLSAQGKRRYDRKQSGYGGQTKPVFHKKAKPPRRLC

SEQ ID NO: 7757 - protein, 85 aa, Ananas comosus
MAETWWTLLDDLVCGGFVYHCRSLFCAGVSAAIVVLVIHSFPWWFLPMQPFAKYICFIGERSKDEEDILQEQGMSEAHPPQGHSV

SEQ ID NO: 7758 - protein, 107 aa, Allium cepa
MVNVPKTKKTYCKNKECKKHTLHKVTQYKKGKDSLSAQGKRRYDRKQSGYGGQTKPVFHKKAKTTKKIVLKLQCQSCKHYSQKAIKRCKHFEIGGDKKGKGTSLFKL

SEQ ID NO: 7759 - protein, 69 aa, Picea glauca
MVNVPKTKKTFCKNKACKKHTLHKVTQYKKGKDSLSAQGKRGMIENNQVMEAKQNLCFTRRQKQQRRLC

SEQ ID NO: 7760 - protein, 131 aa, Amorphophallus konjac
GRGKTLGSGAAKKATSRSSKAGLQFPVGRIARFLKAGKYAERIGAGAPVYLAAVLEYLAAEVLELAGNAARDNKKTRIVPRHIQLAVRNDEELSKLLGAVTIASGGVMPNIHNLLLPKKTGAGSKSSADES

SEQ ID NO: 7761 - protein, 105 aa, Musa acuminata
MVNVPKTKKTYCKNKACKKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7762 - protein, 105 aa, Unknown
  Sequence found in Organisms: Epimedium sagittatum, Fagopyrum esculentum, Carpinus betulus, Tropaeolum majus
MVNVPKTKKTYCKNKECKKHTLHKVTQYKKGKDSLAAQGKRRYDRKQSGYGGQTKPVFHKKAKTTKKIVLRLQCQSCKHVSQHAIKRCKHFEIGGDKKGKGTSLF

SEQ ID NO: 7763 - protein, 105 aa, Unknown
  Sequence found in Organisms: Chelidonium majus, Eschscholzia californica
MVNVPKTKKTYCKNKECKKHTLHKVTQYKKGKDSLAAQGKRRYDRKQSGYGGQTKPVFHKKAKTTKKIVLRLQCQSCKHMSQHAIKRCKHFEIGGDKKGKGTSLF

SEQ ID NO: 7764 - protein, 105 aa, Elaeis guineensis
MVNVPKTKKTYCKNKACRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7765 - protein, 105 aa, Elaeis guineensis
MVNVPKTKKTYCKNKQCRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7766 - protein, 105 aa, Elaeis guineensis
MVNVPKTKKTYCKSKECRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7767 - protein, 104 aa, Oryza sativa
VNVPKTKKTYCKNKECRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7768 - protein, 105 aa, Sorghum bicolor
MVNVPKTKKTYCKNKECRKHTLHKVTQYKKGKDSLAAQGKRRYDRKQSGYGGQTKPVFHKKAKTTKKIVLKLQCQSCKHYSQHPIKRCKHFEIGGDKKGKGTSLF

SEQ ID NO: 7769 - protein, 105 aa, Picea glauca
MVNVPKTKKTFCKNKACKKHTLHKVTQYKKGRDSLSAQGKRRYDRKQSGYGGQTKPVFHKKAKTTKKIVLKLQCQSCKHYSQHAIKRCKHFEIGGDKKGKGTSLF

SEQ ID NO: 7770 - protein, 105 aa, Amorphophallus konjac
MVNVPKTKKTYCKNKECRKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7771 - protein, 105 aa, Festuca arundinacea
MVNVPKTRKTYCKNKECGKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7772 - protein, 105 aa, Phalaenopsis aphrodite
MVNVPKTKKTYCKNKQCRKHTLHKVTQYKKGKDSLSAQGKRRYDRKQSGYGGQTKPVFHKKAKTTKKIVLKLQCQSCKHFSQHAIKRCKHFEIGGDKKGKGTSLF

SEQ ID NO: 7773 - protein, 105 aa, Pinus taeda
MVNVPKTKKTFCKNKACKKHTVHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7774 - protein, 105 aa, Pseudotsuga menziesii
MVNVPKTKKTFCKNKACKKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7775 - protein, 105 aa, Musa acuminata
MVNVPKTKKTYCKNKACRKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7776 - protein, 105 aa, Fagus grandifolia
MVNVPKTKKTYCKSKECKKHTLHKVTQYKKGKDSLAAQGKRRYDRKQSGYGGQTKPVFHKKAKTTKKIVLRLQCQSCKHMSQHAIKRCKHFEIGGDKKGKGTSLF

SEQ ID NO: 7777 - protein, 105 aa, Unknown
  Sequence found in Organisms: Aristolochia fimbriata, Cleome gynandra, Cleome spinosa, Populus trichocarpa
MVNVPKTKKTYCKNKECKKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7778 - protein, 105 aa, Curcuma longa
MVNVPKTKKTYCKNKACRKHTLHKVTQYKKGKDRLSAQGKRRYDRKQSGYGGQTKPVFHKKAKTTKKIVLKLQCQSCKHYSQHPIKRCKHFEIGGDKKGKGTSLF

SEQ ID NO: 7779 - protein, 105 aa, Fagopyrum esculentum
MVNVPKTKKTYCKNKECKKHTLHKVTQYKKGKDSLAAQGKRRYDRKQSGYGGQTKPVFHKKAKTTKKIVLRLQCQSCKHVSQHSIKRCKHFEIGGDKKGKGTSLF

SEQ ID NO: 7780 - protein, 105 aa, Unknown
  Sequence found in Organisms: Humulus lupulus, Primula obconica
MVNVPKTKKTYCKNKECKKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7781 - protein, 105 aa, Pinus pinaster
MVNVPKTKKTFCKNKACRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 7782 - protein, 105 aa, Phalaenopsis aphrodite
MVNVPKTKKTYCKNKACKKHTLHKVTQYKKGKDSLSVQGKRRYDRKQSGYGGQTKPVFHKKAKTTKKIVLKLQCQSCKHFSQHPIKRCKHFEIGGDKKGKGTSLF

SEQ ID NO: 7783 - protein, 105 aa, Populus trichocarpa
MVNVPKTKKTYCKNKECKKHTLHKVTQYKKGKDSLAAQGKRRYDRKQSGYGGQTKPVFHKKAKTTKKIVLRLQCQACKHVSQHAIKRCKHFEIGGDKKGKGTSLF

SEQ ID NO: 7784 - protein, 105 aa, Pseudotsuga menziesii
MVNVPKTKKTFCKNKACKKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7785 - protein, 105 aa, Senecio madagascariensis
MVNVPKTKKTYCKNKECKKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7786 - protein, 105 aa, Thalictrum flavum
MVNVPKTKKTYCKNKECKKHTLHKVTQYKKGKDSLAAQGKRRYDRKQSGYGGQTKPVFHKKAKTTKKIVLRLQCQSCKHVSQHALKRCKHFEIGGDKKGKGTSLF

SEQ ID NO: 7787 - protein, 130 aa, Fagus grandifolia
MVNVPKTKKTYCKSKECKKHTLHKVTQYKKGKDSLAAQGKRRYDRKQSGYGGQTKPVFHKKAKTTKKIVLRLQCQSCKHMSQHAIKRCKHFEIGGDKKGKGTSLFKLTLSCYFYCWLVFSKENVWQDYVV

SEQ ID NO: 7788 - protein, 70 aa, Humulus lupulus
MVNVPKTKKTYCKNKECKKHTLHKVTQYKKGKDSLAAQGKRRYDRKQSRLWRSDQASLSQEGQNHQEDCS

SEQ ID NO: 7789 - protein, 70 aa, Humulus lupulus
MVNVPKTKKTYCKNKECKKHTLHKVTQYKKGKDSLAAQGKRRYDRKQSGYGGQTKPVFHKKAKNHQEDCS

SEQ ID NO: 7790 - protein, 70 aa, Humulus lupulus
MVNVPKTKKTYCKNKECKKHTLHKVTQYKKGKDSLAAQGKRRYDRETVRLWRSDQASLSQEGQNHQEDCS

SEQ ID NO: 7791 - protein, 128 aa, Eragrostis curvula
RVARQPRLSFGSPRPRTGENRGRQPGERPKPRRPTAEQGVKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7792 - protein, 71 aa, Elaeis guineensis
NDGERSKKQRRLIARIRHAVSILFTRLPSIKKARIVCLLKESVVTTANSQVMVVRQSLFSTRRQKQPRKLC

SEQ ID NO: 7793 - protein, 116 aa, Secale cereale
MVNVPKTKKTYCKNKECKKHTLHKVTQYKKGKDSLSAQGKRRYDRKQSGYGGQTKPVSTRRPRHKEDCAEVAVPELQALLTARHQEVQALRNRWRQEGKGHLSSKLMMSLLCLDCC

SEQ ID NO: 7794 - protein, 147 aa, Cucurbita pepo
MVNVPKTKKTYCKSKECKKHTLHKVTQYKKGKDSLAAQGKRRYDRKQSGYGGQTKPVFHKKAKTTKKIVLRLQCQGCKHVSQHAIKRCKHFEIGGDKKGKGTSLFRCFNIVIHYILVFREPKLWVSSALCFCLVILIFVNTLPVEFV

SEQ ID NO: 7795 - protein, 148 aa, Cucurbita pepo
MVNVPKTKKTYCKSKECKKHTLHKVTQYKKGKDSLAAQGKRRYDRKQSGYGGQTKPVFHKKAKTTKKIVLRLQCQGCKHVSQHAIKRCKHFEIGGDKKGKGTSLFRCFNIVIHYILVFREPKLWVSSALCFLFGYSDICEHFYLLNFV

SEQ ID NO: 7796 - protein, 63 aa, Humulus lupulus
MTGNSLVMEVRLSQSFTRRPKTTKKIVLRLQCQGCKHVSQHAIKRCKHFEIGGDKKGKGTSLF

SEQ ID NO: 7797 - protein, 127 aa, Humulus lupulus
MVNVPKTKKTYCKNKECKKHTLHKVTQYKKGKDSLAAQGKRRYDRKQSGYGGQTKPVFHKKAKTTKKIVLRLQCQGCKHVSQHAIKRCKHFEIGGDKKGRDFSFLNLCYYVIFVLWILNRVMGYLLT

SEQ ID NO: 7798 - protein, 70 aa, Humulus lupulus
MVNVPKTKKTYCKNKECKKHTLHKVTQYKKGKDSLAAQGKRRYDRKQYRLWRSDQASLSQEGQNHQEDCS

SEQ ID NO: 7799 - protein, 88 aa, Lolium multiflorum
MVNVPKTRKTYCKNKECKKHTLHKVTQYKKGKDSLSAQGKRRYDRKQSGYGGQTKPVFHKKAKTTKKIVLKLQCQSCKQACHQEVQAL

SEQ ID NO: 7800 - protein, 71 aa, Zea mays
MSAQGKRRYDRKQSGHGGQTKPVFHKKAKTTKKIVLKLQCQSCKHYSQHAIKRCKHFEIGGDKNGKGTSLF

SEQ ID NO: 7801 - protein, 135 aa, Pinus pinaster
MVNVPKTKKTFCKNKACKKHTVHKVTQYKKGKDSLSAQGKRRYDRKQSGYGGQTKPVFHKKAKTTKKIVLKLQCQSCKHYSQHAIKRCKHFEIGGDKKGKEPPFLNFSFVAALCPSFYILVRMSVEGQKFCCVVY

SEQ ID NO: 7802 - protein, 154 aa, Pinus taeda
MVKAKANKSAKKHPRCIADGNELLRFHCITFSCSLGMNGLTNLCNIPSCNVCNIIRHGFSSKVENGKGIYTTASSGKAHDSIEVSEEDESKDKRAMLVCRVIAGRVNKSQDPDECFNGGYDSLAGQAGIYSNLDELFVFNPKAVLPCFVVMYKV

SEQ ID NO: 7803 - protein, 105 aa, Amborella trichopoda
MVNVPKTKKTYCKNKECKKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7804 - protein, 105 aa, Unknown
  Sequence found in Organisms: Cannabis sativa, Cucurbita pepo, Ipomoea batatas, Ipomoea nil, Salvia sclarea
MVNVPKTKKTYCKSKECKKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7805 - protein, 105 aa, Papaver somniferum
MVNVPKTKNTYCKNKECRKHTLHKVTQYKKGKDSLAAQGKRRYDRKQSGYGGQTKPVFHKKAKTTKKIVLRLQCQSCKHMSQHAIKRCKHFEIGGDKKGKGTSLF

SEQ ID NO: 7806 - protein, 105 aa, Picea glauca
MVNVPKTKKTFCKNKACKKHTLHKVTQYKKGKDSLAVQGKRRYDRKQSGYGGQTKPVFHKKAKTTKKIVLKLQCQSCKHYSQHPIKRCKHFEIGGDKKGKGTSLF

SEQ ID NO: 7807 - protein, 105 aa, Abies balsamea
MVNVPKTKKTFCKNKACKKHTLHKVTQYKKGKDSLCVQGKRRYDRKQSGYGGQTKPVFHKKAKTTKKIVLKLQCQSCKHYSQHPIKRCKHFEIGGDKKGKGTSLF

SEQ ID NO: 7808 - protein, 105 aa, Abies balsamea
MVNVPKTKKTFCKNKACRKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7809 - protein, 105 aa, Ambrosia trifida
MVNVPKTKKTYCKNKECRKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7810 - protein, 105 aa, Persea americana
MVNVPKTKKTYCKSKECRKHTLHKVTQYKKGKDSLSVQGKRRYDRKQSGYGGQTKPVFHKKAKTTKKIVLRLQCQSCKHVSQHAIKRCKHFEIGGDKKGKGTSLF

SEQ ID NO: 7811 - protein, 105 aa, Theobroma cacao
MVNVPKTKKTYCKNKECKKHTLHKVTQYKKGKDSLAAQGKRRYDRKQSGYGGQTKPVFHKKAKTTKKIVLRLQCQACKHVSQHPIKRCKHFEIGGDKKGKGTSLF

SEQ ID NO: 7812 - protein, 105 aa, Cedrus atlantica
MVNVPKTKKTFCKNKACRKHTLHKVTQYKKGKDSLAAQGKRRYDRKQSGYGGQTKPVFHKKAKTTKKIVLKLQCQSCKHYSQHPIKRCKHFEIGGDKKGKGTSLF

SEQ ID NO: 7813 - protein, 105 aa, Euphorbia peplus
MVNVPKTKKTYCKSKECKKHTLHKVTQYKKGKDSLSAQGKRRYDRKQSGYGGQTKPVFHKKAKTTKKIVLRLQCQGCKHVSQHPIKRCKHFEIGGDKKGKGTSLF

SEQ ID NO: 7814 - protein, 104 aa, Zingiber officinale
  misc_feature (40)..(40): Xaa can be any naturally occurring amino acid
VNVPKTKKTYCKNKACKKHTLHKVTQYKKGKDRLSAQGKXRYDRKQSGYGGQTKPVFHKKAKTTKKIVLKLQCQSCKHYSQHPIKRCKHFEIGGDKKGKGTSLF

SEQ ID NO: 7815 - protein, 105 aa, Unknown
  Sequence found in Organisms: Mimulus guttatus, Triphysaria pusilla
MVNVPKTKKTFCKSKECKKHTLHKVTQYKKGKDSLAAQGKRRYDRKQSGYGGQTKPVFHKKAKTTKKIVLRLQCQSCKHMSQHAIKRCKHFEIGGDKKGKGTSLF

SEQ ID NO: 7816 - protein, 105 aa, Carica papaya
MVNVPKTKKTYCKSKECKKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7817 - protein, 105 aa, Pisum sativum
MVNVPKTKKTYCKNKECKKHTLHKVTQYKKGKDSIAAQGKRRYDRKQSGYGGQTKPVFHKKAKTTKKIVLRLQCQGCKHVSQHAIKRCKHFEIGGDKKGKGTSLF

SEQ ID NO: 7818 - protein, 105 aa, Tamarix hispida
MVNVPKTKKTYCKNKDCKKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7819 - protein, 105 aa, Solanum lycopersicum
MVNVPKTKKTYCKSKECKKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7820 - protein, 105 aa, Triphysaria pusilla
MVNVPKTKKTFCKSKECKKHTLHKVTQYKKGKDSLAAQGKRRYDRKQSGYGGQTKPVFHKKAKTTKKIVLRLQCQSCKHSSQHAIKRCKHFEIGGDKKGKGTSLF

SEQ ID NO: 7821 - protein, 105 aa, Zostera marina
MVNVPKTKKTYCKNKQCKKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7822 - protein, 105 aa, Unknown
  Sequence found in Organisms: Brassica napus, Brassica juncea, Brassica oleracea, Brassica rapa, Raphanus sativus, Thellungiella halophila, Eutrema halophilum, Eutrema parvulum
MVNIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGKGTSLF

SEQ ID NO: 7823 - protein, 105 aa, Unknown
  Sequence found in Organisms: Bupleurum chinense, Castanea mollissima
MVNVPKTKKTYCKSKECRKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7824 - protein, 105 aa, Unknown
  Sequence found in Organisms: Cicer arietinum, Trifolium pratense, Lotus japonicus, Medicago truncatula, Trigonella foenum-graecum
MVNVPKTKKTYCKSKECKKHTLHKVTQYKKGKDSIAAQGKRRYDRKQSGYGGQTKPVFHKKAKTTKKIVLRLQCQGCKHVSQHAIKRCKHFEIGGDKKGKGTSLF

SEQ ID NO: 7825 - protein, 105 aa, Unknown
  Sequence found in Organisms: Solanum lycopersicum, Malus domestica, Catharanthus roseus, Coffea canephora, Solanum melongena, Linum usitatissimum, Fraxinus spp, Lactuca sativa and additional organisms as disclosed in Tables 52 and 53
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7826 - protein, 105 aa, Unknown
  Sequence found in Organisms: Arnica chamissonis, Cirsium arvense, Conyza canadensis, Flaveria ramosissima, Guizotia abyssinica, Helianthus annuus
MVNVPKTKKTYCKNKECRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7827 - protein, 105 aa, Unknown
  Sequence found in Organisms: Antirrhinum majus, Salvia sclarea
MVNVPKTKKTFCKSKECKKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7828 - protein, 105 aa, Bruguiera gymnorhiza
MVNVPKTKKTYCKSKQCRKHTLHKVTQYKKGKDSLSAQGKRRYDRKQSGYGGQTKPVFHKKAKTTKKIVLRLQCQSCKHVSQHPIKRCKHFEIGGDKKGKGTSLF

SEQ ID NO: 7829 - protein, 105 aa, Euphorbia peplus
MVNVPKTKKTYCKSKECRKHTLHKVTQYKKGKDSLSAQGKRRYDRKQSGYGGQTKPVFHKKAKTTKKIVLRLQCQGCKHVSQHPIKRCKHFEIGGDKKGKGTSLF

SEQ ID NO: 7830 - protein, 105 aa, Mesembryanthemum crystallinum
MVNVPKIKKTYCKNKECKKHTTHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7831 - protein, 105 aa, Unknown
  Sequence found in Organisms: Ipomoea nil, Platanus occidentalis
MVNVPKTKKTYCKSKECRKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7832 - protein, 105 aa, Liriodendron tulipifera
MVNVPKTKKTYCKNKECRKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7833 - protein, 105 aa, Mimulus guttatus
MVNVPKTKKTFCKSKECKKHTLHKVTQYKKGKDSLAAQGKRRYDRKQSGYGGQTKPVFHKKAKTTKKIVLRLQCQSCKHSSQHPIKRCKHFEIGGDKKGKGTSLF

SEQ ID NO: 7834 - protein, 105 aa, Unknown
  Sequence found in Organisms: Rosa hybrid cultivar, Scabiosa columbaria, Valeriana officinalis
MVNVPKTKKTYCKNKACKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7835 - protein, 105 aa, Euphorbia esula
MVNFPKTKKTYCKSKECKKHTLHKVTQYKKGKDSLSAQGKRRYDRKQSGYGGQTKPVFHKKAKTTKKIVLRLQCQGCKHVSQHPIKRCKHFEIGGDKKGKGTSLF

SEQ ID NO: 7836 - protein, 105 aa, Tamarix hispida
MVNVPKTKKTYCKNKECRKHTLHKVTQYKKGKDSLAAQGKRRYDRKQSGYGGQTKPVFHKKAKTTKKIVLRLQCQACKHMSQHPIKRCKHFEIGGDKKGKGTSLF

SEQ ID NO: 7837 - protein, 105 aa, Utricularia gibba
MVNVPKTKKTYCKSKECKKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7838 - protein, 660 aa, Malus domestica
MPVLQTTCISNFPPNPNSAVPLPPYSLSCSALSSAASTFFARSKNPIFQPNSASFLRANPPRGARLAIRAAGTDYYKTLNVPRTATLQEIKSAYRNLARKYHPDKGGGAEDKFKEISAAYEVLSDDGKRSLYDRFGEAGLQGDYGSSTMGPSGVDPFDIFDTFFGGSDGMFGGRGESGGMNFNFSNRGNQGLDIRYDLYLSFEESIFGVQREIQVSCVETCDDCGGTGAKSDKGIKSCTGCGGRGGVMKTQKTPFGMISQVSTCSKCGGDGRIITDPCQRCSGKGQVQSKRAMSISIPAGVNDGATMQIQGEGNLDKKRGKVGDVYIVLHVDEKAGIRRDGLNLYSKINIDYTEAILGTVIKVETVEGLKELQIPSGIQPGETVKLRRMGVPDINRPSSRGDHHFTVNVLIPKIISDKERALVEELASLKASREGHSAASKGTGIRDRNFGKHRTNASSQATKRSASLWDSIKGVLGKRQSGEGFASVSVDRPPLLWGSFQPDPLHMASIFTVLVVTCICTVMGKTADASASSRVLLRGRFCSTAESSPYEPAVAMVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7839 - protein, 69 aa, Cleome spinosa
LLGSFNQLERETEAPRCCRSSSKEERKMVNVPKTKKTYCKNKECKKHTLHKVTQYKRKKQSCCSGKASL

SEQ ID NO: 7840 - protein, 92 aa, Humulus lupulus
MVKVPKTKKTYCKNKECKKHTLHKVTQYKKGKDSLAAQGKRRYDRKQSGYGGQTKPAFTRRPKPPRRLFLGCSARVASMSLSTQSSVASILR

SEQ ID NO: 7841 - protein, 106 aa, Lolium multiflorum
MVNVPKTRKTYCKNKECKKHTLHKVTQYKKGKDSLSAQGKRRYDRKQSGYGGQTKPVFHKKAKTTKKIVLKTSVPELQALTLSVRSRGASTLRSVETRRERELRLF

SEQ ID NO: 7842 - protein, 146 aa, Capsicum annuum
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGREPLFSRLPMKSPRTSFFVFSYAAMLNFDYLDVGSIVLHFLPIDFAL

SEQ ID NO: 7843 - protein, 135 aa, Triticum aestivum
MVNIPKTKKTYCKNKECKKHTLHKVTQYKRVKTVSPPKESVVMTVSNLVMVVRPSPSSTRRLRPRRRLSSGFSAKLASTFRSTQSRGASILRSGETRRARGHLFSKLLFSSLLLQVFYFVWYLDSICFSPRIRLS

SEQ ID NO: 7844 - protein, 132 aa, Amsonia hubrichtii
MVNVPKTKKTYCKSKECRKHTLHKVTQYKKGKDSLAAQGKRRYDRKQSGYGGQTKPVFHKKAKTTKKIVLRLQCQGCKHVSQHPIKRCKHFEIGGDKKGKGTSLFKELVHGVQLLCYLLRFSFTYASCFFVI

SEQ ID NO: 7845 - protein, 139 aa, Brassica juncea
MVNIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGKGTSLCFLFRLDLDSICFSPRIRLSPHLWLSLYILQQNHV

SEQ ID NO: 7846 - protein, 91 aa, Distylium racemosum
MVNVPKTKKTFCKNKACKKHTLHKVTQYKKGKDSLAVQGKRRYDRKQSGYGGQTKPVFHKKAKTTKKNCAEAAVSVVQTCFPTSHQALQTL

SEQ ID NO: 7847 - protein, 142 aa, Flaveria ramosissima
MVNVPKTKKTYCKNKECRKHTLHKVTQYKKGKDSLAAQGKRRYDRKQSGYGGQTKPVFHKKAKTTKKIVLRLQCQGCKHVSQHPIKRCKHFEIGGDKKGKGTSLSEQFVAGLLAATISLIFCLADYSGLSVCKFVLQGPILF

SEQ ID NO: 7848 - protein, 141 aa, Quercus alba
MAPKAEKKPAEKKPAEEKKAEKAPAEKKPRAEKKLPKDSSEKKKKRSKKSVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 7849 - protein, 119 aa, Lippia dulcis
MVNVPKTKKTYCKSKECKKHTLHKVTQYKKGKDSLAVQGKRRYDRKQSGYGGQTKPVFHKKAKTTKKIVLRLQCQGCKHVSQHPIKRCKHFEIGGDKKGQRDIPILMWKNRIVGLLCYF

SEQ ID NO: 7850 - protein, 87 aa, Nicotiana tabacum
MSLSTQSRGASILRLVGTRKEREPLFSKLPVMQNLIVFCYTFLDIFFCWCSSRAFVFLDSRAFVFLCCVNYILIRRSKLYFSSFYLV

SEQ ID NO: 7851 - protein, 105 aa, Beta vulgaris
MVNIPKVKKTYCKNKECKKHTTHKVTQYKKGKDSLAAQGKRRYDRKQSGYGGQTKPVFHKKAKTTKKIVLRLQCQACKHVSQHAIKRCKHFEIGGDKKGKGTSLF

SEQ ID NO: 7852 - protein, 105 aa, Unknown
  Sequence found in Organisms: Gossypium hirsutum, Amsonia hubrichtii, Manihot esculenta, Ricinus communis, Citrus sinensis, Citrus clementina, Cucumis sativus, Eucalyptus grandis, Euonymus alatus and additional organisms as disclosed in Tables 52 and 53
MVNVPKTKKTYCKSKECRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7853 - protein, 105 aa, Plantago ovata
MVNVPKTKKTFCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7854 - protein, 105 aa, Unknown
  Sequence found in Organisms: Arabidopsis thaliana, Arabidopsis lyrata
MVNIPKTKNTYCKNKECKKHTLHKVTQYKKGKDSLAAQGKRRYDRKQSGYGGQTKPVFHKKAKTTKKIVLRLQCQSCKHFSQRPIKRCKHFEIGGDKKGKGTSLF

SEQ ID NO: 7855 - protein, 105 aa, Artemisia annua
MVNVPKTKKTFCKNKACGKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7856 - protein, 105 aa, Brassica juncea
MVNIPKTKKTYCKNKECKKHTLHKVTQYKKGKDSLAAPGKRRYDRKQSGYGGQTKPVFHKKAKTTKKIVLRLQCQTCKHFSQHSIKRCKHFEIGGDKKGKGTSLF

SEQ ID NO: 7857 - protein, 105 aa, Musa acuminata
MVNVPKTKKTFCKNKACRKHTLHKVTQYKKGKDSLSVQGKRRYDRKQSGYGGQTKPVFHKKARTTKKIVLKLQCQSCKHYSQHPIKRCKHFEIGGDKKGRGTSLF

SEQ ID NO: 7858 - protein, 105 aa, Bruguiera gymnorhiza
MVNVPKTKKTYCKNKQCRKHTLHKVTQYKKGKDSLAAQGKRRYDRKQSGYGGQTKPVFHKKAKTTKKIVLRLQCQSCKHVSQHPLKRCKHFEIGGDKKGKGTSLF

SEQ ID NO: 7859 - protein, 105 aa, Unknown
  Sequence found in Organisms: Castanea mollissima, Quercus alba, Lippia dulcis
MVNVPKTKKTYCKSKECKKHTLHKVTQYKKGKDSLAVQGKRRYDRKQSGYGGQTKPVFHKKAKTTKKIVLRLQCQGCKHVSQHPIKRCKHFEIGGDKKGKGTSLF

SEQ ID NO: 7860 - protein, 105 aa, Cryptomeria japonica
MVNVPKTKKTFCKNKACRKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7861 - protein, 105 aa, Cycas rumphii
MVNVPKTKKTFCRNKECRKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7862 - protein, 105 aa, Unknown
  Sequence found in Organisms: Taraxacum officinale, Gerbera hybrid cultivar, Lactuca sativa
MVNVPKTKKTYCKNKDCRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7863 - protein, 105 aa, Unknown
  Sequence found in Organisms: Distylium racemosum, Sequoia sempervirens
MVNVPKTKKTFCKNKACKKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7864 - protein, 105 aa, Unknown
  Sequence found in Organisms: Fraxinus spp, Primula obconica
MVNVPKTKKTYCKSKECRKHTLHKVTQYKKGKDSLAAQGKRRYDRKQSGYGGQTKPVFHKKAKTTKKIVLRLQCQGCKHMSQHPIKRCKHFEIGGDKKGKGTSLF

SEQ ID NO: 7865 - protein, 105 aa, Gnetum gnemon
MVNVPKTKKTFCKNKACRKHTLHKVTQYKKGKDSLAVQGKRRYDRKQSGYGGQTKPVFHKKAKTTKKIVLKLQCQSCKHVSQHPIKRCKHFEIGGDKKGKGTSLF

SEQ ID NO: 7866 - protein, 105 aa, Unknown
  Sequence found in Organisms: Lactuca sativa, Tragopogon dubius, Valeriana officinalis
MVNVPKTKKTYCKSKDCKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7867 - protein, 104 aa, Pinus pinaster
MVNVPKTKKTFCKNKACKKHTVHKVTQYKKGKDSLSAQGKRRYDRKQSGYGGQTKPVFHKKAKTTKKIVLKLQCQSCKHYSQHAIKRCKHFEIGGDKKGRNLLF

SEQ ID NO: 7868 - protein, 105 aa, Nuphar advena
  misc_feature (84)..(84): Xaa can be any naturally occurring amino acid
MVNVPKTKKTYCKSKECRKHTLHKVTQYKKGKDSLAVQGKRRYDRKQSGYGGQTKPVFHKKAKTTKKIVLRLQCQSCKHVSQHXIKRCKHFEIGGDKKGKGTSLF

SEQ ID NO: 7869 - protein, 105 aa, Nuphar advena
MVNVPKTKKTYCKSKECRKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7870 - protein, 105 aa, Raphanus sativus
MVNIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGEGTSLF

SEQ ID NO: 7871 - protein, 105 aa, Raphanus sativus
MVNIPKTKKTYCKNKECKKHTLHKVTQYKKGKDSLAAQGKRCYDRKQSGYGGQTKPVFHKKAKTTKKIVLRLQCQTCKHFSQHSIKRCKHFEIGGDKKGKGTSLF

SEQ ID NO: 7872 - protein, 105 aa, Raphanus sativus
  misc_feature (81)..(81): Xaa can be any naturally occurring amino acid
MVNIPKTKKTYCKNKECKKHTLHKVTQYKKGKDSLAAQGKRRYDRKQSGYGGQTKPVFHKKAKTTKKIVLRLQCQTCKHFXQHSIKRCKHFEIGGDKKGKGTSLF

SEQ ID NO: 7873 - protein, 105 aa, Raphanus sativus
MVNIPKTKKTYCKNKECKKHTLHKVTQYKKGKDSLAAQGKRRYDRKQSGYGGQTKPVFHKKAKTTKKIVLRLHCQTCKHFSQHSIKRCKHFEIGGDKKGKGTSLF

SEQ ID NO: 7874 - protein, 105 aa, Rhizophora mangle
MVNVPKTKKTYCKSKDCRKHTLHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7875 - protein, 105 aa, Sciadopitys verticillata
MVNVPKTKKTFCKNKACRKHSLHKVTQYKKGKDSLSAQGKRRYDRKQSGYGGQTKPVFHKKAKTTKKIVLRLQCQSCKHVSQHPIKRCKHFEIGGDKKGKGTSLF

SEQ ID NO: 7876 - protein, 105 aa, Sesamum indicum
MVNVPKTKKTYCKSKEWKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7877 - protein, 105 aa, Silene vulgaris
MVNVPKLKKTYCKNKECRKHTQHKVTQYKKGKDSLAAQGKRRYDRKQSGYGGQTKPVFHKKAKTTKKIVLRLQCQSCKHVSQHPIKRCKHFEIGGDKKGKGTSLF

SEQ ID NO: 7878 - protein, 105 aa, Glycine max
MVNVPKTKKTYCKSKECRKHTLHKVTQYKKGKDSIAAQGKRRYDRKQSGYGGQTKPVFHKKAKTTKKIVLRLQCQGCKHVSQHAIKRCKHFEIGGDKKGKGTSLF

SEQ ID NO: 7879 - protein, 105 aa, Nicotiana tabacum
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGNGTSLF

SEQ ID NO: 7880 - protein, 105 aa, Vinca minor
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTQLF

SEQ ID NO: 7881 - protein, 105 aa, Triticum aestivum
MVNVPKTKKTYCKNKECKKHTLHKVTQYKKGKDSLSAQGKRRYDRNQSGYGGQTKPVFHKKAKTPKKIVLKLQCQSCKHYSQGKIPRSHHFEIGGDKKGKGTSLF

SEQ ID NO: 7882 - protein, 105 aa, Zamia vazquezii
  misc_feature (65)..(65): Xaa can be any naturally occurring amino acid
MVNVPKTKKTFCRNKECKKHTLHKVTQYKKGKDSLAAQGKRRYDRKQSGYGGQTKPVFHKKAKTXKKIVLRLQCQSCKHVSQHPIKRCKHFEIGGDKKGKGTSLF

SEQ ID NO: 7883 - protein, 105 aa, Unknown
  Sequence found in Organisms: Vaccinium corymbosum, Actinidia deliciosa, Sarracenia psittacina, Juglans hindsii x Juglans regia
MVNVPKTKKTYCKSKECRKHTLHKVTQYKKGKDSLAVQGKRRYDRKQSGYGGQTKPVFHKKAKTTKKIVLRLQCQGCKHVSQHPIKRCKHFEIGGDKKGKGTSLF

SEQ ID NO: 7884 - protein, 105 aa, Unknown
  Sequence found in Organisms: Brassica juncea, Theobroma cacao, Centaurea maculosa, Cichorium intybus, Cirsium arvense, Cynara scolymus, Gerbera hybrid cultivar, Lactuca sativa, Carthamus tinctorius, Camellia sinensis
MVNVPKTKKTYCKSKDCRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7885 - protein, 103 aa, Brassica juncea
NIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGKGTSLF

SEQ ID NO: 7886 - protein, 105 aa, Unknown
  Sequence found in Organisms: Phaseolus coccineus, Vigna unguiculata, Cyamopsis tetragonoloba, Glycyrrhiza uralensis, Arachis hypogaea, Cajanus cajan
MVNVPKTKKTYCKSKECRKHTLHKVTQYKKGKDSIAAQGKRRYDRKQSGYGGQTKPVFHKKAKTTKKIVLRLQCQGCKHVSQHPIKRCKHFEIGGDKKGKGTSLF

SEQ ID NO: 7887 - protein, 104 aa, Orobanche aegyptiaca
VNVPKTKKTFCKSKQCKKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7888 - protein, 103 aa, Petunia hybrida
NVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7889 - protein, 105 aa, Primula obconica
MVNVPKTKKTYCKSKECRKHTLHKVTQYKKGKDSLAVQGKRRYDRKQSGYGGQTKPVFHKKAKTTKKIVLRLQCQGCKHMSQHPIKRCKHFEIGGDKKGKGTSLF

SEQ ID NO: 7890 - protein, 105 aa, Raphanus sativus
MVNIPKTKKTYCKNKECKKHTLHKVTQYKKGKDILAAQGKRRYDRKQSGYGGQTKPVFHKKAKTTKKIVLRLQCQTCKHFSQHSIKRCKHFEIGGAKKGKGTSLF

SEQ ID NO: 7891 - protein, 105 aa, Taxus baccata
MVNVPKTKKTFCRNKACKKHTLHKVTQYKKGKDSLAVQGKRRYDRKQSGYGGQTKPVFHKKAKTTKKIVLRLQCQSCKHVSQHPIKRCKHFEIGGDKKGKGTSLF

SEQ ID NO: 7892 - protein, 105 aa, Vinca minor
MVNVPKTKKTYCKSKECKKHTLHKVTQYKKGKDSLAVQGKRRYDRKQSGYGGQTKPVFHKKAKTTKKIVLRLQCQGCKHVSQHPIKRCKHFEIGGDKKGKGTQLF

SEQ ID NO: 7893 - protein, 298 aa, Centaurea maculosa
MVFFSHKDKKYPTGTRTNRATTAGFWKATGRDKAIYAKNDLVGMRKTLVFYKGRAPNGQKSDWIMHEYRLESDENATTTQEEGWVVCRVFKKRLPTMRRASDHESPIWYDDQVSFMPDIDSPNQNNNSQSHLVNHGYQYPYGACKKELDQLQNYQITPDHFLQLPLLESPKLLPTCNPSMPIYGININQAGNINYQPSSLTQNQNNNIHQNQDQNVNNQVTDWRVLDKFVASQLLSQGDVSIKENDHYANIEDNSPIFQSNEDHDTSNSELMITHLNKQDTKGPRCQKMPRIPSPVVT

SEQ ID NO: 7894 - protein, 129 aa, Citrullus lanatus
MVIFLPLFFAVCLDFLPVNASMLCLVNVPKTKKTYCKSKECRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7895 - protein, 143 aa, Cichorium intybus
MQEVHVETGEENEKAVFTADSVLFEFLDSGWKERGKGELKVNVLTTGTKKARLVMRARGNYRLILNASIFPDMKLTNMEKKGITFACLNSTGEGQNGLSTFALKFKDASIVDEFRSVVTEHKGNTGATAALKTPENSPKASDE

SEQ ID NO: 7896 - protein, 305 aa, Cirsium arvense
MDVELHDWEVLPNSEDSTSLQNTSYLEGIERDSEGIIRSDYFSLDSRNKYAGTQVEDVTDGISVESDNPSWIDPVCDTRYSTTKEMGEFWSTDGSSDDGKYVESEANNKELDIVETGTRQVAYDGSASVEMDKSWSDSGEIGSKPTKYENMDVDRYDDDLKIHEESEPSGEQKIMQARGQGENEDVLIETMKADGEERNRVAVWWKLPFDLLKYCLFKASPVWTLSVAAAMMGVVILGRRLYKMKRKSRTLQLKVTVDDKKVSQFMSRAARLNEAFSVVKRGPIIRPSLPAGGTGIAPWPMMALR

SEQ ID NO: 7897 - protein, 75 aa, Silene vulgaris
MFPNIRSRGASTLKLVETRRARVHHSFNCSGRLFGFCFRLLFMSFHVQDTCLSLNNLIVGFWLVLADLSDFGTRS

SEQ ID NO: 7898 - protein, 69 aa, Vaccinium corymbosum
MVNVPKTKKTYCKSKECRKHTLHKVTQYKKGKIVWLCKASAVTIGNNQGMAGKLSLFSTRRLKLQKRLC

SEQ ID NO: 7899 - protein, 148 aa, Catharanthus roseus
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTPFLRSWALVFNCCFICVTFYFFMFVHLDQMTDRCLWQNESSDFYFY

SEQ ID NO: 7900 - protein, 54 aa, Vigna unguiculata
  misc_feature (8)..(8): Xaa can be any naturally occurring amino acid
  misc_feature (14)..(14): Xaa can be any naturally occurring amino acid
MVNVPKTXKTYCKXKECRKHTLHKVTQYKKGKDSIACSGETPLRSQTIRLWWTN

SEQ ID NO: 7901 - protein, 90 aa, Flaveria ramosissima
MVNVPKTKKTYCKNKECRKHTLHKVTQYKKGKDSLAAQGKRRYDRKQSGYGGQTKPVFHKKAKTTKKIVLRLQCQGCKHVSQHQSRDASI

SEQ ID NO: 7902 - protein, 126 aa, Fraxinus spp
MVNVPKTKKTYCKSKECRKHTLHKVTQYKKGKDSLAVQGKRRYDRKQSGYGGQTKPVFHKKAKTTKKIVLRLQCQGCKHVSQHPIKSASILRLVETRKEREPLFSRRAFKELKCLYVFCYVKFTSS

SEQ ID NO: 7903 - protein, 91 aa, Gnetum gnemon
MVNVPKTKKTFFKTKACRKHTLHKVTQYKKGKDSLAVQGKRRYDRKQSGYGGQTKPVFHKKAKTTKKISAEAAVPILQTRLSTPYQALQAF

SEQ ID NO: 7904 - protein, 120 aa, Humulus lupulus
IRSLCSRSPQARTSQLGSGGGGGSGSVSRHGERSQDQEDLLQEQGVQEHTLHKVTQYKKGKDSLAAQGKRRYDRKQSGYGGQTKPVFHKKAKTTKKIVLRLQCQGCKHVSQHDNQAVQAF

SEQ ID NO: 7905 - protein, 132 aa, Pinus taeda
MVNVPKTKKTFCKNKACKKHTVHKVTQYKKGKDSLSAQGKQSGYGGQTKPVFHKKAKTTKKIVLKLQCQSCKHYSQHAIKRCKHFEIGGDKKGKGTSLFKLSALLQLYIHHFTFLFACLSKDRNFVVLFIRR

SEQ ID NO: 7906 - protein, 105 aa, Centaurea maculosa
MVNVPKTKKTYCKSKDCRKHTLHKVTQYKKGKDSLAAQGKRRYDRKQSGYGGQTKPVFHKKAKTTKKIVLRLQCQGCKHVSQHPIKRCKQFEIGGDKKGKGTSLF

SEQ ID NO: 7907 - protein, 105 aa, Primula obconica
MVNVPKTKKTYCKSKECRKHTLHKVTQYKKGKDSLAVQGKRRYDRKQSGYGGQTKPVFHKKAKTTKKLVLRLQCQGCKHMSQHPIKRCKHFEIGGDKKGKGTSLF

SEQ ID NO: 7908 - protein, 105 aa, Prunus persica
MVNVPKTKKTYCKSKECKKHTLHKVTQYKTGKASIAAQGKRRYDRKQSGYGGQTKPVFHKKAKTTKKIVLRLQCQGCKHVSQHPIKRCKHFEIGGDKKGKGTSLF

SEQ ID NO: 7909 - protein, 104 aa, Vinca minor
VNVPKTKKTYCKSKECKKHTLHKVTQYKKGKDSLAVQGKRRYDRKQSGYGGQTKPVFHKKAKTTKKIVLRLQCQGCKHVSQHPIKRCKHFEIGGDKKGKGTQLF

SEQ ID NO: 7910 - protein, 109 aa, Cajanus cajan
MVNVPKTKKTYCKSKECKKHTLHKVTQYKKGKDSIAAQGKRRYDRKQSGYGGQTKPVFHKKAKTTKKIVLRLQCQGCKHVSQHAIKRCKHFEIGGDKKGKGTSLFWVEN

SEQ ID NO: 7911 - protein, 101 aa, Brassica juncea
MVNIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGKG

SEQ ID NO: 7912 - protein, 102 aa, Artemisia annua
MVNVPKTKKTFCKNKACGKHTVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7913 - protein, 68 aa, Humulus lupulus
MVNVPKTKKTYCKNKECKKHTLHKVTQYKKGKDSLAAQGKRRYDRKQSGYGGQTKPVFHKKPNTKRLS

SEQ ID NO: 7914 - protein, 106 aa, Humulus lupulus
MVKRFPRPRRLTARTRSAKKHTLHKGDSIQEGQRIVLLLRVSVVMTGNSPVMEVRPSQSFTRSQNHQKIVLRLQCQGCKHVSQHAIKRCKHFEIGGDKKGKGTSLF

SEQ ID NO: 7915 - protein, 68 aa, Cajanus cajan
MVNVPKTKKTYCKSKECRKHTLHKVTQYKKGKDSIAAQGKRRYDRKQSGYGGQTKPVFHKKAPPRRLS

SEQ ID NO: 7916 - protein, 112 aa, Thalictrum flavum
MVNVPKTKKTYCKNKECKKHTLHKVTQYKKGKDSLAAQGKRRYDRKQSGYGGQTKPVFHKKAKTTKKIVLRLQCQSCKHVSQHALKRCKHFEIGGDKKGKGTSLFRWGVCLV

SEQ ID NO: 7917 - protein, 63 aa, Medicago truncatula
MVNVPKTKKTYCKSKECKKHTLHKVTNTKGKDSIAAQGKRRYDRKQSGYGGQTKPVFHKRQNY

SEQ ID NO: 7918 - protein, 105 aa, Linum usitatissimum
MVNVPKTKKTYRKSKECKKHTLHKVPQYKKGKDSLAAQGKRRYDRKQSGYGGQTKPVFHKKAKTTKKIVLRLQYQGCKHVFQPPIKRCKHFEIGGDKKGKGTSLF

SEQ ID NO: 7919 - protein, 105 aa, Marchantia polymorpha
MVNVPKTKKSFCSGKDCKKHTLHKVTQYKKGKDSLYAQGKRRYDRKQSGYGGQTKPVFHKKAKTTKKIVLRLQCQGCKHVTQHPIKRCKHFEIGGDKKGKGTSLF

SEQ ID NO: 7920 - protein, 105 aa, Mesostigma viride
MVNIPKTKKTFCKGKECGKHRLHKVTQYKTGKASLSAQGKRRYDRKQSGYGGQTKPVFHKKAKTTKKIVLRLQCQSCKHVSQHAIKRCKHFEIGGDKKGKGAQLF

SEQ ID NO: 7921 - protein, 147 aa, Picea glauca
MVNVPKTKKTFCKNKACKKHTLHKVTQYKKGKDSLSAQGKRRYDRKQSGYGGQTKPVFHKKAKTTKKIVLKLQCQSCKHYSQHAIKRCKHFEIGGDKKGRNVLSKLSAMFQLSIDHFTFLFAYLSEDSKLCCLFVDWWRQGEGNVLF

SEQ ID NO: 7922 - protein, 99 aa, Brassica juncea
MVNIPKTKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKG

SEQ ID NO: 7923 - protein, 105 aa, Mesostigma viride
MVNIPKTKKTFCKGKECGKHRLHKVTQYKTGKASLFAQGKRRYDRKQSGYGGQTKPVFHKKAKTTKKIVLRLQCQSCKHVSQHAIKRCKHFEIGGDKKGKGAQLF

SEQ ID NO: 7924 - protein, 105 aa, Physcomitrella patens
MVNVPKTKKSFCPGKACKKHTLHKVTQYKKGKDSLYAQGKRRYDRKQSGYGGQTKPVFHKKAKTTKKIVLRLQCQACKHVTQHPIKRCKHFEIGGDKKGKGTQLF

SEQ ID NO: 7925 - protein, 105 aa, Physcomitrella patens
MVNVPKTKKSFCPGKSCKKHTLHKVTQYKKGKDSLYAQGKRRYDRKQSGYGGQTKPVFHKKAKTTKKIVLRLQCQACKHVTQHPIKRCKHFEIGGDKKGKGTQLF

SEQ ID NO: 7926 - protein, 97 aa, Senecio madagascariensis
MVNVPKTKKTYCKNKECKKHTLHKVTQYKKGKDSLAAQGKRRYDRKQSGYGGQTKPVFHKKAKTTKKIVLRLQCQSCKHMSQHPIKRCKHFEIGGDK

SEQ ID NO: 7927 - protein, 87 aa, Elaeis guineensis
LIAKNKACRKHTLHKVTQYKKGKDSLSAQGKRRYDRKQSGYGGQTKPVFHKKAKTTKKIVLKLQCQSCKHYSQHPIKRCKHFRNWWR

SEQ ID NO: 7928 - protein, 173 aa, Tabernaemontana elegans
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKLEKLVYKDVKRGIRRDRKYAVQPRNVFATGVHMSQNTEGKTTHKTEGRIMYFHYHGTIADRREPCRQMVNSTDITV

SEQ ID NO: 7929 - protein, 114 aa, Aquilegia formosa
MILTPGLSIQVNVPKTKKTYCKNKECKKHTLHKVTQYKKGKDSLAAQGKRRYDRKQSGYGGQTKPVFHKKAKTTKKIVLRLQCQSCKHVSQHALKRCKHFEIGGDKKGKGTSLF

SEQ ID NO: 7930 - protein, 127 aa, Solanum phureja
DWHQLNGDCALWYFCLTSRLAKIVNVPKTKKTYCKSKECKNHTLHKVIQYKKGKDSLASQEKRRYDRKQSGYGGQTKPVFHKKAKTTKKIVLRLQFQGCKHVSQHPIKRFKHFEIGGDKKGKGTSLF

SEQ ID NO: 7931 - protein, 113 aa, Musa acuminata
TFTINVIIQVNVPKTKKTFCKNKVCRKHTLHKVTQYKKGKDSLSVQGKRRYDRKQSGYGGQTKPVFHKKAKTTKKIVLKLQCQSCKHYSQHPIKRCKHFEIGGDKKGKGTSLF

SEQ ID NO: 7932 - protein, 105 aa, Physcomitrella patens
MVNVPKTKKSFCPGKACKKHTLHKVTQYKKGKDSLYVQGKRRYDRKQSGYGGQTKPVFHKKAKTTKKIVLRLQCQACKHVTQHPIKRCKHFEIGGDKKGKGTQLF

SEQ ID NO: 7933 - protein, 100 aa, Primula obconica
KTKKTYCKSKECRKHTLHKVTQYKKGKDSLAVQGKRRYDRKQSGYGGQTKPVFHKKAKTTKKIVLRLQCQGCKHMSQHPIKRCKHFEIGGDKKGKGTSLF

SEQ ID NO: 7934 - protein, 104 aa, Pteridium aquilinum
MVNVPKTKKTFCKGKDCKKHTLHKVTQYKKGKDSLYVQGKRRYDRKQSGYGGQTKPVFHKKAKTTKKIVLRLQCQSCKHVTQHPIKRCKHFEIGGDKKRKGALY

SEQ ID NO: 7935 - protein, 100 aa, Sarracenia psittacina
KTKKTYCKSKECRKHTLHKVTQYKKGKDSLAVQGKRRYDRKQSGYGGQTKPVFHKKAKTTKKIVLRLQCQGCKHVSQHPIKRCKHFEIGGDKKGKGTSLF

SEQ ID NO: 7936 - protein, 103 aa, Secale cereale
MVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEMVETRRAREHL

SEQ ID NO: 7937 - protein, 105 aa, Ceratodon purpureus
MVNVPKTKKSFCPGKACKKHTLHKVTQYKTGKASLYAQGKRRYDRKQSGYGGQTKPVFHKKAKTTKKIVLRLQCQACKHVTQHPIKRCKHFEIGGDKKGKGTQLF

SEQ ID NO: 7938 - protein, 105 aa, Selaginella moellendorffii
MVNVPKTKKSFCQGKNCRKHTLHKVTQYKKGKDSLYVQGKRRYDRKQSGYGGQTKPVFHKKAKTTKKIVLRLQCQTCKRVSQHPLKRCKHFEIGGDKKGKGTSLF

SEQ ID NO: 7939 - protein, 115 aa, Allium cepa
MVNVPKTKKTYCRNKECKKHTLHKVTQYKKGKDSLSAQGKRRYDRKQSGYGGQTKPVFHKKAKTTKKIVLKLQCQSCKHYSQKAIKRCKHFEIGGDKKGKGNITLTKYCFSFLFV

SEQ ID NO: 7940 - protein, 104 aa, Arnica chamissonis
AIGERFPKTKKTYCKNKECRKHTLHKVTQYKKGKDSLAAQGKRRYDRKQSGYGGQTKPVFHKKAKTTKKIVLRLQCQGCKHVSQHPIKRCKHFEIGGDKKGKGT

SEQ ID NO: 7941 - protein, 91 aa, Pinus taeda
MVNVPKAKKTFCKNKACKKPPVRKVSQYKKGKGSLSAQGKRRYDRKPSGYGGQTKPVFPKKAKTTKKIVFKLQCQSCKHYSQHAIKRCKHF

SEQ ID NO: 7942 - protein, 88 aa, Prunus persica
MVNVPKTNKTHCKSKECKKHTLHKVTQYKKGKDSLAAQGKRRYDRKQSGYGGQTKPVFHKKAKTTKKIVLMLQCQGCKHVSQQEVQVL

SEQ ID NO: 7943 - protein, 107 aa, Triticum aestivum
  misc_feature (1)..(1): Xaa can be any naturally occurring amino acid
  misc_feature (4)..(4): Xaa can be any naturally occurring amino acid
  misc_feature (6)..(6): Xaa can be any naturally occurring amino acid
  misc_feature (21)..(21): Xaa can be any naturally occurring amino acid
  misc_feature (23)..(23): Xaa can be any naturally occurring amino acid
  misc_feature (29)..(29): Xaa can be any naturally occurring amino acid
  misc_feature (42)..(42): Xaa can be any naturally occurring amino acid
  misc_feature (59)..(61): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(93): Xaa can be any naturally occurring amino acid
  misc_feature (97)..(97): Xaa can be any naturally occurring amino acid
XQEXKXTRGGELPGGDHGERXKXQEDLVXEQGVQEAHPPQGXAVQERQGQFFCSGKAPXXXQAVRIWWPDKACFPQEGQDNKEDCXEAXVPXXQALXSTRYQEVQAL

SEQ ID NO: 7944 - protein, 96 aa, Bupleurum chinense
TYCKSKECRKHTLHKVTQYKKGKDSLAAQGKRRYDRKQSGYGGQTKPVFHKKAKTTKKIVLRLQCQSCKHMSQHPIKRCKHFEIGGDKKGKGTSLF

SEQ ID NO: 7945 - protein, 104 aa, Adiantum capillus-veneris
MVNVPKTKKSFCKGKDCKKHTLHKVTQYKKGKDSLYVQGKRRYDRKQSGYGGQTKPVFHKKAKTTKKIVLRLQCQSCKHVTQHPIKRCKHFEIGGDKKRKGAMY

SEQ ID NO: 7946 - protein, 104 aa, Pteridium aquilinum
MVNVPKTKKTYCKSKDCRKHTLHKVTQYKKGKDSLAAQGKRRYDRKQSGYGGQTKPVLHKKAKTTKKIVLRLQCQGCKHVSQHPIKRCKHFEIGGDKREGNISF

SEQ ID NO: 7947 - protein, 105 aa, Sarracenia psittacina
MVNVPKTRKTYCKSKECRKHTLHKVTQYKKSKERLVAQGKRRYDRKNSGYGGQAKPIQRKKAKTTKKIVLKLQCQRCKHVSQHPIKRCKHFEIGGDKKGKGTSLF

SEQ ID NO: 7948 - protein, 91 aa, Secale cereale
MVNVPKTKKTYCKNKECKKHTLHKVTQYKKGKDSLSAQGKRRYDRKQSGYGGQTKPVFHKKAKTTKKIVLKLQCQSCKHYSQRAIKRCKLF

SEQ ID NO: 7949 - protein, 95 aa, Cephalotaxus harringtonia
FCKNKACKKHTLHKVTQYKKGKDSLSVQGKRRYDRKQSGYGGQTKPVFHKKAKTTKKIVLRLQCQSCKHVSQHPIKRCKHFEIGGDKKGKGTSLF

SEQ ID NO: 7950 - protein, 117 aa, Brassica rapa
NVSFADDGTQSSPERERDQSSENGEHSKDKEDVLQEQGMQEAHIAQGYPIQKRRYDRKQSGYGGQTKPVFHKKAKTTKKIVLRLQCQTCKHFSQHSIKRCKHFEIGGDKKGKGTSLF

SEQ ID NO: 7951 - protein, 69 aa, Eschscholzia californica
MVNVPKTKKTYCKNKECKKHTLHKVTQYKKGKDSLAAQGKRRYDRKQSGYGGQTKPVFTKRRKPRRRLF

SEQ ID NO: 7952 - protein, 146 aa, Sarracenia psittacina
MVNVPKTRKTYCKSKECRKHTLHKVTQYKKSKERLVAQGKRRYDRKNSGYGGQAKPIQRKKAKTTKKIVLKLQCQRCKHVSQHPIKRCKHFEIGGDKKGKGLHYSSHVSILSVLCLRSLFLSFLDSFMFWLKKFIFRLSRLEKSKK

SEQ ID NO: 7953 - protein, 54 aa, Panicum virgatum
MNYYLCLYPAAATAARSLPSAAAKMMNVPKTMKTYCRNKECRKHPSQGDSVQEG

SEQ ID NO: 7954 - protein, 115 aa, Citrus sinensis
MILTSSVCVLQVNVPKTKKTYCKSKECRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 7955 - protein, 115 aa, Orobanche aegyptiaca
MLECINGLCLQVNVPKTKKTFCKSKQCKKHTLHKVTQYKKGKDSLAAQGKRRYDRKQSGYGGQTKPVFHKKAKTTKKIVLRLQCQGCKHVSQHAIKRCKHFEIGGDKKGKGTSLF

SEQ ID NO: 7956 - protein, 108 aa, Flaveria ramosissima
PKTKKTYCKNKECRKHTLHKVTQYKKGKDSLAAQGKRRYDRKQSGYGGQTKPVFHKKAKTTKKIVLRLQCQGCKHVSQHPIKRCKHFEIGGDKKGKGTSLSKLYLLYM

SEQ ID NO: 7957 - protein, 103 aa, Lippia dulcis
MVNVPKTKKTYCKSKECKKHTLHKVTQYKKGKDSLAAQGKRRYDRKQSGYGGQTKPVFHKRPKHQEDCVEAAVPGLQACLPTPDQECKHLRIGGNKRARDLLF

SEQ ID NO: 7958 - protein, 88 aa, Picea glauca
KKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 7959 - protein, 94 aa, Euphorbia peplus
CKSKECRKHTLHKVTQYKKGKDSLSAQGKRRYDRKQSGYGGQTKPVFHKKAKTTKKIVLRLQCQACKHMSQHPIKRCKHFEIGGDKKGKGTSLF

SEQ ID NO: 7960 - protein, 104 aa, Cephalotaxus harringtonia
NGERSKTKKHFAKQSMQKHTLHKVTQYKKGKDSLSVQGKRRYDRKQSGYGGQTKPVFHKKAKTTKKIVLRLQCQSCKHVSQHPIKRCKHFEIGGDKKGKGTSLF

SEQ ID NO: 7961 - protein, 91 aa, Euphorbia esula
KECKKHTLHKVTQYKKGKDSLSAQGKRRYDRKQSGYGGQTKPVFHKKAKTTKKIVLRLQCQGCKHVSQHPIKRCKHFEIGGDKKGKGTSLF

SEQ ID NO: 7962 - protein, 70 aa, Citrullus lanatus
MSHSIPLRDTSILRLVRTTRQRELLLFRCINIVIHYILLFRESELWGFSTLCFLFGVSDIWEYFYLLDFV

SEQ ID NO: 7963 - protein, 121 aa, Aquilegia formosa
LHIFDVTLRIRDICIVQVNVPKTKKTYCKNKECKKHTLHKVTQYKKGKDSLAAQGKRRYDRKQSGYGGQTKPVFHKKAKTTKKIVLRLQCQSCKHVSQHALKRCKHFEIGGDKKGKGTSLF

SEQ ID NO: 7964 - protein, 88 aa, Secale cereale
PKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 7965 - protein, 89 aa, Picea glauca
MVNVPKTKKTFCKNKACKKHTLHKVTQYKKGKDSLSAQGKRRYDRKQSGYGGQTKPVFHKKAKTTKKIVLKLQCQSCKHYSQHPIKRCK

SEQ ID NO: 7966 - protein, 89 aa, Triticum aestivum
MVNVPKTKKTYCKNKECKKHTLHKVTQYKKGKDSLSAQGKRRYDRKQSGYGGQTKPVSTRSKNHKEDCAEAAMPELQALLPACHQEVQA

SEQ ID NO: 7967 - protein, 93 aa, Fraxinus spp
MVNVPKTKKTYCKSKECRKHTLHKVTQYKKGKDSLAAQGKRRYDRKQSGYGGQTKPVFHKKAKTTKKIVLRLQCQGCKHVSQHPIKRCKHFEI

SEQ ID NO: 7968 - protein, 66 aa, Carthamus tinctorius
MQLSGCQLCNIFSLSGLQLCYGVCRFGFFFTELTYCLKQYKSVFESLLLNLLLMLFLCEKIEVHFS

SEQ ID NO: 7969 - protein, 104 aa, Helianthus annuus
MVNVPKTKKAYCKGRDCKKHTLHKVTQYKSGKASLYAQGKRRYDRKQSGYGGQTKPVFHKKAKTTRKIVLRLQCQVCKTQHMHAIKRCKHFEIGGEKKTKGGLY

SEQ ID NO: 7970 - protein, 120 aa, Vinca minor
MLMFQGQRRPTAIQMSAKSTTCTRLPNTRKVRLALQLKGSVVMIASSQVMVDRLNPSSTRRQIPQKRLSGGSNVRVASMSHSTQLSGASILRLVETKREREPNFSKKLGIKVQVLFYLMF

SEQ ID NO: 7971 - protein, 115 aa, Brassica juncea
PCARNIPCTRLPNTRRVKKTYCKNKECKKHTLHKVTQYKKGKDSLAAQGKRRYDRKQSGYGGQTKPVFHKKAKTTKKIVLRLQCQTCKHFSQHSIKRCKHFEIGGDKKGKGTSLF

SEQ ID NO: 7972 - protein, 71 aa, Humulus lupulus
SRSPQARTSQLGSGGGGRSPALLADMVLTFPRPSKYLLTKNKECKKHTLHKVVLNTKKGKDSLRLLEGNRR

SEQ ID NO: 7973 - protein, 90 aa, Chelidonium majus
SAKKHTLHKVTQYKKGKDSLAAQGKRRYDRKQSGYGGQTKPVFHKKAKTTKKIVLRLQCQSCKHMSQHAIKRCKHFEIGGDKKGKGTSLF

SEQ ID NO: 7974 - protein, 95 aa, Picea glauca
RRRGYQRLRVDRSNGQCSEDQETFCKTSLQKHTLHKVAQYKKEAAFLPKENDGMIETSGYGGQTKPVFHKKAKTTKKIVLMLQCRSCKLYSQHAI

SEQ ID NO: 7975 - protein, 82 aa, Gossypium hirsutum
MVTHYTKGKDSLAAQGKRRYHRTQSGYGGQTKPLLHKKAITTKKIVLRLQCQGSKHVFQHPIKRCKHFEIGGDKKGKGTSLF

SEQ ID NO: 7976 - protein, 123 aa, Flaveria ramosissima
MVNVPKTKKTYCKNKECRKHTLHKVTQYKKGKDSLAAQGKRRYDRKQSGYGGQTKPVFHKKAKTTKKIVLRLQCQGCKHVSQHPIKRCKHFEIGGDKKGKGTSLFLSNLLQACLQLLYRIFLF

SEQ ID NO: 7977 - protein, 46 aa, Brassica rapa
HASARFTGSISEAAENGEHSQDKENLLPSNKVMQVNIPCTRVAQYK

SEQ ID NO: 7978 - protein, 92 aa, Brassica juncea
MVNVPKTKKTYCKSKDCRKHTLHKVTQYKKGKDSLAAQGKRRYDRKQSGYGGQTKPVFHKKAKTTKKIVLRLQCQGCKHVSQHPIKRCKHFE

SEQ ID NO: 7979 - protein, 124 aa, Carpinus betulus
MVNVPKTKKTYCKNKECKKHTLHKVTQYKKGKDSLAAQGKRRYDRKQSGYGGQTKPVFHKKAKTTKKIVLRLQCQSCKHVSQHAIKRCKHFEIGGDKKGKGPLFSKGILLVLFYFVFLFNVVGA

SEQ ID NO: 7980 - protein, 104 aa, Medicago truncatula
MVNVPKTKRAFCKDKNCKKHTVHKVTQYKTGKASLYAQGKRRYDRKQSGYGGQTKPVFHKKAKTTKKIVLRLQCQLCKAVHMHPIKRCKHFEIGGDKKGKNQMY

SEQ ID NO: 7981 - protein, 102 aa, Sarracenia psittacina
MVNVPKTKRAFCKDKNCKKHTVHKVTQYKTGKASLYAQGKRRYDRKQSGYGGQTKPVFHKKAKTTKKIVLRLQCQLCKAVHMHPIKRCKHFEIGGDKKGKNQ

SEQ ID NO: 7982 - protein, 106 aa, Taxus baccata
MVNVPKTRKTYCKGKACKKHTQHKVTQYKAGKASLFAQGKRRYDRKQSGYGGQTKPVFHKKAKTTKKVVLRLECVSCKTKSQLSLKRCKHFELGGDKKTKGAALVF

SEQ ID NO: 7983 - protein, 265 aa, Zea mays
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAANA

SEQ ID NO: 7984 - protein, 264 aa, Sorghum bicolor
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAAA

SEQ ID NO: 7985 - protein, 265 aa, Setaria italica
MARGLKKHLKRLNAPKHWMLDKLGGAFAPKPSSGPHKSRECLPLILIIRNRLKYALNYREVISILMQRHVLVDGKVRTDKTYPAGFMDVISIPKTNENYRLLYDTKGRFRLHPIRDEDAKTKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 7986 - protein, 265 aa, Panicum virgatum
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDAQGHQFATRLGNVFTIGKGNKPWVSLPKGKGIKLSIIEEQRKRDAAAQAAANA

SEQ ID NO: 7987 - protein, 265 aa, Panicum virgatum
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 7988 - protein, 265 aa, Cenchrus ciliaris
MARGLKKHLKRLNAPKHWMLDKLGGAFAPKPSSGPHKSRECLPLILIIRNRLKYALTYGEVISILMQRHVLVDGKVRTDKTYPAGFMDVISIPKTNENYRLLYDTKGRFRLHPIRDEDAKTKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 7989 - protein, 265 aa, Sorghum bicolor
MARGLKKHLKRLNAPKHWMLDKLGGAFAPKPSSGPHKSRECLPLILIIRNRLKYALTYREVISILMQRHVLVDGKVRTDKTYPSGFMDVISIPKTGENYRLLYDTKGRFRLHSVRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHAFATRMGNVFTIGKGNKPWVSLPKGKGIKLSIIEEQRKRDAAAQAAANA

SEQ ID NO: 7990 - protein, 108 aa, Pennisetum glaucum
MGKEKSHINIVVIGHVDSGKSTTTGHLIYKLGGIDKRVIERFEKEAAEMNKRSFKYAWVLDKLRGITIDIALWKFETTKYYCTVIDAPGHRDFINYRYLPGRLCCPHH

SEQ ID NO: 7991 - protein, 265 aa, Pennisetum glaucum
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHAIKDEDAKTKLCKVRSVQFGQKGIPYLNTYDGRTIRYPDPLIKANDTIKIDLETNKIIDFIKFDVGNVVMVTGGRNTGRVGVIKNREKHKGSFETIHVEDALGHQFATRLGNVFTIGKGTKPWVSLPKGKGIKLSIIEEQRKRDAAAQAAANA

SEQ ID NO: 7992 - protein, 265 aa, Pennisetum glaucum
MARGLKKHLQRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHAIKDEDAKTKLCKVRSVQFGQKGIPYLNTYDGRTIRYPDPLIKANDTIKIDLETNKIIDFIKFDVGNVVMVTGGRNTGRVGVIKNREKHKGSFETIHVEDALGHQFATRLGNVFTIGKGTKPWVSLPKGKGIKLSIIEEQRKRDAAAQAAANA

SEQ ID NO: 7993 - protein, 265 aa, Oryza sativa
MARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHAFATRLGNVFTIGKGNKPWVSLPKGKGIKLSIIEEQRKRDAAAQAAANA

SEQ ID NO: 7994 - protein, 265 aa, Oryza sativa
MARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPIIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 7995 - protein, 264 aa, Eragrostis curvula
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIKDEDSKWKLCKVRSVQFGQKGIPYLNTYDGRTIRYPDPLIKANDTIKIDLETNKIVDFIKFDVGNVIMVTGGRNTGRVGVIKNREKHKGTFETIHVEDALGHQFATRLGNVFTIGKGTKPWVSLPKGKGIKLSIIEEQRKRDAAAQAAAA

SEQ ID NO: 7996 - protein, 264 aa, Cynodon dactylon
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPVKDEDAKWKLCKVRSVQFGQKGIPYLNTYDGRTIRYPDPLIKANDTIKIDLETNKIIDFIKFDVGNVIMVTGGRNTGRVGIIKNREKHKGTFETIHVEDATGHQFATRLGNVFTIGKGTKPWVSLPKGKGIKLSIIEEQRKRDAAAQAAAA

SEQ ID NO: 7997 - protein, 265 aa, Unknown
  Sequence found in Organisms: Hordeum vulgare, Leymus cinereus x Leymus triticoides, Pseudoroegneria spicata, Triticum aestivum
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 7998 - protein, 265 aa, Brachypodium distachyon
MARGLKKHLKRLNAPSHWMLDKLGGAFAPKPSSGPHKARECLPLILILRNRLKYALTYREVQSILMQRQILVDGKVRTDKTYPAGFMDIISIPKTGENYRLLYDTKGRFRLHSVRDEDSKFKLCKVRSVQFGQKGIPYLNTYDGRTIRYPDPLIKANDTIKIDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 7999 - protein, 265 aa, Avena sativa
MARGLKKHLKRLNAPSHWMLDKLGGAFAPKPSSGPHKARECLPLILILRNRLKYALTYREVQSILMQRHIQVDGKVRTDKTYPAGFMDIISIPKTGENYRLLYDTKGRFRLHAVRDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 8000 - protein, 116 aa, Secale cereale
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTEGPLPPSLCQG

SEQ ID NO: 8001 - protein, 265 aa, Secale cereale
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 8002 - protein, 265 aa, Secale cereale
MARVWKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 8003 - protein, 262 aa, Cleome gynandra
MARGLKKHLKRLNAPKHWMLDKLGGAFAPKPSSGPHKSRECLPLILIIRNRLKYALTYREVIAILMQRHVLVDGKVRTDKTYPAGFMDVVSIPKTNENFRLLYDTKGRFRLHSIRDEEAKFKLCKVRSVQFGQKGIPYLNTYDGRTIRYPDPLIKANDTIKLDLESNKIVDFIKFDVGNVVMVTGGRNRGRVGVIKNREKHKGSFETIHVQDATGHEFATRMGNVFTIGKGTKPWVSLPKGKGIKLSIIEEARKRLAAQQAA

SEQ ID NO: 8004 - protein, 264 aa, Olea europaea
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSIRDEEAKFKLCKVRSVQFGKKGIPYLNTYDGRTIRYPDPLIKANDTIKLDLETNKIVDFIKFDVGNVVMVTGGRNRGRVGVIKNREKHKGSFETIHVQDAVGHEFATRLGNVFTIGKGTKPWVSLPKGKGIKLSIIEEARKRLAAQSAATA

SEQ ID NO: 8005 - protein, 262 aa, Carica papaya
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHTIRDEEAKFKLCKVRSVQFGQKGIPYLNTYDGRTIRYPDPLIKANDTIKLDLETNKIVDFIKFDVGNVVMVTGGRNRGRVGVIKNREKHKGSFETIHVQDAVGHEFATRMGNVFTIGKGAKPWVSLPKGKGIKLSIIEESRKRLAAQQAA

SEQ ID NO: 8006 - protein, 262 aa, Cleome spinosa
MARGLKKHLKRLNAPKHWMLDKLGGAFAPKPSSGPHKSRECLPLILIIRNRLKYALTYREVIAILMQRHVLVDGKVRTDKTYPAGFMDVVSIPKTNENFRLLYDTKGRFRLHSIRDEEAKLKLCKVRSVQFGQKGIPYLNTYDGRTIRYPDPLIKANDTIKLDLETNKIVDFIKFDVGNVVMVTGGRNRGRVGVIKNREKHKGSFDTIHIQDATGHEFATRMGNVFTIGKGTKPWVSLPKGKGIKLSIIEEARKRLVAQQAA

SEQ ID NO: 8007 - protein, 262 aa, Cleome spinosa
MARGLKKHLKRLNAPKHWMLDKLGGAFAPKPSSGPHKSRECLPLILIIRNRLKYALTYREVIAILMQRHVLVDGKVRTDKTYPAGFMDVVSIPKTNENFRLLYDTKGRFRLHSIRDEEAKFKLCKVRSVQFGQKGIPYLNTYDGRTIRYPDPLIKANDTIKLDLESNKIVDFIKFDVGNVVMVTGGRNRGRVGVIKNREKHKGSFDTIHIQDATGHEFATRMGNVFTIGKGTKPWVSLPKGKGIKLSIIEEARKRLASQQAA

SEQ ID NO: 8008 - protein, 265 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLETNKIVDFIKFDVGNVVMVTGGRNTGRVGVIKNREKHKGSFDTIHVQDATGHEFATRMGNVFTIGKGTKPWVSLPKGKGIKLSIIEEARKRLAAAGATATA

SEQ ID NO: 8009 - protein, 264 aa, Fraxinus spp
MARGLKKHLKRLNAPKHWMLDKLGGAFAPKPSSGPHKSRECLPLILIMRNRLKYALTYREVIAILMQRHVLVDGKVRTDKTYPAGFMDVVSIPKTNENFRLLYDTKGRFRLHSIRDEEAKFKLCKVRSVQFGKKGIPYLNTYDGRTIRYPDPLIKANDTVKLDLETNKIVDFIKFDVGNVVMVTGGRNRGRVGVIKNREKHKGSFETIHVQDAVGHEFATRLGNVFTIGKGTKPWVSLPKGKGIKLSIIEEARKRLAAQSAATA

SEQ ID NO: 8010 - protein, 264 aa, Olea europaea
MARGLKKHLKRLNAPKHWMLDKLGGAFAPKPSSGPHKSRECLPLILIIRNRLKYALTYREVIAILMQRHVLVDGKVRTDKTFPAGFMDVVSIPKTNENFRLLYDTKGRFRLHSIRDEEAKFKLCKVRSVQFGKKGIPYLNTYDGRTIRYPDPLIKANDTIKLDLETNKIVDFIKFDVGNVVMVTGGRNRGRVGVIKNREKHKGSFETIHVQDATGHEFATRLGNVFTIGKGTKPWVSLPKGKGIKLSIIEEARKRLAAQSAVTA

SEQ ID NO: 8011 - protein, 262 aa, Carica papaya
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFCLHTVRDEEAKFKLCKVRSVQFGQKGIPYLNTYDGRTIRYPDPLIKANDTIKLDLETNKIVDFIKFDVGNVVMVTGGRNRGRVGVIKNREKHKGSFETIHVQDAVGHEFATRMGNVFTIGKGSKPWVSLPKGKGIKLSIIEESRKRLAAQQAA

SEQ ID NO: 8012 - protein, 263 aa, Panicum virgatum
MARGLKKHLKRLNAPKHWMLDKLGGAFAPKPSSGPHKARECLPLILILRNRLKYALTYREVISILMQRQVMVDGKVRTDKTYPSGFMDVVSIPKTGENFRLLYDTKGRFRLHSIRDDEAKFKLCKVRSVQFGQKGIPFLNTYDGRTIRYPDPLIKANDTIKIDLETNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 8013 - protein, 263 aa, Ricinus communis
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDDEAKFKLCKVRSVQFGQKGIPYLNTYDGRTIRYPDPLIKANDTIKLDLESNKITDFIKFDVGNVVMVTGGRNRGRVGVIKNREKHKGSFETIHVQDATGHEFATRMGNVFTIGKGTKPWVSLPKGKGIKLSIIEEARKRLAAAQAVA

SEQ ID NO: 8014 - protein, 264 aa, Coffea canephora
MARGLKKHLKRLNAPKHWMLDKLGGAFAPKPSSGPHKSRECLPLILILRNRLKYALTYREVISILMQRHILVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLESNKITDFIKFDVGNVVMVTGGRNRGRVGVIKNREKHKGSFETIHVQDATGHEFATRLGNVFIIGKGAKPWVSLPKGKGIKLSVIEEQRKRIAAQAATTA

SEQ ID NO: 8015 - protein, 264 aa, Eucalyptus grandis
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSIRDDEAKFKLCKVRSVQFGQKGIPYLNTYDGRTIRYPDPLIKANDTVKLDLETNKITDFIKFDVGNVVMVTGGRNRGRVGVIKNREKHKGTFETIHVQDSQGHEFATRLGNVYTIGKGTKPWVSLPKGKGIKLSIIEEARKRLAAQASATA

SEQ ID NO: 8016 - protein, 264 aa, Fraxinus spp
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDEEAKFKLCKVRSIQFGKKGIPYLNTYDGRTIRYPDPLIKANDTVKLDLETNKIVDFIKFDVGNVVMVTGGRNRGRVGVIKNREKHKGSFETIHVQDAVGHEFATRLGNVFTIGKGTKPWVSLPKGKGIKLSIIEEARKRLAAQSAATA

SEQ ID NO: 8017 - protein, 263 aa, Pennisetum glaucum
MARGLKKHLKRLNAPKHWMLDKLGGAFAPKPSSGPHKARECLPLILILRNRLKYALTYREVISILMQRQVMVDGKVRTDKTYPSGFMDVVSIPKTGENFRLLYDTKGRFRLHSLRDDEAKFKLCKVRSVQFGQKGIPYLNTYDGRTIRYPDPLIKANDTIKIDLDTNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 8018 - protein, 264 aa, Arachis hypogaea
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSIRDEEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDAMGHEFATRMGNVFTIGKGSKPWVSLPKGKGIKLTIIEEARKRTAAQQAVTA

SEQ ID NO: 8019 - protein, 263 aa, Lippia dulcis
MARGLKKHLKRLNAPKHWMLDKLGGAFAPKPSSGPHKSRECLPLILILRNRLKYALNYREVISILMQRHVLVDGKVRTDKTYPSGFMDVVSIPKTNENFRLLYDTKGRFRLHSIRDEEAKFKLCKVRSVQFGKKGIPYLNTYDGRTIRYPDPLIKANDTIKFDLESNKIVDFIKFDVGNVVMVTGGRNRGRVGVIKNREKHKGSFETIHIQDATGHEFATRLGNVFTIGKGTKPWVSLPKGKGIKLSIIEEARKRLAAQAATA

SEQ ID NO: 8020 - protein, 263 aa, Sorghum bicolor
MARGLKKHLKRLNAPKHWMLDKLGGAFAPKPSSGPHKARECLPLILILRNRLKYALTYREVISILMQRLVMVDGKVRTDKTYPSGFMDVVSIPKTGENFRLLYDTKGRFRLHSIRDDEAKFKMCKVRSVQFGQKGIPFLNTYDGRTIRYPDPLIKANDTIKIDLETNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 8021 - protein, 263 aa, Saccharum officinarum
MARGLKKHLKRLNAPKHWMLDKLGGAFAPKPSSGPHKARECLPLILILRNRLKYALTYREVISILMQRHVMVDGKVRTDKTYPSGFMDVVSIPKTGENFRLLYDTKGRFRLHSIRDDEAKFKMCKVRSVQFGQKGIPFLNTYDGRTIRYPDPLIKANDTIKIDLDTNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 8022 - protein, 264 aa, Amsonia hubrichtii
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLETNKIVDFIKFDVGNVVMVTGGRNRGRVGVIKNREKHKGSFETIHIQDATGHEFATRLGNVFTIGKGTKPWVSLPKGKGIKLSIIEEARKRNASQSATTA

SEQ ID NO: 8023 - protein, 265 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLEANKIVDFIKFDVGNVVMVTGGRNTGRVGVIKNREKHKGSFETIHVQDATGHEFATRMGNVFTIGKGTKPWVSLPKGKGIKLSIIEEARKRLAAAGATATA

SEQ ID NO: 8024 - protein, 264 aa, Vaccinium corymbosum
MARGLKKHLKRLNAPKHWMLDKLGGAFAPKPSSGPHKSRECLPLILIIRNRLKYALTYREVIAILMQRQVLVDQKVRTDKTYPAGFMDVVSIPKTNENFRLLYDTKGRFRLHSIRDEEAKFKLCKVRSVQFGSKGIPYINTYDGRTIRYPDPLIKANDTIKFDLETNKITDFIKFDVGNVVMVTGGRNRGRVGVIKSREKHKGSFETIHVQDATGHEFATRMGNVFTIGKGSKPWVSLPKGKGIKLSIIEEARKRLAAQTGAAA

SEQ ID NO: 8025 - protein, 263 aa, Cenchrus ciliaris
MARGLKKHLKRLNAPKHWMLDKLGGAFAPKPSSGPHKARECLPLILILRNRLKYALTYREVISILMQRQVMVDGKVRTDKTYPSGFMDVVSIPKTGENFRLLYDTKGRFRLHSLRDDEAKFKLCKVRSVQFGQKGIPFLNTYDGRTIRYPDPLIKANDTIKIDLDTNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 8026 - protein, 264 aa, Cyamopsis tetragonoloba
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDEEAKFKLCKVRSVQFGQKGIPYLNTYDGRTIRYPDPIIRANDTIKLDLEENKIVDFIKFDVGNVVMVTGGRNRGRVGVIKNREKHKGSFETIHVQDATGHEFATRLGNVFTIGKGNKPWVSLPKGKGIKLSIIEEARKRIAAQQATAA

SEQ ID NO: 8027 - protein, 265 aa, Fraxinus spp
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDEEAKFKLCKVRSIQFGKKGIPYLNTYDGRTIRYPDPLIKANDTVKLDLETNKIVDFIKFDVGNVVMVTGGRNRGRVGVIKNREKHKGSFETIHVQDAVGHEFATRLGNVFTIGKGTKPWVSLPKGKGIKLSIIEDARKRLAAAQSAATA

SEQ ID NO: 8028 - protein, 263 aa, Lippia dulcis
MARGLKKHLKRLNAPKHWMLDKLGGAFAPKPSSGPHKSRECLPLILILRNRLKYALNYREVISILMQRHVLVDGKVRTDKTYPSGFMDVVSIPKTNENFRLLYDTKGRFRLHSIRDEESKFKLCKVRSVQFGKKGIPYLNTYDGRTIRYPDPLIKANDTIKFDLEANKIVDFIKFDVGNVVMVTGGRNRGRVGVIKNREKHKGSFETIHIQDATGHEFATRLGNVFTIGKGTKPWVSLPKGKGIKLSIIEEARKRLAAQAATS

SEQ ID NO: 8029 - protein, 263 aa, Lippia dulcis
MARGLKKHLKRLNAPKHWMLDKLGGAFAPKPSSGPHKSRECLPLILILRNRLKYALNYREVISILMQRHVLVDGKVRTDKTYPSGFMDVVSIPKTNENFRLLYDTKGRFRLHSIRDEEAKFKLCKVRSVQFGKKGIPYLNTYDGRTIRYPDPLIKANDTIKFDLESQKIVDFIKFDVGNVVMVTGGRNRGRVGVIKNREKHKGSFETIHIQDATGHEFATRLGNVFTIGKGTKPWVSLPKGKGIKLSIIEEARKRLAAQAATA

SEQ ID NO: 8030 - protein, 263 aa, Plantago ovata
MARGLKKHLKRLNAPKHWMLDKLGGAFAPKPSSGPHKSRECLPLVLIIRNRLKYALTYREVIAILMQRHVLVDGKVRTDKTYPAGFMDVVSIPKTNENFRLLYDTKGRFRLHSVRDEEAKFKLCKVRSIQFGKKGIPYLNTYDGRTIRYPDPLIKANDTIKLDLEANKIVDFIKFDVGNVVMVTGGRNRGRVGVIKNREKHKGSFETIHVQDSTGHEFATRLGNVFTIGKGTKPWVSLPKGKGIKLSIIEEARKRLAAQAATA

SEQ ID NO: 8031 - protein, 264 aa, Platanus occidentalis
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIKDEEAKFKLCKVRSVQFGQKGIPYINTYDGRTIRYPDPLIKANDTIKLDLESNKIIDFIKFDVGNVVMVTGGRNRGRVGVIKNREKHKGSFETIHVQDATGHEFATRLGNVYTIGKGTKPWVSLPKGKGIKLSIIEEARKRLAAQAASTA

SEQ ID NO: 8032 - protein, 264 aa, Platanus occidentalis
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIKDEEAKFKLCKVRSVQFGQKGIPYINTYDGRTIRYPDPLIKANDTIKLDLESNKIIDFIKFDVGNVVMVTGGRNRGRVGVIKNREKHKGSFETIHVQDATGHEFATRLGNVYTIGKGTKPWVSLPKGKGIKLSIIEEARKRLAAQAATTA

SEQ ID NO: 8033 - protein, 263 aa, Oryza sativa
MARGLKKHLKRLNAPSHWMLDKLGGAFAPKPSSGPHKARECLPLILILRNRLKYALTYREVISILMQRHVMVDGKVRTDKTYPAGFMDVVSIAKTGENFRLLYDTKGRFRLHSIKDEDAKFKLCKVRSVQFGQKGIPFLNTNDGRTIRYPDPLIKANDTIKIDLETNKIVDFIKFDVGNIVMVTGGRNTGRVGVIKSREKHKGSFETIHVEDALGHQFATRMGNVFTIGKERKPWVSLPKGKGIKLSIIEEARKRNAEAAAEA

SEQ ID NO: 8034 - protein, 265 aa, Sarracenia psittacina
MARGLKKHLKRLNAPKHWMLDKLGGAFAPKPSSGPHKSRECLPLILILRNRLKYGLTYREVISILMQRHVLVDGKVRTDKTYPAGFMDVVSIPKTNENFRLLYDTKGRFRLHSLRDEEAKFKLCKVRSVQFGQKGIPYLNTYDGRTIRYPDPLIKANDTIKLDLETNKIADFIKFDVGNVVMVTGGRNRGRVGVIKNREKHKGSFETVHIQDATGHEFATRMGNVFTIGKGTKPWVSLPKGKGIKLSIIEEAKKRLAATQAGATA

SEQ ID NO: 8035 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDSTGHEFATRMGNVFTIGKGTKPWISLPKGKGIKLSIIEEARKRIAAQQATAA

SEQ ID NO: 8036 - protein, 265 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSIRDEEAKFKLCKVRSVQFGQKGIPYLNTYDGRTIRYPDPLIKANDTIKLDLETNKIVDFIKFDVGNVVMVTGGRNTGRVGVIKNREKHKGSFETIHIQDATGHEFATRLGNVFTIGKATKPWVSLPKGKGIKLSIIEEARKRLAAANATATA

SEQ ID NO: 8037 - protein, 265 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVRFGQKGIPYLNTYDGRTIRYPDPLIKANDTIKLDLEANKIVDFIKFDVGNVVMVTGGRNTGRVGVIKNREKHKGSFETIHVQDATGHEFATRMGNVFTIGKGTKPWVSLPKGKGIKLSIIEEARKRLAAAGATATA

SEQ ID NO: 8038 - protein, 264 aa, Vaccinium corymbosum
MARGLKKHLKRLNAPKHWMLDKLGGAFAPKPSSGPHKSRECLPLILILRNKLKYALTYREVIAILMQRHVFVDGKVRTDKTYPAGFMDVVSIPKTNENFRLLYDTKGRFRLHSVRDEESKFKLCKVRSVQFGQKGIPYINTYDGRTIRYPDPLIKANDTIKLDLETNKITDFIKFDVGNVVMVTGGRNRGRVGVIKNREKHKGSFETIHVQDSVGHEFATRMGNVFTIGKGSKPWVSLPKGKGIKLSIIEEARKRLAAQTSATV

SEQ ID NO: 8039 - protein, 265 aa, Elaeis guineensis
MARGLKKHLKRLNAPKHWMLDKLGGAFAPKPSSGPHKARECLPLILILRNRLKYALTYREVIAILMQRHVLVDGKVRTDKTYPAGFMDVVSIPKTNENFRLLYDTKGRFRLHSIRDEEAKFKLCKVRSVQFGHKGIPYLNTYDGRTIRYPDPLIKANDTIKLDLETYKIVDFIKFDVGNVVMVTGGRNRGRVGVIKNREKHKGSFETIHLQDATGHEFATRLGNVFTIGKGTKPWVSLPKGKGIKLSIIEEARKRLAASGAAATA

SEQ ID NO: 8040 - protein, 263 aa, Plantago ovata
MARGLKKHLKRLNAPKHWMLDKLGGAFAPKPSSGPHKSRECLPLVLIIRNRLKYALTYREVIAILMQRHVLVDGKVRTDKTYPAGFMDVVSIPKTNENFRLLYDTKGRFRLHSVRDEEAKFKLCKVRSIQFGKKGIPYLNTYDGRTIRYPDPLIKANDTIKLDLEANKIVDFIKFDVGNVVMVTGGRNRGRVGVIKNREKHKGSFETIHVQDATGHEFATRLGNVFTIGKGTKPWVSLPKGKGIKLSIIEEARKRLAAQAATA

SEQ ID NO: 8041 - protein, 258 aa, Secale cereale
HLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 8042 - protein, 264 aa, Antirrhinum majus
  misc_feature (186)..(186): Xaa can be any naturally occurring amino acid
MARGLKKHLKRLNAPKHWMLDKLGGAFAPKPSSGPHKSRECLPLMLIIRNRLKYALTYREVIAILMQRHVLVDGKVRTDKTYPAGFMDVISIPKTNESFRLLYDTKGRFRLHSLRDEEAKFKLCKVRSVQFGKKGIPYINTYDGRTIRYPDPLIKANDTIKLDLEENKIVDFIKFDVGNVVMVTGXRNRGRVGVIKNREKHKGSFETIHVQDSTGHEFATRLGNVFTIGKGTKPWISLPKGKGIKLSIIEEARKRLAAQSAATA

SEQ ID NO: 8043 - protein, 265 aa, Musa acuminata
MARGLKKHLKRLNAPRHWMLDKLGGAFAPKPSSGPHKARECLPLILILRNKLKYALTYREVIAILMQRHVMVDGKVRTDKTYPAGFMDVVSIPKTNENFRLLYDTKGRFRLHSIRDEESKFKLCKVRSVQFGQKGIPYLNTFDGRTIRYPDPLIKANDTIKLDLETNKIVDFIKFDVGNVVMVTGGRNTGRVGVIKNREKHKGSFETIHVQDATGHEFATRMGNVFTIGKGTKPWVSLPKGKGIKLSIIEEARKRLAAASATATA

SEQ ID NO: 8044 - protein, 263 aa, Ricinus communis
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDDEAKFKLCKVRSVQFGQKGIPYLNTYDGRTIRYPDPLIKANDTIKLDLESNKITEFIKFDVGNVVMVTGGRNRGRVGVIKNREKHKGSFETIHIQDSTGHEFATRMGNVFTIGKGTKPWVSLPKGKGIKLSIIEEARKRLAASQTAA

SEQ ID NO: 8045 - protein, 264 aa, Vigna unguiculata
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRLGNVFTIGKGTKPWVSLPKGKGIKLSIIEEARKRIAAQQATAA

SEQ ID NO: 8046 - protein, 264 aa, Cucurbita pepo
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSVRDEEAKYKLCKVRSVQFGQKGIPYLNTYDGRTIRYPDPLIKANDTIKLDLETNKIADFIKFDVGNVVMVTGGRNRGRVGVIKNREKHKGSFETIHVQDATGHEFATRLCNVFTVGKGTKPWLSLPKGKGIKLSIIEEARKRLASQAAVTA

SEQ ID NO: 8047 - protein, 264 aa, Cucurbita pepo
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLDSNKIADFIKFDVGNVVMVTGGRNRGRVGVIKNREKHKGSFETIHIQDATGHEFATRLGNVFTIGKGTKPWVSLPKGKGIKLSIIEEARKRLANQAAVTV

SEQ ID NO: 8048 - protein, 264 aa, Cucurbita pepo
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDEESKFKLCKVRSVQFGQKGIPYLNTYDGRTIRYPDPLIKANDTIKLDLDSNKIADFIKFDVGNVVMVTGGRNRGRVGVIKNREKHKGSFETIHVQDATGHEFATRLCNVFTIGKGTKPWVSLPKGKGIKLSIIEEARKRLASQTAATA

SEQ ID NO: 8049 - protein, 264 aa, Eucalyptus grandis
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSIRDDEAKFKLCKVRSIQFGQKGIPYLNTYDGRTIRYPDPLIKANDTIKLDLETNKITDFIKFDVGNVVMVTGGRNRGRVGIIKNREKHKGTFETIHVQDSLGHEFATRLGNVFIIGKGSKPWLSLPKGKGIKLSIIEEARKRLAAQASATA

SEQ ID NO: 8050 - protein, 264 aa, Unknown
  Sequence found in Organisms: Euonymus alatus, Tripterygium wilfordii
MARGLKKHMKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYLNTYDGRTIRYPDPLIKANDTIKLDFETNKIADFIKFDVGNVVMVTGGRNRGRVGVIKNREKHKGSFETIHIQDAQGHEFATRLGNVFTIGKGTKPWVSLPKGKGIKLSIIEEARKRLAAQQATTA

SEQ ID NO: 8051 - protein, 264 aa, Actinidia deliciosa
MARGLKKHLKRLNAPSHWMLDKLGGAFAPKPSSGPHKSRECLPLMLILRNRLKYALTYREVIAILMQRHILVDGKVRTDKTYPTGFMDVVSIPKTNENFRLLYDTKGRFRLHSLRDEEAKFKLCKVRSVQFGQKGIPYLNTYDGRTIRYPDPLIKANDTIKLDLETNKITDFIKFDVGNVVMVTGGRNRGRVGVIKNREKHKGSFETIHVQDATGHEFATRMGNVFTIGKGTKPWVSLPKGKGIKLTIIEEARKRLAAQASATA

SEQ ID NO: 8052 - protein, 264 aa, Actinidia deliciosa
MARGLKKHLKRLNAPSHWMLDKLGGAFAPKPSSGPHKSRECLPLMLILRNRLKYALTYREVIAIQMQRHILVDGKVRTDKTYPTGFMDVVSIPKTNENFRLLYDTKGRFRLHSLRDEEAKFKLCKVRSVQFGQKGIPYLNTYDGRTIRYPDPLIKANDTIKFDLETNKITDFIKFDVGNVVMVTGGRNRGRVGVIKNREKHKGSFETIHVQDATGHEFATRMGNVFTIGKGTKPWVSLPKGKGIKLSIIEEARKRLAAQASATA

SEQ ID NO: 8053 - protein, 264 aa, Actinidia deliciosa
MARGLKKHLKRLNAPSHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIRDEEAKFKLCKVRSVQFGQKGIPYINTYDGRTIRYPDPLIKANDTVKLDLESNKITDFIKFDVGNVVMVTGGRNRGRVGVIKNREKHKGSFETIHIQDSTGHEFATRMGNVFTIGKGSKPWVSLPKGKGIKLSIIEEARKRLAAQAGAAA

SEQ ID NO: 8054 - protein, 264 aa, Cucumis melo
MARGLKKHLKRLNAPKHWMLDKLGGAFAPKPSSGPHKSRECLPLILILRNRLKYALTYREVIAILMQRHVLVDAKVRTDKTYPAGFMDVVSIPKTSENFRLLYDTKGRFRLHSIRDEEAKFKLCKVRSVQFGQKGIPYLNTYDGRTIRYPDPLIKANDTIKLDLESNKIADFIKFDVGNVVMVTGGRNRGRVGVIKNREKHKGSFETIHIQDATGHEFATRLGNVFTIGKGTKPWVSLPKGKGIKLTIIEEARKRLASQAAVTA

SEQ ID NO: 8055 - protein, 264 aa, Olea europaea
MARGLKKHLKRLNAPKHWMLDKLGGAFAPKPSSGPHKSRECLPLILIMRNRLKYALTYREVIAILMQRHVLVDGKVRTDKTYPAGFMDVVSIPKTNENFRLLYDTKGRFRLHSVRDEEAKFKLCKVRSVQFGKKGIPYLNTYDGRTIRYPDPLIKANDSIKLDLETNKIVDFIKFDVGNVVMVTGGRNRGRVGVIKNREKHKGSFETIHVQDALGHEFATRLGNVFTIGKGTKPWVSLPKGKGIKLSIIEEARKRLAAQSATTV

SEQ ID NO: 8056 - protein, 264 aa, Prunus persica
MARGLKKHLKRLNAPKHWMLDKLGGAFAPKPSSGPHKSRECLPLVIILRNRLKYALTYREVISILMQRHVLVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLETNKITDFIKFDVGNVVMVTGGRNRGRVGVIKNREKHKGSFETIHVQDASGHEFATRLGNVFTIGKGTKPWVSLPKGKGIKLTIIEEAKKRQAAQATATA

SEQ ID NO: 8057 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDEESKFKLCKVRSVQFGQKGIPYLNTYDGRTIRYPDPLIKANDTIKLDLESNKITDFIKFDVGNVVMVTGGRNRGRVGVIKNREKHKGSFETIHVQDATGHEFATRMGNVFIIGKGTKPWVSLPKGKGIKLSIIEEARKRLAAQNETVA

SEQ ID NO: 8058 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDEESKFKLCKVRSVQFGQKGIPYLNTYDGRTIRYPDPLIKANDTIKLDLESNKITDFIKFDVGNVVMVTGGRNRGRVGVIKNREKHKGSFETIHVQDATGHEFATRMGNVFIIGKGTKPWVSLPKGKGIKLSIIEEARKRLAAQKETVA

SEQ ID NO: 8059 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDDEAKFKLCKVRSVQFGQKGIPYLNTYDGRTIRYPDPLIRANDTVKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATTA

SEQ ID NO: 8060 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATAA

SEQ ID NO: 8061 - protein, 264 aa, Tabernaemontana elegans
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLETNKIVDFIKFDVGNVVMVTGGRNRGRVGVIKNREKHKGSFETIHIQDATGHEFATRLGNVFTIGKGTKPWVSLPKGKGIKLSIIEEAHKRNAIQSATTA

SEQ ID NO: 8062 - protein, 265 aa, Vinca minor
MARGLKKHLKRLNAPKHWMLDKLGGAFAPKPSSGPHKSRECLPLILIMRNKLKYALNYREVVSILMQRHVMVDGKVRTDKTYPAGFMDVVSIPKTNENFRLLYDTKGRFRLHSLRDEEAKFKLCKVRSIQFGQKGIPYLNTYDGRTIRYPDPLIKANDTIKLDLETNKIVDFIKFDVGNVVMVTGGRNRGRVGVIKNRDKNKGSFETIHVQDATGHEFATRLGNVFTIGKGNKPWVSLPKGKGIKLSIIEEQKKRLAATQSAATA

SEQ ID NO: 8063 - protein, 265 aa, Musa acuminata
MARGLKKHLKRLNAPRHWMLDKLGGAFAPKPSSGPHKARECLPLILILRNKLKYALTYREVIAILMQRHVMVDGKVRTDKTYPAGFMDVVSIPKTNENFRLLYDTKGRFRLHSIRDEESKFKLCKVRSVQFGQKGIPYLNTFDGRTIRYPDPLIKANDTIKLDLETNKIVDFIKFDVGNIVMVTGGRNTGRVGVIKNREKHKGSFETIHVQDATGHEFATRMGNVFTIGKGTKPWVSLPKGKGIKLSIIEEARKRLAAASATATA

SEQ ID NO: 8064 - protein, 262 aa, Tropaeolum majus
MARGLKKHLKRLNAPKHWMLDKLGGAFAPKPSSGPHKSRECLPLILILRNRLKYALTYREVIAILMQRHILVDGKVKTDKTYPAGFMDVISIPKTNENFRLLYDTKGRFRLHSVRDEESKFKLCKVRSVQFGQKGIPYINTYDGRTIRYPDPLIKANDTIKLDLEANKIVDFIKFDVGNVVMVTGGRNRGRVGVIKNREKHKGSFETIHVQDSLGHEFATRLGNVFTIGKGTKPWVSLPKGKGIKLTIIEEARKRLAAQQAA

SEQ ID NO: 8065 - protein, 262 aa, Tropaeolum majus
MARGLKKHLKRLNAPKHWMLDKLGGAFAPKPSSGPHKSRECLPLILILRNRLKYALTYREVIAILMQRHILVDGKVRTDKTYPAGFMDVMSIPKTNENFRLLYDTKGRFRLHSIRDEEAKFKLCKVRSVQFGQKGIPYINTFDGRTIRYPDPLIKANDTIKLDLEANKIVDFIKFDVGNVVMVTGGRNRGRVGVIKNREKHKGSFETIHVQDAQGHEFATRLGNVFTIGKGTKPWVSLPKGKGIKLTIIEEARKRIAAQQAA

SEQ ID NO: 8066 - protein, 265 aa, Elaeis guineensis
MARGLKKHLKRLNAPKHWMLDKLGGAFAPKPSSGPHKARECLPLILILRNRLKYALTYREVIAILMQRHVLVDGKVRTDKTYPAGFMDVVSIPKTNENFRLLYDTKGRFRLHSIRDEEAKFKLCKVRSVQFGHKGIPYLNTYDGRTIRYPDPLIKANDTIKLDLETYKIVDFIKFDVGNVVMVTGGRNRGRVGVIKNREKHKGSFETIHLQDATGHEFATRLGNVFTIGKGTKPWVSLPKGKGIKLSIIEEARKRLAASGAAATV

SEQ ID NO: 8067 - protein, 263 aa, Unknown
  Sequence found in Organisms: Catharanthus roseus, Catharanthus roseus
MARGLKKHLKRLNAPKHWMLDKLGGAFAPKPSSGPHKSRECLPLILILRNRLKYALTYREVIAILMQRHIMVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLESNKIVDFIKFDVGNVVMVTGGRNRGRVGVIKNREKHKGSFETIHIQDATGHEFATRLGNVFTIGKGTKPWVSLPKGKGIKLSIIEEQRKRATQSAATA

SEQ ID NO: 8068 - protein, 264 aa, Papaver somniferum
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFCLHSIKDEEAKFKLCKVRNVQFGQKGIPYINTYDGRTIRYPDPLIKANDTIKLDLESNKITDFIKFDVGNVVMVTGGRNRGRVGVIKNREKHKGSFETIHIQDSTGHEFATRLGNVFTIGKGTKPWVSLPKGKGIKLSIIEEARKRLAAQGAATA

SEQ ID NO: 8069 - protein, 264 aa, Rosa hybrid cultivar
MARGLKKHLKRLNAPKHWMLDKLGGAFAPKPSSGPHKSRECLPLIIILRNRLKYALTYREVIAILMQRHVLVDGKVRTDKTYPAGFMDVVSIPKTNENFRLLYDTKGRFRLHSIRDEEAKFKLCKVRSVQFGQKNIPYINTYDGRTIRYPDPLIKANDTIKLDLETNKIIDFIKFDVGNVVMVTGGRNRGRVGVIKNREKHKGSFETIHVQDAAGHEFATRLGNVFTIGKGTKPWVSLPKGKGIKLSIIEEARKRQAALQTATA

SEQ ID NO: 8070 - protein, 264 aa, Malus domestica
MARGLKKHLKRLNAPKHWMLDKLGGAFAPKPSSGPHKSRECLPLVIILRNRLKYALTYREVISILMQRHVLVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLETNKITDFIKFDVGNVVMVTGGRNRGRVGVIKNREKHKGSFETIHVQDASGHEFATRLGNVFTIGKGTKPWISLPKGKGIKLTIIEEAKKRAAAQATATA

SEQ ID NO: 8071 - protein, 263 aa, Aristolochia fimbriata
MARGLKKHLKRLNAPKHWMLDKLGGAFAPKPSSGPHKSRECLPLILILRNKLKYALTYREVISIMMQRHVLVDGKVRTDKTYPAGFMDVVSIPKTNENFRLLYDTKGRFRLHTIKDEEAKFKLCKVRNVQFGQKGIPYLNTYDGRTIRYPDPLIRANDTIKLDLEANKIVDFIKFDVGNVVMVTGGRNRGRVGVIKSREKHKGSFETIHVEDATGHAFATRLGNVFTIGKGTKPWVSLPKGKGIKLSIIEEARKRLAAQAATA

SEQ ID NO: 8072 - protein, 263 aa, Catharanthus roseus
MARGLKKHLKRLNAPKHWMLDKLGGAFAPKPSSGPHKSRECLPLILILRNRLKYALTYREVIAILMQRHVMVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLESNKIVDFIKFDVGNVVMVTGGRNRGRVGVIKNREKHKGSFETIHIQDATGHEFATRLGNVFTIGKGTKPWVSLPKGKGIKLSIIEEQRKRATQSAPTA

SEQ ID NO: 8073 - protein, 264 aa, Chelidonium majus
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIKDEEAKFKLCKVRNVQFGQKGIPYINTYDGRTIRYPDPLIKANDTIKLDLESNKITDFIKFDVGNVVMVTGGRNRGRVGVIKNREKHKGSFETIHIQDSTGHEFATRLGNVFTIGKGTKPWVSLPKGKGIKLSIIEEARKRLAAQGATTA

SEQ ID NO: 8074 - protein, 264 aa, Cucurbita pepo
MARGLKKHLKRLNAPKHWMLDKLGGAFAPKPSSGPHKSRECLPLILILRNRLKYALTYREVISILMQRHVLVDGKVRTDKTFPAGFMDVVSIPKTNENFRLLYDTKGRFRLHSVRDEEAKFKLCKVRSVQFGQKGIPYLNTYDGRTIRYPDPLIKANDTIKLDLDSNKIADFIKFDVGNVVMVTGGRNRGRVGVIKNREKHKGSFETIHVQDATGHEFATRLCNVFTVGKGTKPWVSLPKGKGIKLSIIEEARKRVASQAAVTA

SEQ ID NO: 8075 - protein, 264 aa, Euonymus alatus
MARGLKKHMKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAMFKLCKVRSVQFGQKGIPYLNTYDGRTIRYPDPLIKANDTIKLDFETNKIVDFIKFDVGNVVMVTGGRNRGRVGVIKNREKHKGSFETIHIQDAQGHEFATRLGNVFTIGKGTKPWVSLPKGKGIKLSIIEEARKRLAAQQATTA

SEQ ID NO: 8076 - protein, 263 aa, Euphorbia peplus
MARGLKKHLKRLNAPKHWMLDKLGGAFAPKPSSGPHKSRECLPLILILRNRLKYALTYREVIAILMQRHILVDGKVRTDKTYPAGFMDVVSIPKTNENFRLLYDTKGRFRLHSIRDDEAKFKLCKVRSVQFGQKGIPYLNTYDGRTIRYPDPLIKANDTIKLDLESNKITEFIKFDVGNVVMVTGGRNRGRVGVIKNREKHKGSFETIHIQDATGHEFATRLGNVFTIGKGTKPWVSLPKGKGIKLSIIEEARKRQAAAQTAA

SEQ ID NO: 8077 - protein, 262 aa, Setaria italica
MARGLKKHLKRLNAPKHWMLDKLGGAFAPKPSSGPHKARECLPLILILRNRLKYALTYREVISILMQRQVMVDGKVRTDKTYPSGFMDVVSIPKTGENFRLLYDTKGRFRLHSIRDDEAKFKLCKVRSVQFGQKGIPFLNTYDGRTIRYPDPLIKANDTIKIDLDTNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAEA

SEQ ID NO: 8078 - protein, 264 aa, Panax ginseng
MARGLKKHLKRLNAPKHWMLDKLGGAFAPKPSSGPHKSRECLPLILILRNRLKYALTYREVQSILMQRHVLVDGKVRTDKTYPAGFMDVVSIPKTNENFRLLYDTKGRFRLHSVRDEEAKFKLCKVRSVQFGQKGIPYINTYDGRTIRYPDPLIKANDTIKLDLEANKIADFIKFDVGNVVMVTGGRNTGRVGVIKNREKHKGSFETVHIQDSLGHEFATRLGNVFTIGKGTKPWVSLPKGKGIKLTIIEEARKRNVAQSATTA

SEQ ID NO: 8079 - protein, 264 aa, Vitis vinifera
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLESNKITDFIKFDVGNVVMVTGGRNRGRVGVIKNREKRKGSFETIHVQDATGHEFATRLGNVFIIGKGTKPWVTLPKGKGIKLSIIEEAQKRLAAQAASSA

SEQ ID NO: 8080 - protein, 264 aa, Liriodendron tulipifera
MARGLKKHLKRLNAPKHWMLDKLGGAFAPKPSSGPHKARECLPLILILRNKLKYALTYREVISILMQRHVLVDGKVRTDKTYPAGFMDVVSIPKTNENFRLLYDTKGRFRLHTIKDEEAKFKLCKVRSVQFGQKGIPYLNTYDGRTIRYPDPLIRANDTIKLDLETYKIVDFIKFDVGNVVMVTGGRNRGRVGVIKNREKHKGTFETIHVQDATGHEFATRLGNVFTIGKGTKPWVSLPKGKGIKLSIIEEARKRLAATSATTA

SEQ ID NO: 8081 - protein, 264 aa, Momordica charantia
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDEEAKYKLCKVRSVQFGQKGIPYLNTYDGRTIRYPDPLIKANDTIKLDLDSNKIADFIKFDVGNVVMVTGGRNRGRVGVIKNREKHKGSFETIHIQDATGHEFATRLGNVFTIGKGTKPWVSLPKGKGIKLSIIEEARKRLASQAAVTA

SEQ ID NO: 8082 - protein, 264 aa, Cajanus cajan
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDEEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFTTRMGNVFTIGKGTKPWISLPKGKGIKLSIIEEARKRIAAQQATAA

SEQ ID NO: 8083 - protein, 265 aa, Prunus persica
MARGLKKHLKRLNAPKHWMLDKLGGAFAPKPSSGPHKSRECLPLILILRNRLKYALTYREVVSILMQRHILVDGKVRTDKTYPSGFMDVVSIPKTNENFRLLYDTKGRFRLHSIRDEESKFKLCKVRSVQFGQKGIPYINTYDGRTIRYPDPLIKANDTIKLDLETNKITDFIKFDVGNVVMVTGGRNRGRVGVIKNREKHKGSFETIHVQDATGHEFATRLGNVFTIGKGTKPWVSLPKGKGIKLTILEEAKKRQAAAQAAATA

SEQ ID NO: 8084 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVIDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATAA

SEQ ID NO: 8085 - protein, 264 aa, Tabernaemontana elegans
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIRDEEAKFKLCKVRSVQFGQKGIPYLNTYDGRTIRYPDPLIKANDTIKLDLETNKITDFIKFDVGNVVMVTGGRNRGRVGVIKNREKHKGSFETIHIQDAQGHEFATRLGNVFTIGKGTKPSVSLPKGKGIKLSIIEEARKREAAKSPATA

SEQ ID NO: 8086 - protein, 264 aa, Tripterygium wilfordii
MARGLKKHMKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYLNTYDGRTIRYPDPLIKANDTIKLDFETNKIAEFIKFDVGNVVMVTGGRNRGRVGVIKNREKHKGSFETIHIQDAQGHEFATRLGNVFTIGKGTKPWVSLPKGKGIKLSIIEEARKRLAAQQATTA

SEQ ID NO: 8087 - protein, 241 aa, Juglans hindsii x Juglans regia
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSIRDDEAKFKLCKVRSVQFGQKGIPYLNTYDGRTIRYPDPLIKANDTIKLDLESNKIADFIKFDVGNVVMVTGGRNRGRVGVIKSREKQKGSFETIHVQDATGHEFATRLSNVYTYWQGDEAVGIPSQG

SEQ ID NO: 8088 - protein, 249 aa, Liriodendron tulipifera
MARGLKKHLKRLNAPKHWMLDKLGGAFAPKPSSGPHKARECLPLILILRNKLKYALTYREVISILMQRHVLVDGKVRTDKTYPAGFMDVVSIPKTNENFRLLYDTKGRFRLHTIKDEEAKFKLCKVRSVQFGQKGIPYLNTYDGRTIRYPDPLIRANDTIKLDLETYKIVDFIKFDVGNVVMVTGGRNRGRVGVIKNREKHKGTFETIHVQDATGHEFATRLGECVHHRQGDEAVGLPAQGQGYQALHH

SEQ ID NO: 8089 - protein, 265 aa, Cicer arietinum
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSVRDDEAKFKLCKVRSVQFGQKGIPYLNTYDGRTIRYPDPLIKANDTIKLDLEENKIVDFIKFDVGNVVMVTGGRNRGRVGVIKNREKHKGTFETIHVQDATGHEFATRLGNVFTIGKGTKPWVSLPKGKGIKLTVIEEARKRAAAAQQAIAA

SEQ ID NO: 8090 - protein, 265 aa, Carpinus betulus
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDEEAKFKLCKVRSVQFGQKGIPYLNTYDGRTIRYPDPVIKANDTIKLDLESNKITDFIKFDVGNVVMVTGGRNRGRVGVIKSREKHKGTFETIHVQDASGHEFATRLGNVFIIGKGTKPWVSLPKGKGIKLTIIEEARKRHGAEAAASTA

SEQ ID NO: 8091 - protein, 264 aa, Amsonia hubrichtii
MARGLKKHLKRLNAPKHWMLDKLGGAFAPKPSSGPHKSRECLPLILILRNRLKYALTYREVIAILMQRHVFVDGKVRTDKTYPSGFMDVVSIPKTNENFRLLYDTKGRFRLHSIRDEEAKFKLCKVRSIQFGQKGIPYLNTYDGRTIRYPDPLIKANDTIKLDLETNKITDFIKFDVGNVVMVTGGRNRGRVGVIKNREKHKGSFETIHIQDAQGHEFATRLGNVFTIGKGTKPWVSLPKGKGIKLSIIEEARKREATKSPATA

SEQ ID NO: 8092 - protein, 263 aa, Aristolochia fimbriata
MARGLKKHLKRLNAPKHWMLDKLGGAFAPKPSSGPHKSRECLPLILILRNKLKYALTYREVISIMMQRHILVDGKVRTDKTYPAGFMDVVSIPKTNENFRLLYDTKGRFRLHTIKDEEAKFKLCKVRSVQFGQKGIPYLNTYDGRTIRYPDPLIRANDTIKLDLETNKIVDFIKFDVGNVVMVTGGRNRGRVGIIKSREKHKGSFETIHVEDATGHAFATRLGNVFTLGKGSKPWVSLPKGKGIKLSIIEEARKRLAAQAATA

SEQ ID NO: 8093 - protein, 264 aa, Persea americana
MARGLKKHLKRLNAPKHWMLDKLGGAFAPKPSSGPHKARECLPLILILRNKLKYALTYREVISILMQRHVLVDGKVRTDKTYPTGFMDVVSIPKTNENFRLLYDTKGRFRLHSIRDDEAKYKLCKVRSIQFGQKGIPYLNTYDGRTIRYPDPLIKANDTIKLDLETCKIVDFIKFDVGNVVMVTGGRNRGRVGVIKNREKHKGSFETIHVQDSTGHEFATRLGNVYTIGKGTKPWVSLPKGKGIKLSIIEEARKRLAAASAATA

SEQ ID NO: 8094 - protein, 262 aa, Unknown
  Sequence found in Organisms: Citrus sinensis, Citrus clementina, Citrus sinensis
MARGLKKHLKRLNAPKHWMLDKLGGAFAPKPSSGPHKSRECLPLILVLRNRLKYALTYREVIAILMQRHVLVDGKVRTDKTYPAGFMDVVSIPKTNENFRLLYDTKGRFRLHSLRDEEAKFKLCKVRSVQFGQKGIPYINTYDGRTIRYPDPLIKANDTIKLDLEENKITDFIKFDVGNIVMVTGGRNRGRVGIIKNREKHKGSFETIHIQDALGHEFATRLGNVFTIGKGSKPWVSLPKGKGIKLSIIEEARKRQAAQAAA

SEQ ID NO: 8095 - protein, 264 aa, Vigna unguiculata
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDEEAKFKLCKVRSVQFGQKGIPYLNTYDGRTIRYPDPVIRANDTIKLDLEENKIVDFIKFDVGNVVMVTGGRNRGRVGVIKSREKHKGSFETIHVQDATGHEFATRLGNVFTIGKGTKPWVSLPKGKGIKLSIIEEARKRIAAQQATAA

SEQ ID NO: 8096 - protein, 264 aa, Cucumis sativus
MARGLKKHLKRLNAPKHWMLDKLGGAFAPKPSSGPHKSRECLPLILILRNRLKYALTYREVIAILMQRHVLVDGKVRTDKTFPAGFMDVVSIPKTNENFRLLYDTKGRFRLHSVRDEEAKYKLCKVRSVQFGQKGIPYLNTYDGRTIRYPDPLIKANDTIKLDLESNKIADFIKFDVGNVVMVTGGRNRGRVGVIKNREKHKGSFETIHIQDATGHEFATRLGNVFTIGKGTKPWVSLPKGKGIKLSIIEEARKRLASQATVTA

SEQ ID NO: 8097 - protein, 264 aa, Euonymus alatus
MARGLKKHMKRLNAPKHWMLDKLGGAFAPKPSSGPHKSRECLPLILILRNRLKYALTYREVIAILMQRHVMVDFKVRTDKTYPAGFMDVVSIPKTNENFRLLYDTKGRFRLHSIRDEEAMFKLCKVRSVQFGQKGIPYLNTYDGRTIRYPDPLIKANDTIKLDFETNKIADFIKFDVGNVVMVTGGRNRGRVGVIKNREKHKGSFETIHIQDAQGHEFATRLGNVFTIGKGTKPWVSLPKGKGIKLSIIEEARKRLAAQQATTA

SEQ ID NO: 8098 - protein, 264 aa, Euonymus alatus
MARGLKKHMKRLNAPKHWMLDKLGGAFAPKPSSGPHKSRECLPLILILRNRLKYALTYREVIAILMQRHVMVDFKVRTDKTYPAGFMDVVSIPKTNENFRLLYDTKGRFRLHSIRDEEATFKLCKVRSVQFGQKGIPYLNTYDGRTIRYPDPLIKANDTIKLDFETNKIADFIKFDVGNVVMVTGGRNRGRVGVIKNREKHKGSFETIHIQDAQGHEFATRLGNVFTIGKGTKPWVSLPKGKGIKLSIIEEARKRLAAQQATTA

SEQ ID NO: 8099 - protein, 264 aa, Actinidia deliciosa
MARGLKKHLKRLNAPSHWMLDKLGGAFAPKPSSGPHKSRECLPLILILRNRLKYALTYREVIAILMQRHILVDGKVRTDKTYPSGFMDVVSIPKTNENFRLLYDTKGRFRLHSVRDEEAKFKLCKVRSVQFGQKGIPYLNTYDGRTIRYPDPLIKANDTVKLDLESNKITDFIKFDVGNVVMVTGGRNRGRVGVIKNREKHKGSFETIHIQDATGHEFATRMGNVFTIGKGTKPWVSLPKGKGIKLSIIEEARKRLATQAGAAA

SEQ ID NO: 8100 - protein, 264 aa, Medicago truncatula
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIKANDTIKLDLENNKITDFIKFDVGNVVMVTGGRNRGRVGVIKNREKHKGTFETIHVQDASGHEFATRLGNVFTIGKGTKPWVSLPKGKGIKLTVIEEARKRQAAQNVTAA

SEQ ID NO: 8101 - protein, 264 aa, Cucumis melo
MARGLKKHLKRLNAPKHWMLDKLGGAFAPKPSSGPHKSRECLPLILILRNRLKYALTYREVIAILMQRHVLVDGKVRTDKTFPAGFMDVVSIPKTSENFRLLYDTKGRFRLHSVRDEEAKYKLCKVRSVQFGQKGIPYLNTYDGRTIRYPDPLIKANDTIKLDLESNKIADFIKFDVGNVVMVTGGRNRGRVGVIKNREKHKGSFETIHIQDATGHEFATRLGNVFTIGKGTKPWVSVPKGKGIKLSIIEEARKRLASQAAVTA

SEQ ID NO: 8102 - protein, 264 aa, Momordica charantia
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGQFRLHSVRDEEAKYKLCKVRSVQFGQKGIPYLNTYDGRTIRYPDPLIKANDTIKLDLETNKVADFIKFDVGNVVMVTGGRNRGRVGVIKNREKHKGSFETIHIQDATGHEFATRLGNVFTIGKGTKPWVSLPKGKGIKLSIIEEARKRLASQAAVTA

SEQ ID NO: 8103 - protein, 262 aa, Tropaeolum majus
MARGLKKHLKRLNAPKHWMLDKLGGAFAPKPSSGPHKSRECLPLILILRNRLKYALTYREVIAILMQRHILVDGKVKTDKTYPAGFMDVVSIPKTNENFRLLYDTKGRFRMHSIRDEEAKFKLCKVRSVQFGSKGIPYINTYDGRTIRYPDPLIKANDTIKLDLEANKIVDFIKFDVGNVVMVTGGRNRGRVGVIKNREKHKGSFETIHVQDSLGHEFATRLGNVFTIGKGTKPWVSLPKGKGIKLTIIEEARKRLAAQQAA

SEQ ID NO: 8104 - protein, 264 aa, Arachis hypogaea
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSIRDEEAKFKLCKVRSVQFGQKGIPYLNTFDGRTIRYPDPLIRANDTIKLDLEENKIVDFIKFDVGNVVMVTGGRNRGRVGVIKNREKHKGSFETIHVQDATGNEFATRMGNVFTIGKGSKPWVSLPKGKGIKLTIIEEARKRIASQQAVTA

SEQ ID NO: 8105 - protein, 264 aa, Prunus persica
MARGLKKHLKRLNAPKHWMLDKLGGAFAPKPSSGPHKSRECLPLVIILRNRLKYALTYREVISILMQRHVLVDGKVRTDKTYPSGFMDVISIPKTNENFRLLYDTKGRFRLHSIRDEEAKFKLCKVRSVQFGQKGIPYINTYDGRTIRYPDPLIKANDTIKLDLESNKITDFIKFDVGNVVMVTGGRNRGRVGVIKNREKHKGSFETIHVQDATGHEFATRLANVFTIGKGTKPWVSLPKGKGIKLTIIEEAKKRQAAQQASTA

SEQ ID NO: 8106 - protein, 262 aa, Rhizophora mangle
MARGLKKHLKRLNAPKHWMLDKLGGAFAPKPSSGPHRSRECLPLILILRNRLKYALTYREVIAILMQRHVLVDGKVRTDKTYPSGFMDVVSIPKTTDNFRLLYDTKGRFRLHRIRDDEAKFKLCKVRSVQFGDKGIPYINTYDGRTIRYPDPLIKANDTIKLDLEANKITDFIKFDVGNVVMVTGGRNRGRVGVIKNREKHKGSFETIHVQDSLGHEFATRMGNVFIIGKGTKPLVSLPKGKGIKLSIIEEARKRLAAQAAA

SEQ ID NO: 8107 - protein, 264 aa, Fragaria vesca
MARGLKKHLKRLNAPKHWMLDKLGGAFAPKPSSGPHKSRECLPLIIILRNRLKYALTYREVIAILMQRHVLVDGKVRTDKTYPSGFMDVISIPKTNENFRLLYDTKGRFRLHSIRDEESKFKLCKVRSVQFGQKNIPYINTYDGRTIRYPDPLIKANDTIKLDLETNKITDFIKFDVGNVVMVTGGRNRGRVGVIKSREKHKGSFETIHVQDSTGHEFATRLGNVFTIGKGTKPWVSLPKGRGIKLSIIEEARKRQAALQASAA

SEQ ID NO: 8108 - protein, 264 aa, Tabernaemontana elegans
MARGLKKHLKRLNAPKHWMLDKLGGAFAPKPSSGPHKSRECLPLILILRNRLKYALTYREVIAILMQRHVMVDGKVRTDKTYPSGFMDVVSIPKTNENFRLLYDTKGRFRLHSVRDEEAKFKLCKVRSVQFGQKGIPFLNTYDGRTIRYPDPLIKANDTIKLDLESNKIVDFIKFDVGNVVMVTGGRNRGRVGVIKNREKHKGSFETIHIQDATGHEFATRLGNVFTIGKGTKPWVSLPKGKGIKLSIIEEQQKRLASQSAATA

SEQ ID NO: 8109 - protein, 263 aa, Utricularia gibba
MARGLKKHLKRLNAPKHWMLDKLGGAFAPKPSSGPHKSRECLPLILILRNRLKYALTYREVIAILMQRLVLVDNKVRTDKTYPAGFMDVVSIPKTNENFRLLYDTKGRFRLHSIRDEEAKFKLCKVRSVQFGKKGIPYLNTYDGRTIRYPDPLIKANDTIKLDLEENKIVDFIKFDVGNVVMVTGGRNRGRVGVIRNREKHKGTFETIHVEDATGHAFATRLSNVFTIGKGTKPWVSLPKGKGIKLSVIEESRKRLAAQAATS

SEQ ID NO: 8110 - protein, 265 aa, Vinca minor
MARGLKKHLKRLNAPKHWMLDKLGGAFAPKPSSGPHKSRECLPLILILRNKLKYALNYREVVSILMQRHVMVDGKVRTDKTYPSGFMDVISIPKTNENFRLLYDTKGRFRLHSLRDEEAKFKLCKVRSVQFGQKGIPFLNTYDGRTIRYPDPLIKPNDTIKLDLESNKIVDFIKFDVGNVVMVTGGRNRGRVGVIKNREKQKGSFETIHVQDATGHEFATRLGNVFTIGKGTKPWVSLPKGKGIKLSIIEEQKKRLAASQSAATA

SEQ ID NO: 8111 - protein, 264 aa, Cajanus cajan
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDEEAKFKLCKVRSVQFGQKGIPYLNTYDGRTIRYPDPLIRANDTIKLDLEENKIVDFIKFDVGNVVMVTGGRNRGRVGVIKNRERHKGSFETIHVQDATGHEFTTRMGNVFTIGKGTKPWISLPKGKGIKLSIIEEARKRIAAQQATAA

SEQ ID NO: 8112 - protein, 265 aa, Unknown
  Sequence found in Organisms: Citrus sinensis, Citrus sinensis
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYINTYDGRTIRYPDPLIKANDTIKLDLETNKITEFIKFDVGNVVMVTGGRNRGRVGIIKNREKHKGSFETIHIQDALGHEFATRLGNVFTIGKGTKPWVSLPKGKGIKLSIIEEARKRQALATSAAAQ

SEQ ID NO: 8113 - protein, 264 aa, Jatropha curcas
MARGLKKHLKRLNAPKHWMLDKLGGAFAPKPSSGPHKSRECLPLILILRNRLPYALTYREVIAILMQRHVLVVGKVRTDKTYPAGFMDVVSIPKTNENFRLLYDTKGRFRLHSVRDEEAKFKLCKVRSVQFGQKGIPYLNTYDGRTIRYPDPLIKANDTIKLDLESNKITDFIKFDVGNVVMVTGGRNRGRVGVIKNREKHKGSFETIHIQDATGHEFATRLGNVFTIGKGTKPWVSLPKGKGIKLSIIEEARKRQAAAAQTVA

SEQ ID NO: 8114 - protein, 266 aa, Ananas comosus
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSIKDEEAKFKLCKVRSVQFGQKGIPYLNTYDGRTIRYPDPLIKANDTIKLDLEANKIVDFIKFDVGNVVMVTGGRNTGRVGVIKNREKHKGSFETIHIQDATGHEFATRLGNVFTIGKGTKPWVTLPKGKGIKLSIIEEARKRLAAAGATAAAS

SEQ ID NO: 8115 - protein, 264 aa, Cannabis sativa
MARGLKKHLKRLNAPKHWMLDKLGGAFAPKPSSGPHKSRECLPLILILRNRLKYALTYREVQSILMQRHVMVDGKVRTDKTYPSGFMDVVSIPKTNENFRLLYDTKGRFRLHSVRDDEAKFKLCKVRSVQFGQKGIPYLNTYDGRTIRYPDPLIKANDTIKLDLEANKITDFIKFDVGNVVMVTGGRNRGRVGVIKNREKHKGTFETIHVQDALGHEFATRLGNVFTIGKGTKPWISLPKGKGIKLTILEEAKKRLAAQAAATA

SEQ ID NO: 8116 - protein, 262 aa, Unknown
  Sequence found in Organisms: Gossypium hirsutum, Gossypium raimondii
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQAAA

SEQ ID NO: 8117 - protein, 265 aa, Elaeis guineensis
MARGLKKHLKRLNAPKHWMLDKLGGAFAPKPSSGPHKARECLPLILILRNRLKYALTYREVIAILMQRHVMVDGKVRTDKTYPSGFMDVVSIPKTNENFRLLYDTKGRFRLHSIRDEEAKFKLCKVRSVQFGQKGIPYLNTFDGRTIRYPDPLIKANDTIKLDLEANKIVDFIKFDVGNVVMVTGGRNRGRVGVIKNREKHKGSFETIHLQDALGHEFATRIGNVFTIGKGTKPWVSLPKGKGIKLSIIEEARKRLAASGAAATV

SEQ ID NO: 8118 - protein, 264 aa, Capsicum annuum
MARGLKKHLKRLNAPKHWMLDKLGGAFAPKPSSGPHKSRECLPLIIILRNRLKYALTYREVISILMQRQVLVDGKVRTDKTYPAGFMDVVSIPKTNESFRLLYDTKGRFRLHSLRDEEAKFKLCKVRSVQFGQKGIPYLNTYDGRTIRYPDPLIKANDTIKLDLESNKIVDFIKFDVGNVVMVTGGRNRGRVGVIKNREKHKGSFETVHIQDAQGHEFATRLGNVFTLGKGTKPWVSLPKGKGIKLSIIEEARKRLAAQSATTA

SEQ ID NO: 8119 - protein, 264 aa, Rosa hybrid cultivar
MARGLKKHLKRLNAPKHWMLDKLGGAFAPKPSSGPHKSRECLPLIIILRNRLKYALTYREVIAILMQRHVMVDGKVRTDKTYPSGFMDVVSIPKTNENFRLLYDTKGRFRLHSIRDEEAKFKLCKVRSVQFGQKNIPYINTYDGRTIRYPDPLIKANDTIKLDLETNKIVDFIKFDVGNVVMVTGGRNRGRVGVIKNREKHKGSFETIHVQDATGHEFATRLANVFTIGKGTKPWVSLPKGKGIKLTIIEEAKKRQAAQATAAA

SEQ ID NO: 8120 - protein, 262 aa, Unknown
  Sequence found in Organisms: Thellungiella halophila, Eutrema halophilum
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLSIIEEARKRLSAQQAA

SEQ ID NO: 8121 - protein, 262 aa, Eutrema halophilum
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQAA

SEQ ID NO: 8122 - protein, 262 aa, Eutrema parvulum
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLAGQQAA

SEQ ID NO: 8123 - protein, 263 aa, Citrullus lanatus
ARGLKKHLKRLNAPKHWMLDKLGGAFAPKPSSGPHKSRECLPLILILRNRLKYALTYREVIAILMQRHVLVDGKVRTDKTFPAGFMDVVSIPKTNENFRLLYDTKGRFRLHSVRDEEAKYKLCKVRSVQFGQKGIPYLNTYDGRTIRYPDPLIKANDTIKLDLDSNKIADFIKFDVGNVVMVTGGRNRGRVGVIKNREKHKGSFETIHIQDETGHEFATRLGNVFTIGKGTKPWVSLPKGKGIKLSIIEEARKRLASQAAVTA

SEQ ID NO: 8124 - protein, 265 aa, Malus domestica
MARGLKKHLKRLNAPKHWMLDKLGGAFAPKPSSGPHKARECLPLVLILRNRLKYALTYREVVSILMQRHILVDGKVRTDKTYPSGFMDVVSIPKTNENFRLLFDTKGRFRLHSIRDEEAKFKLCKVRSVQFGQKGIPYLNTFDGRTIRYPDPLIKANDTIKLDLEANKITDFIKFDVGNVVMVTGGRNRGRVGVIKNREKHKGSFETIHVQDALGHEFATRLGNVFTIGKGTKPWVSLPKGKGIKLSIIEEAKKRQAAAQTAATA

SEQ ID NO: 8125 - protein, 262 aa, Theobroma cacao
MARGLKKHLKRLNAPKHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHIQDAAGHEFATRLGNVFTIGKGTKPWVSLPKGKGIKLSIIEEARKRLAAQAAA

SEQ ID NO: 8126 - protein, 264 aa, Castanea mollissima
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSIRDEEAKFKLCKVRSVQFGQKGIPYLNTFDGRTIRYPDPLIKANDTIKLDLESQKITEFIKFDVGNVVMVTGGRNRGRVGVIKNREKHKGTFETVHIQDATGHEFATRLGNVFTIGKGTKPWVSLPKGKGIKLTIIEEARKRLGAQTASTA

SEQ ID NO: 8127 - protein, 264 aa, Cucurbita pepo
MARGLKKHLKRLNAPKHWMLDKLGGAFAPKPSSGPHKSRECLPLVLILRNRLKYALTYREVISILMQRHILVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLESNKIADFIKFDVGNVVMVTGGRNRGRVGVLKNREKHKGSFETVHIQDATGHEFATRLGNVFTLGKGTKPWVSLPKGKGIKLSIIEEARKRLASQAAVTA

SEQ ID NO: 8128 - protein, 264 aa, Eucalyptus grandis
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSIRDDEAKFKLCKVRSIQFGQKGIPYLNTYDGRTIRYPDPVIKANDTVKLDLEANKITDFIKFDVGNVVMVTGGRNRGRVGVIKNREKHKGTFETIHIQDAQGHEFATRLGNVFIIGKGTKPWVSLPKGKGIKLSIIEEARKRLAAQASATA

SEQ ID NO: 8129 - protein, 264 aa, Vitis vinifera
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVKGVQFGQKGIPYLNTYDGRTIRYPDPLIKANDTVKLDLESNKIVDFIKFDVGNVVMVTGGRNRGRVGVIKSREKHKGTFETIHVQDATGHEFATRLGNVFTIGKGTKPWVTLPKGKGIKLSIIEEAKKRLAAQASATA

SEQ ID NO: 8130 - protein, 264 aa, Vitis vinifera
MARGLKKHLKRLNAPKHWMLDKLGGAFAPKPSSGPHKSRECLPLILILRNRLKYALTYREVIAILMQRHIFVDGKVRTDKTYPSGFMDVVSIPKTNENFRLLYDTKGRFRLHSVRDEEAKFKLCKVRSVQFGQKGIPYLNTYDGRTIRYPDPLIKANDTIKLDLESNKITDFIKFDVGNVVMVTGGRNRGRVGVIKNREKHKGTFETIHIQDATGHEFATRLGNVFIIGKGTKPWVSLPKGKGIKLSIIEEAKKRLAAQAASSA

SEQ ID NO: 8131 - protein, 264 aa, Humulus lupulus
MARGLKKHLKRLNAPKHWMLDKLGGAFAPKPSSGPHKSRECLPLILILRNRLKYALTYREVQSILMQRHIMVDGKVRTDKTYPSGFMDVVSIPKTNENFRLLYDTKGRFRLHSIRDDEAKFKLCKVRSVQFGQKGIPYLNTYDGRTIRYPDPLIKANDTIKLDLEANKITDFIKFDVGNVVMVTGGRNRGRVGVIKNREKHKGTFETIHVQDALGHEFATRLGNVFTIGKGTKPWISLPKGKGIKLTILEEAKKRLAAQAAATA

SEQ ID NO: 8132 - protein, 264 aa, Cucumis melo
MARGLKKHLKRLNAPKHWMLDKLGGAFAPKPSSGPHKSRECLPLILILRNRLKYALTYREVIAILMQRHVLVDGKVRTDKTFPAGFMDILSIPKTNENFRLLYDTKGRFRLHSVRDEEAKYKLCKVRSVQFGQKGIPYLNTFDGRTIRYPDPLIKANDTIKLDLESNKIADFIKFDVGNVVMVTGGRNRGRVGVIKNREKHKGSFETIHIQDATGHEFATRLGNVFTIGKGTKPWVSLPKGKGIKLSIIEEARKRLASQAAVTA

SEQ ID NO: 8133 - protein, 262 aa, Tropaeolum majus
MARGLKKHLKRLNAPKHWMLDKLGGAFAPKPSSGPHKSRECLPLILILRNRLKYALTYREVIAILMQRHILVDGKVKTDKTYPAGFMDVVSIPKTNENFRLLYDTKGRFRLHSIRDEESKFKLCKVRSVQFGQKGIPYINTYDGRTIRYPDPLIKANDTIKLDLDSQKIVDFIKFDVGNVVMVTGGRNRGRVGVIKNREKHKGSFETIHVQDSLGHEFATRLGNVFTIGKGTKPWVSLPKGKGIKLTIIEEARKRLAAQQAA

SEQ ID NO: 8134 - protein, 264 aa, Capsicum annuum
MARGLKKHLKRLNAPKHWMLDKLGGAFAPKPSSGPHKSRECLPLIIILRNRLKYALTYREVISILMQRQVMVDGKVRTDKTYPAGFMDVVSIPKTNENFRLLYDTKGRFRLHSLRDEEAKFKLCKVRSVQFGQKGIPYLNTYDGRTIRYPDPLIKANDTIKLDLESNKIVDFIKFDVGNVVMVTGGRNRGRVGVIKNREKHKGSFETVHIQDALGHEFATRLGNVFTLGKGTKPWVSLPKGKGIKLSIIEEARKRLAAQSAVAA

SEQ ID NO: 8135 - protein, 264 aa, Phalaenopsis aphrodite
MARGLKKHLKRLNAPKHWMLDKLGGAFAPKPSSGPHKARECLPLILILRNKLKYALTYRDVIAILMQRHVMVDGKVRTDKTYPAGFMDVIQIPKTNENFRLLYDTKGRFRLHSIRDEEAKFKLCKVRSVQFGQKGIPFLNTYDGRTIRYPDPLIKANDTIKLDLESNKIVDFIKFDVGNVVIVTGGRNRGRVGVIKNREKHKGTFETIHVQDAAGHEFATRLGNVFTIGKGTKPWVSLPKGKGIKLSIIEEARKRLAAASAATA

SEQ ID NO: 8136 - protein, 264 aa, Sarracenia psittacina
MARGLKKHLKRLNAPKHWMLDKLGGAFAPKPSSGPHKSRECLPLILILRNRLKYALVNREVNAILMQRLVLVDGKVRTDKTYPAGFMDVISIPKTNENFRLLYDTKGRFRLHSLRDEEAKIKLCKVRSVQFGQKGIPYLNTYDGRTIRYPDPLIKANDTIKLDLETNKITDFIKFDVGNVVMVTGGRNRGRVGVIKNREKHKGSFETVHIQDATGQEFATRMGNVFTIGKGTKPWVSLPKGKGIKLSIIEEARKRLAVQTGAAA

SEQ ID NO: 8137 - protein, 264 aa, Fragaria vesca
MARGLKKHLKRLNAPKHWMLDKLGGAFAPKPSSGPHKSRECLPLIIILRNRLKYALTYREVIAILMQRHVMVDGKVRTDKTYPSGFMDVVSIPKTNENFRLLYDTKGRFRLHSIRDEEAKFKLCKVRSVQFGQKNIPYINTYDGRTIRYPDPLIKANDTIKLDLETNKIVDFIKFDVGNVVMVTGGRNRGRVGVIKSREKHKGSFETIHVQDATGHEFATRLGNVFTIGKGTKPWVSLPKGKGIKLTIIEEAKKRQAAQATAAA

SEQ ID NO: 8138 - protein, 264 aa, Trigonella foenum-graecum
MARGLKKHLKRLNAPKHWNLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIKANDTIKLDLENNKITDFIKFDVGNVVMVTGGRNRGRVGVIKNREKHKGTFETIHVQDATGHEFATRLGNVFTIGKGTKPWVSLPKGKGIKLTVIEEARKRQAAQNVTAA

SEQ ID NO: 8139 - protein, 265 aa, Trigonella foenum-graecum
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDDEAKFKLCKVRSVQFGQKGIPYLNTYDGRTIRYPDPLIKANDTIKLDLELNKITNFIKFDVGNVVMVTGGRNRGRVGVIKNREKHKGTFETIHVEDITGHEFATRLGNVFVIGKGTKPWVSLPKGKGIKLTVIEEARKRIAASKQVAAA

SEQ ID NO: 8140 - protein, 264 aa, Phaseolus coccineus
MARGLKKHLKRLNAPKHWMLDKLGGAFAPKPSSGPHKSRECLPLILILRNRLKYALTYREVISILMQRHVLVDGKVRTDKTYPSGFMDVVSIPKTNENFRLLYDTKGRFRLHSVRDEEAKFKLCKVRSVQFGQKGIPYLNTYDGRTIRYPDPLIKANDTIKLDLEENKIVEFIKFDVGNVVMVTGGRNRGRVGVIKSRDKNKGSFETIHVQDATGHEFATRLGNVFTIGKGTKPWVSLPKGKGIKLSIIEEARKRISAQQATAA

SEQ ID NO: 8141 - protein, 262 aa, Unknown
  Sequence found in Organisms: Gossypium hirsutum, Gossypium raimondii
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8142 - protein, 262 aa, Tropaeolum majus
MARGLKKHLKRLNAPKHWMLDKLGGAFAPKPSSGPHKSRECLPLILILRNRLKYALTYREVIAILMQRHILVDGKVKTDKTYPAGFMDVVSIPKTNENFRLLYDTKGRFRLHSIRDEESKFKLCKVRSVQFGQKGIPYINTYDGRTIRYPDPLIKANDTIKLDLDSQKIVDFIKFDVGNVVMVTGGRNRGRVGVIKNREKHKGSFETIHVQDSLGHEFATRLGNVFTIGKGTKPWVSLPKGKGIKLTIIEEARKRLAAQQAS

SEQ ID NO: 8143 - protein, 262 aa, Eutrema halophilum
MARGLKKHLKRLNAPKHWMLDKLGGAFAPKPSSGPHKSRECLPLVLIIRNRLKYALNYREVVSILMQRHIQVDGKVRTDKTYPAGFMDVVSIPKTNENFRLLYDTKGRFRLHSIRDEEAKYKLCKVRTIQFGQKGIPYLNTYDGRTIRYPDPLIKPNDTIKLDLEANKIVEFIKFDVGNVVMVTGGRNRGRVGVIKNREKHKGSFETIHIQDSTGHEFATRLGNVFTIGKGTKPWVSLPKGKGIKLTIIEEARKRLAAQQAA

SEQ ID NO: 8144 - protein, 264 aa, Castanea mollissima
MARGLKKHLKRLNAPKHWMLDKLGGAFAPKPSSGPHKSRECLPLILILRNRLKYALTYREVISILMQRHVLVDGKVRTDKTYPSGFMDVVSIPKTNENFRLLYDTKGRFRLHSIRDEEAKFKLCKVRSVQYGQKGIPYLNTHDGRTIRYPDPLIKANDTIKLDLESGKITDFIKFDVGNVVMVTGGRNRGRVGVIKNREKHKGTFETVHIQDATGHEFATRLGNVYTIGKGTKPWVSLPKGKGIKLTIIEEAKKRLAAQGAATA

SEQ ID NO: 8145 - protein, 265 aa, Citrus clementina
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYINTYDGRTIRYPDPLIKANDTIKLDLETNKITEFIKFDVGNVVMVTGGRNRGRVGIIKNREKHKGSFETIHIQDALGHEFATRLGNVFTIGKGTKPWVALPKGKGIKLSIIEEARKRQALATSAAAQ

SEQ ID NO: 8146 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAISGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8147 - protein, 264 aa, Solanum melongena
MARGLKKHLKRLNAPKHWMLDKLGGAFAPKPSSGPHKSRECLPLVIILRNRLKYALTYREVISILMQRQVLVDGKVRTDKTYPAGFMDVVSIPKTNENFRLLYDTKGRFRLHSLRDEEAKFKLCKVRSVQFGQKGIPYLNTYDGRTIRYPDPLIKANDTIKLDLESNKIVDFIKFDVGNVVMVTGGRNRGRVGILKNREKHKGSFETVHIQDSLGHEFATRLGNVFTLGKGTKPWVSLPKGKGIKLSIIEEARKRLAAQSATAA

SEQ ID NO: 8148 - protein, 264 aa, Humulus lupulus
MARGLKKHLKRLNAPKHWMLDKLGGAFAPKPSSGPHKSRECLPLILILRNRLKYALNYREVVSILMQRHIMVDGKVRTDKKYPSGFMDVVSIPKTNENFRLLYDTKGRFRLHSIRDEEAKFKLCKVRSVQFGQKGIPYLNTYDGRTIRYPDPLIKANDTIKLDLESNKIVDFIKFDVGNVVMVTGGRNRGRVGVIKNREKHKGTFETIHVQDATGHEFATRLGNVFTIGKGTKPWITLPKGKGIKLTILEEAKKRLASQAAATA

SEQ ID NO: 8149 - protein, 264 aa, Ipomoea batatas
MARGLKKHMKRLNAPKHWMLDKLGGAFAPKPSSGPHKSRECLPLILIIRNRLKYALTYREVISILMQRHVLVDGKVRTDKTYPAGFMDVVSIPKTNENFRLLYDTKGRFRLHSIRDEEAKFKLCKVRSVQFGKKGIPYINTYDGRTIRYPDPLIKANDTVKLDLESNKIVEFIKFDVGNVVMVTGGRNRGRVGVIKNREKHKGSFETVHIQDALGHEFATRLGNVFTIGKGTKPWVSLPKGKGIKLTIIEEAKKRLAAQSATTA

SEQ ID NO: 8150 - protein, 264 aa, Ipomoea nil
MARGLKKHMKRLNAPKHWMLDKLGGAFAPKPSSGPHKSRECLPLVLIIRNRLKYALTYREVISILMQRHVLVDGKVRTDKTYPAGFMDVVSIPKTNENFRLLYDTKGRFRLHSIRDEEAKFKLCKVRSVQFGKKGIPYINTYDGRTIRYPDPLIKANDTVKLDLESNKIVDFIKFDVGNVVMVTGGRNRGRVGVLKNREKHKGSFETVHIQDSLGHEFATRLGNVYTIGKGTKPWVSLPKGKGIKLSIIEEAKKRLAAQSATTA

SEQ ID NO: 8151 - protein, 264 aa, Lotus japonicus
MARGLKKHLKRLNAPKHWMLDKLGGAFAPKPSSGPHKSRECLPLILILRNRLKYALTYREVIAILMQRHILVDGKVRTDKTYPAGFMDVVSIPKTNENFRLLYDTKGRFRLHSVRDDEAKFKLCKVRSVQFGQKGIPYLNTYDGRTIRYPDPLIKANDTIKLDLELNKITEFIKFDVGNVVMVTGGRNRGRVGVIKNREKQKGSFDTIHVQDATGHEFATRLGNVFMIGKGSKPWVSLPKGRGIKLSIIEEARKRQAAQQQAAA

SEQ ID NO: 8152 - protein, 265 aa, Elaeis guineensis
MARGLKKHLKRLNAPKHWMLDKLGGAFAPKPSSGPHKARECLPLILILRNRLKYALTYREVIAILMQRHVMVDGKVRTDKTYPSGFMDVVSIPKTNENFRLLYDTKGRFRLHSIRDEEAKFKLCKVRSVQFGQKGIPYLNTFDGRTIRYPDPLIKANDTIKLDLEANKIVDFIKFDVGNVVMVTGGRNRGRVGVIKNREKHKGSFETIHLQDALGHEFATRIGNVFTIGKGTKPWVFLPKGKGIKLSIIEEARKRLAASGAAATV

SEQ ID NO: 8153 - protein, 265 aa, Elaeis guineensis
MARGLKKHLKRLNAPKHWMLDKLGGAFAPKPSSGPHKARECLPLILILRNRLKYALTYREVIAILMQRHVLVDGKVRTDKTYPAGFMDVVSIPKTNENFRLLYDTKGRFRLHSVRDEEAKFKLCKVRSIQFGHKGIPYLNTYDGRTIRYPDPLIKANDTIKLDLETCKIVDFIKFDVGNVVMVTGGRNRGRVGIIKNREKHKGSFETIHLQDATGHEFATRLGNVFTIGKGTKPWVSLPKGKGIKLSIIEEARKRLAASGAAATV

SEQ ID NO: 8154 - protein, 261 aa, Orobanche aegyptiaca
MARGLKKHLKRLNAPKHWMLDKLGGAFAPKPSSGPHKSRECLPLILILRNRLKYALTYREVIAILMQRQILVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLESSKIVDFIKFDVGNVVMVTGGRNRGRVGVIKNREKHKGSFETIHIQDSTGHEFATRLGNVFTIGKGTKPWISLPKGKGIKLSIIEEARKRLAAQSA

SEQ ID NO: 8155 - protein, 264 aa, Phalaenopsis aphrodite
MARGLKKHLKRLNAPKHWMLDKLGGAFAPKPSSGPHKARECLPLILILRNKLKYALTYRDVIAILMQRHVMVDGKVRTDKTYPAGFMDVIQIPKTNENFRLLYDTKGRFRLHSIRDEEAKFKLCKVRSVQFGQKGIPFLNTYDGRTIRYPDPLIKANDTIKLDLESNKIVDFIKFDVGNVVIVTGGRNRGRVGVIKNREKHKGTFETIHIQDAAGHEFATRLGNVFTIGKGTKPWVSLPKGKGIKLSIIEEARKRLAAASAATA

SEQ ID NO: 8156 - protein, 263 aa, Populus trichocarpa
MARGLKKHLKRLNAPKHWMLDKLGGAFAPKPSSGPHKSRECLPLILILRNRLKYALTYREVISILMQRHVLVDGKVRTDKTYPSGFMDVVSIPKTNESFRLLYDTKGRFRLHSLREDEAKFKLCKVRSIQFGQKGIPYLNTYDGRTIRYPDPLIKANDTIKLDLESNKIVDFIKFDVGNVVMVTGGRNRGRVGVIKNREKHKGSFETIHVQDATGHEFATRLGNVFTIGKGSKPWISLPKGKGIKLSIIEEAKKRLAASQAAA

SEQ ID NO: 8157 - protein, 263 aa, Populus trichocarpa
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNESFRLLYDTKGRFRLHSLRDDEAKFKLCKVRSIQFGQKGIPYLNTYDGRTIRYPDPLIKANDTIKLDLESNKIVDFIKFDVGNVVMVTGGRNRGRVGVIKNREKHKGSFETIHVQDATGHEFATRLGNVFTIGKGSKPWISLPKGKGIKLSIIEEARKRQAASQTAA

SEQ ID NO: 8158 - protein, 263 aa, Populus trichocarpa
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNESFRLLYDTKGRFRLHSLRDDEAKFKLCKVRSIQFGQKGIPYLNTYDGRTIRYPDPLIKANDTIKLDLENNKIVDFIKFDVGNVVMVTGGRNRGRVGVIKNREKHKGSFETIHVQDATGHEFATRLGNVFTIGKGTKPWISLPKGKGIKLSIIEEARKRLAASQATA

SEQ ID NO: 8159 - protein, 264 aa, Scabiosa columbaria
MARGLKKHLKRLNAPKHWMLDKLGGAFAPKPSSGPHKSRECLPLILILRNRLKYALTYREVQSILMQRHVLVDGKVRTDKTYPSGFMDVVSIPKTNENFRLLYDTKGRFRLHSVRDEESKFKLCKVRSVQFGSKGIPYINTYDGRTIRYPDPLIKANDTIKLDLETNKITDFIKFDVGNVVMVTGGRNRGRVGVIKNREKHKGSFETVHIQDSLGHEFATRLANVFTIGKGTKPWVSLPKGKGIKLTIIEEAKRRLAAQSATTA

SEQ ID NO: 8160 - protein, 264 aa, Fragaria vesca
MARGLKKHLKRLNAPKHWMLDKLGGAFAPKPSSGPHKSRECLPLIIILRNRLKYALTYREVIAILMQRHVLVDGKVRTDKTYPSGFMDVVSIPKTNENFRLLYDTKGRFRLHSIRDEEAKFKLCKVRSVQFGQKNIPYINTYDGRTIRYPDPLIKANDTIKLDLETNKVIDFIKFDVGNVVMVTGGRNRGRVGVIKNREKHKGSFETIHVQDAAGHEFATRLGNVFTIGKGTKPWVSLPKGKGIKLTIIEEARKRQAALQTATA

SEQ ID NO: 8161 - protein, 264 aa, Nicotiana tabacum
MARGLKKHLKRLNAPKHWMLDKLGGAFAPKPSSGPHKSRECLPLIIILRNRLKYALTYREVISILMQRQVMVDSKVRTDKTYPAGFMDVVSIPKTNENFRLLYDTKGRFRLHSVRDEEAKFKLCKVRSVQFGQKGIPYLNTYDGRTIRYPDPLIKANDTIKLDLESNKIVDFIKFDVGNVVMVTGGRNRGRVGVIKNREKHKGSFETVHIQDALGHEFATRLGNVFTLGKGTKPWVSLPKGKGIKLSIIEEARKRLAAQSATTA

SEQ ID NO: 8162 - protein, 264 aa, Valeriana officinalis
MARGLKKHLKRLNAPKHWMLDKLGGAFAPKPSSGPHKSRECLPLVLILRNRLKYALTYREVQSILMQRHVLVDGKVRTDKTYPSGFMDVVSIPKTNENFRLLYDTKGRFRLHSIRDEEAKFKLCKVRSVQFGQKGIPYINTYDGRTIRYPDPLIKANDTIKLDLETNKITDFIKFDVGNVVMVTGGRNRGRVGVLKNREKHKGSFETVHIQDSLGHEFATRLSNVYTIGKGTKPWVSLPKGKGIKLTIIEEAKKRLAAQSAATA

SEQ ID NO: 8163 - protein, 265 aa, Vinca minor
MARGLKKHLKRLNAPKHWMLDKLGGAFAPKPSSGPHKSRECLPLILILRNKLKYALNYREVVAILMQRHVMVDGKVRTDKTYPSGFMDVISIPKTNENFRLLYDTKGRFRLHSLRDEEAKFKLCKVRSVQFGQKGIPFLNTYDGRTIRYPDPLIKPNDTIKLDLENNKIVDFIKFDVGNVVMVTGGRNRGRVGVIKNREKQKGSFETIHVQDATGHEFATRLGNVFTIGKGTKPWISLPKGKGIKLSIIEEQKKRLAATQSAATA

SEQ ID NO: 8164 - protein, 264 aa, Cajanus cajan
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDDEAKFKLCKVRSVQFGQKGIPYLNTYDGRTIRYPDPVIRANDTIKLDLEENKIVDFIKFDVGNVVMVTGGRNRGRVGVIKSREKHKGSFETIHLQDATGHEFTTRMGNVFTIGKGTKPWVSLPKGKGIKLSIIEEARKRIAAQQATAA

SEQ ID NO: 8165 - protein, 262 aa, Brassica juncea
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKIVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8166 - protein, 264 aa, Fagus grandifolia
MARGLKKHLKRLNAPKHWMLDKLGGAFAPKPSSGPHKSRECLPLVLILRNRLKYALTYHEVISILMQRHVLVDGKVRTDKTYPSGFMDVVSIPKTNENFRLLYDTKGRFRLHSVRDEEAKFKLCKVRSVQFGQKGIPYLNTYDGRTIRYPDPIIKANDTIKLDLEINKIADFIKFDVGNVVMVTGGRNRGRVGVIKSREKHKGSFETVHIQDASGHEFATRLGNVFTIGKGTKPWVSLPKGKGIKLTIIEEARKRLAAQGASTA

SEQ ID NO: 8167 - protein, 262 aa, Beta vulgaris
MARGLKKHMKRLNAPKHWMLEKLGGAFAPKPSSGPHKARECLPLILILRNRLKYALVYREVIAILMQRHVLVDGKVRTDKTYPAGFMDVISIPKTNENFRLLYDAKGRFRLHSIRDEEAKFKLCKVRNVQFGTKGIPYLNTYDGRTIRYPDPLIRANDTIKLDLEENKIVDFIKFDVGNVVMVTGGRNRGRVGVIKNREKHKGSFETIHIQDSQGHEFATRMGNVFTIGKGTKPWVSLPKGKGIKLTIIEEARKRAEKTATA

SEQ ID NO: 8168 - protein, 263 aa, Cicer arietinum
ARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDDEAKFKLCKVRSVQFGQKGIPYLNTYDGRTIRYPDPVIKANDTIKLDLEENKIVDFIKFDVGNVVMVTGGRNRGRVGVIKNREKHKGTFETIHVQDATGHEFATRLGNVFTIGKGTKPWVSLPKGKGIKLTVIEEARKRAAAQQAIAA

SEQ ID NO: 8169 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLSTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8170 - protein, 264 aa, Eschscholzia californica
MARGLKKHLKRLNAPKHWMLDKLGGAFAPKPSSGPHKSRECLPLILILRNRLKYALTYREVVAILMQRHILVDGKVRTDQRYPSGFMDVVSIPKTNENFRLLYDTKGRFRLHSIKDEEAKFKLCKVRNVQFGQKGIPYINTYDGRTIRYPDPLIKANDTIKLDLETNKITDFIKFDVGNVVMVTGGRNRGRVGIIKNREKHKGSFETIHVQDSTGHEFATRLGNVFTIGKGTKPWISLPKGKGIKLSIIEEARKRLAAQGGASA

SEQ ID NO: 8171 - protein, 265 aa, Elaeis guineensis
MARGLKKHLKRLNAPKHWMLDKLGGAFAPKPSSGPHKARECLPLILILRNRLKYALTYREVIAILMQRHVLVDGKVRTDKTYPAGFMDVVSMPKTNENFRLLYDTKGRFRLHSIRDEEAKFKLCKVRSIQFGHKGIPYLNTYDGRTIRYPDPLIKANDTIKLDLDTCKIVDFIKFDVGNVVMVTGGRNRGRVGIIKNREKHKGSFETIHLQDATGHEFATRLGNVFTIGKGTKPWVSLPKGKGIKLSIIEEARKRLAASGAAATV

SEQ ID NO: 8172 - protein, 262 aa, Eutrema halophilum
MARGLKKHLKRLNAPKHWMLDKLGGAFAPKPSSGPHKSRECLTLVLIIRNSLKYALTYREVISILMQRHIQVDGKVRTDKTYPAGFMDVVSIPKTNENFRLLYDTKGRFRLHSIRDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQAA

SEQ ID NO: 8173 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRTVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8174 - protein, 264 aa, Amborella trichopoda
MARGLKKHLKRLNAPKHWMLDKLGGAFAPKPSSGPHKSRECLPLILILRNKLKYALTYREVISILMQRHVLVDGKVRTDKTYPAGFMDVVSIPKTNENFRLLYDTKGRFRLHSVKDEEAKFKLCKVRSVQFGQKSIPYLNTYDGRTIRYPDPLIKANDTIKLDLETNKIVDFIKFDVGNVVMVTGGRNRGRVGLIKSRERHKGSFDIIHIEDAAKHEFATRLGNVFTIGKASKPWVSLPKGKGIKLSIIEEARKRNAAAATAAA

SEQ ID NO: 8175 - protein, 264 aa, Amorphophallus konjac
MARGLKKHLKRLNAPKHWMLDKLGGAFAPKPSSGPHKARECLPLILILRNKLKYALTYREVISILMQRHVMVDGKIRTDKTFPAGFMDVVSIPKTNENFRLLYDTKGRFRLHRIKDEEAKFKLCKVRSVQFGDKGIPYLNTYDGRTIRYPDPLIKANDTIKLDLENNKIVDFIKFDVGNVVMVTGGRNRGRVGLIKNREKHKGTFETIHVQDAAGHEFATRLGNVFTIGKGSKPWVSLPKGKGVKQSIIEEQRKRAAAAAATTA

SEQ ID NO: 8176 - protein, 262 aa, Arabidopsis lyrata
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAQFKLCKVRSIQFGQKGIPYLNTYDGRTIRYPDPLIKPNDTIKLDLEANKIVEFIKFDVGNVVMVTGGRNRGRVGVIKNREKHKGSFETIHIQDSTGHEFATRLGNVFTIGKGTKPWVSLPKGKGIKLTIIEEARKRLAGQQVA

SEQ ID NO: 8177 - protein, 262 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVYTIGKGTKPWVSLPKGKGIKLTIIEEARKRLASQQAA

SEQ ID NO: 8178 - protein, 262 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEANKIVEFIKFDVGNVVMVTGGRNRGRVGVIKNREKHKGSFETIHIQDSTGHEFATRLGNVYTIGKGTKPWVSLPKGKGIKLTIIEEARKRLASQQAA

SEQ ID NO: 8179 - protein, 263 aa, Manihot esculenta
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDDEAKFKLCKVRSVQFGQKGIPYINTYDGRTIRYPDPLIKANDTIKLDLESNKIADFIKFDVGNIVMVTGGRNRGRVGIIKNREKHKGSFETIHIQDATGHEFATRLGNVFTIGKGNKPWVSLPKGKGIKLSIIEEAKKRLAAAPTVA

SEQ ID NO: 8180 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVNFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8181 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFCLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQNAA

SEQ ID NO: 8182 - protein, 264 aa, Solanum melongena
MARGLKKHLKRLNAPKHWMLDKLGGAFAPKPSSGPHKSRECLPLVIILRNRLKYALTYREVISILMQRQVLVDGKVRTDKTYPAGFMDIVSIPKTNENFRLLYDTKGRFRLHSVRDEEAKFKLCKVRSVQFGQKGIPYLNTYDGRTIRYPDPLIKANDTIKLDLESNKIVDFIKFDVGNVVMVTGGRNRGRVGIIKNREKHKGSFETLHIQDATGHEFATRLGNVFTLGKGTKPWVSLPKGKGIKLSIIEEARKRLAAQSATAA

SEQ ID NO: 8183 - protein, 264 aa, Fagopyrum esculentum
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLMYDTKGRFRLHSVRDEEAKFKLCKVRSVQFGQKGIPYINTYDGRTIRYPDPLIKANDTIKLDLETSKIVDFIKFDVGNVVMVTGGRNRGRVGVIKNREKHKGSFETIHVTDSQGHEFATRLGNVFIIGKGTKPWVSLPKGKGIKLTIIEEAKKRQQQAQASTA

SEQ ID NO: 8184 - protein, 264 aa, Fagopyrum esculentum
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLMYDTKGRFRLHSVRDEEAKFKLCKVRSVQFGQKGIPYINTYDGRTIRYPDPLIKANDTIKLDLETSKIVDFIKFDVGNVVMVTGGRNRGRVGVIKNREKHKGSFETIHVTDSQGHEFATRLGNVFIIGKGTKPWVSLPKGKGIKLTIIEEAKKRQQQAQATTA

SEQ ID NO: 8185 - protein, 264 aa, Fagopyrum esculentum
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLMYDTKGRFRLHSVRDDEAKFKLCKVRSVQFGQKGIPYINTYDGRTIRYPDPLIKANDTIKLDLETSKIVDFIKFDVGNVVMVTGGRNRGRVGVIKNREKHKGSFETIHVTDSQGHEFATRLGNVFIIGKGTKPWVSLPKGKGIKLTIIEEAKKRQQQAQAATA

SEQ ID NO: 8186 - protein, 264 aa, Ipomoea nil
MARGLKKHLKRLNAPKHWMLDKLGGAFAPKPSSGPHKSRECLPLVLIIRNRLKYALTYREVISILMQRHVLVDGKVRTDKTYPAGFMDVISIPKTNENFRLLYDTKGRFRLHSIRDEEAKFKLCKVRSVQFGKKGIPFINTYDGRTIRYPDPLIKANDTVKLDLESNKVVDFIKFDVGNVVMVTGGRNRGRVGVLKNREKHKGSFETVHIQDATGHEFATRLGNVYTIGKGTKPWVSLPKGKGIKLSIIEEAKKRLAAQSAITA

SEQ ID NO: 8187 - protein, 264 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEEAKFKLCKVRSVQFGSKGIPYINTYDGRTIRYPDPLIKANDTIKLDLDTNKIVDFIKFDVGNVVMVTGGRNTGRVGILKNREKHKGSFETVHIQDSTGHEFATRLGNVFTLGKGTKPWVSLPKGKGIKLTIIEEARKRQAAQAAQVA

SEQ ID NO: 8188 - protein, 264 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEEAKFKLCKVRSVQFGSKGIPYINTYDGRTIRYPDPLIKANDTIKLDLDTNKIVDFIKFDVGNVVMVTGGRNTGRVGILKNREKHKGSFETVHIQDSTGHEFATRLGNVFTLGKGTKPWVSLPKGKGIKLTIIEEARKRQAAQAAQSA

SEQ ID NO: 8189 - protein, 264 aa, Quercus alba
MARGLKKHLKRLNAPKHWMLDKLGGAFAPKPSSGPHKSRECLPLILILRNRLKYALTYREVISILMQRHVLVDGKVRTDKTYPAGFMDVVSIPKTNENFRLLYDTKGRFRLHSIRDEEAKFKLCKVRSVQFGQKGIPYLNTFDGRTIRYPDPLIKANDTIKLDLESQKITEFIKFDVGNVVMVTGGRNRGRVGVIKNREKHKGTFETVHIQDATGHEFATRLGNVFNIGKGTKPWVSLPKGKGIKLTIIEEARKRLGAQTASTS

SEQ ID NO: 8190 - protein, 264 aa, Capsicum annuum
MARGLKKHLKRLNAPKHWMLDKLGGAFAPKPSSGPHKSRECLPLIIILRNRLKYALTYREVISILMQRQVLVDGKVRTDKTYPAGFMDVVSIPKTNESFRLLYDTKGRFRLHSLRDEEAKFKLCKVRSVQFGQKGIPYLNTYDGRTIRYPDPLIKANDTIKLDLESNKIVDFIKFDVGNVVMVTGGRNRGRVGVIKNREKHKGSFETVHIQDAQGHEFATRLGNVFTLGKGTKPWASLPKGKGIKLSIIEEAQKRLAAQSATTA

SEQ ID NO: 8191 - protein, 263 aa, Populus trichocarpa
MARGLKKHLKRLNAPKHWMLDKLGGAFAPKPSSGPHKSRECLPLILILRNRLKYALTGREVLAILMQRHVLVDGKVRTDKTYPSGFMDVVSIPKTNESFRLLYDTKGRFRLHSLRDDEAKFKLCKVRSVQFGQKGIPYLNTYDGRTIRYPDPLIKANDTIKLDLENNKIVDFIKFDVGNVVMVTGGRNRGRVGVIKNREKHKGTFETIHVQDATGHEFATRLGNVFTIGKGTKPWISLPKGKGIKLSIIEEAKKRLAASQAAA

SEQ ID NO: 8192 - protein, 264 aa, Scabiosa columbaria
MARGLKKHLKRLNAPKHWMLDKLGGAFAPKPSSGPHKSRECLPLILILRNRLKYALTYREVQSILMQRHVLVDGKVRTDKTYPSGFMDVVSIPKTNENFRLLYDTKGRFRLHSVRDEESKFKLCKVRSVQFGSKGIPYINTYDGRTIRYPDPLIKANDTIKLDLESNKITDFIKFDVGNVVMVTGGRNRGRVGVIKNREKHKGSFETVHIQDSLGHEFATRLANVFTIGKGTKPWVSLPKGKGIKLTIIEEAKRRLAAQSATTA

SEQ ID NO: 8193 - protein, 264 aa, Nicotiana tabacum
MARGLKKHLKRLNAPKHWMLDKLGGAFAPKPSSGPHKSRECLPLIIILRNRLKYALTYREVISILMQRQVMVDSKVRTDKTYPAGFMDVVSIPKTNENFRLLYDTKGRFRLHSVRDEEAKFKLCKVRSIQFGQKGIPYLNTYDGRTIRYPDPLIKANDTIKLDLESNKIVDFIKFDVGNVVMVTGGRNRGRVGVIKNREKHKGSFETVHIQDALGHEFATRLGNVFTLGKGTKPWVSLPKGKGIKLSIIEEARKRLAAQSATTA

SEQ ID NO: 8194 - protein, 264 aa, Solanum lycopersicum
MARGLKKHLKRLNAPKHWMLDKLGGAFAPKPSSGPHKSRECLPLVIIMRNRLKYALTYREVISILMQRQVMVDGKVRTDKTYPAGFMDVVSIPKTNENFRLLYDTKGRFRLHSVRDEESKFKLCKVRSVQFGQKGIPYLNTYDGRTIRYPDPLIKANDTIKLDLESNKIVDFIKFDVGNVVMVTGGRNRGRVGVIKNREKHKGSFETLHIQDSQGHEFATRLGNVFTLGKGTKPWVSLPKGKGIKLTIIEEARKRLAAQSATPA

SEQ ID NO: 8195 - protein, 261 aa, Utricularia gibba
LKKHLKRLNAPKHWMLDKLGGAFAPKPSSGPHKSRECLPLILILRNRLKYALTYREVIAILMQRLVLVDNKVRTDKTYPAGFMDVVSIPKTNENFRLLYDTKGRFRLHSIRDEEAKFKLCKVRSVQFGKKGIPYLNTYDGRTIRYPDPLIKANDTIKLDLEENKIVDFIKFDVGNVVMVTGGRNRGRVGVIRNREKHKGTFETIHVEDATGHAFATRLSNVFTIGKGSKPWVSLPKGKGIKLSIIEESRKRLAAQAPAAAS

SEQ ID NO: 8196 - protein, 243 aa, Cajanus cajan
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDDEAKFKLCKVRSVQFGQKGIPYLNTYDGRTIRYPDPVIRANDTIKLDLEENKIVDFIKFDVGNVVMVTGGRNRGRVGVIKSREKHKGSFETIHLQDATGHEFTTRMGNVFTIGKGLNHGYHCPRVRY

SEQ ID NO: 8197 - protein, 176 aa, Quercus alba
MARGLKKHLKRLNAPKHWMLDKLGGAFAPKPSSGPHKSRECLPLILILRNRLKYALTYREVISILMQRHVLVDGKVRTDKTYPSGFMESPRLMRISACFTTLRVDSVFTQSGTKRQSLSSAKSGRCSLGKRASHTSTPMMGEPSATQTLSSRPMTPSSWTWRVARSLISSNLMLGM

SEQ ID NO: 8198 - protein, 229 aa, Papaver somniferum
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMFTGGRNRGRVGVIKNREKHKGSFDTLHIQDSTGHEFATRLGQCVHHW

SEQ ID NO: 8199 - protein, 262 aa, Brassica juncea
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLAGQQAA

SEQ ID NO: 8200 - protein, 272 aa, Musa acuminata
LMYLVAFQARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLETNKIVDFIKFDVGNVVMVTGGRNTGRVGVIKNREKHKGSFETIHIQDSTGHEFATRLGNVFTIGKGTKPWVSLPKGKGIKLSIIEEARKRLAAAGAAATT

SEQ ID NO: 8201 - protein, 264 aa, Fagus grandifolia
MARGLKKHLKRLNAPKHWMLDKLGGAFAPKPSSGPHKSRECMPLILILRNRLKYALTYHEVVSILMQRHVMVDGKVRTDKTYPSGFMDVISIPKTNENFRLLYDTKGRFRIHSIRDEEAKFKLCKVRSVQFGQKGIPYLNTYDGRTIRYPDPIIKANDTIKLDLEGNKIADFIKFDVGNVVMVTGGRNRGRVGVIKSREKHKGTFETVHIQDATGHEFATRLGNVFTIGKGTKPWVSLPKGKGIKLTIIEEARKRLGAQAASTA

SEQ ID NO: 8202 - protein, 262 aa, Beta vulgaris
MARGLKKHMKRLNAPKHWMLDKLGGAFAPKPSSGPHKARECLPLILILRNRLKYALVYREVIAILMQRHVLVDGKVRTDKTYPAGFMDVISIPKTNENFRLLYDAKGRFRLHSVRDEEAKFKLCKVRNVQFGTKGIPYLNTYDGRTIRYPDPLIRANDTIKLDLEENKIVDFIKFDVGNVVMVTGGRNRGRVGVIKNREKHKGSFETIHIQDSQGHEFATRMGNVFIIGKGTKPWVSLPKGKGIKLTIIEEARKRAEKTATA

SEQ ID NO: 8203 - protein, 264 aa, Eschscholzia californica
MARGLKKHLKRLNAPSHWMLDKLGGAFAPKPSSGPHKSRECLPLILILRNRLKYALTYREVVAILMQRHILVDGKVRTDQRYPSGFMDVVSIPKTNENFRLLYDTKGRFRLHSIKDEEAKFKLCKVRNVQFGQKGIPYINTYDGRTIRYPDPLIKANDTIKLDLENNKITDFIKFDVGNVVMVTGGRNRGRVGVIKNREKHKGSFETIHVQDATGHEFATRLGNVFTIGKGTKPWISLPKGKGIKLSIIEEARKRLAAQGAATA

SEQ ID NO: 8204 - protein, 262 aa, Gossypium raimondii
MARGLKKHLKRLNAPRHWMLDKLGGAFAPKPSSGPHKSRECLPLVLILRNRLKYALTYREVIAILMQRHVMVDGKVRTDKTYPAGFMDVVSIPKTNEDFRLLYDTKGRFRLHAITGDESKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVLLPKGKGIKLSIIEEARKRLAAQSAA

SEQ ID NO: 8205 - protein, 262 aa, Unknown
  Sequence found in Organisms: Gossypium hirsutum, Gossypium raimondii
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFCLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKRKGIKLSIIEEARKRLAAQNAA

SEQ ID NO: 8206 - protein, 264 aa, Cajanus cajan
MARGLKKHLKRLNAPKHWMLDKLGGAFAPKPSSGPHKSRECLPLILILRNRLKYALTYREVIAILMQRHVFVDGKVRTDKTYPAGFMDVVSIPKTNESFRLLYDTKGRFRLHSVRDEESKFKLCKVRSVQFGQKGIPYLNTYDGRTIRYPDPLIKANDTIKLDLESNKITDFIKFDVGNVVMVTGGRNRGRVGVIKSREKHKGSFETIHIQDATGHEFTTRMGNVFIIGKGTKPWVSLPKGRGIKLSIIEEARKRQAAQHETTA

SEQ ID NO: 8207 - protein, 264 aa, Papaver somniferum
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVSLPKGKGIKLSIIEEARKRLAAQGAATA

SEQ ID NO: 8208 - protein, 261 aa, Arabidopsis lyrata
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPFLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQA

SEQ ID NO: 8209 - protein, 261 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVYTIGKGTKPWVSLPKGKGIKLTIIEEARKRLSAQQA

SEQ ID NO: 8210 - protein, 264 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVQFGQKGIPYLNTYDGRTIRYPDPLIKANDTIKLDLETNKIVDFIKFDVGNVVMVTGGRNTGRVGVIKNREKHKGSFDTIHVQDATGHEFATRMGNVFTIGKGQSHGCLFQRQGIKLSIIEEARKRLAAAGATATA

SEQ ID NO: 8211 - protein, 264 aa, Phaseolus coccineus
MARGLKKHLKRLNAPKHWMLDKLGGAFAPKPSSGPHKSRECLPLILILRNRLKYALTYREVISILMQRHVLVDGKVRTDKTYPSGFMDVVSIPKTNENFRLLYDTKGRFRLHSVRDEEAKYKLCKVRSVQFGQKGIPYLNTYDGRTIRYPDPVIRANDTIKLDLEENKIVEFIKFDVGNVVMVTGGRNRGRVGVIKSRDKNKGSFETIHVQDATGHEFATRLGNVFTIGKGTKPWVSLPKGKGIKLSIIEEARKRISAQQATAA

SEQ ID NO: 8212 - protein, 262 aa, Theobroma cacao
MARGLKKHLKRLNAPKHWMLDKLGGAFAPKPSSGPHKSRECLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHIQDAAGHEFATRLGNVFTIGKGTKPWVSLPKGKGIKLSVIEEARKRLAAQNAV

SEQ ID NO: 8213 - protein, 262 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8214 - protein, 262 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEARKRLAGQQAA

SEQ ID NO: 8215 - protein, 264 aa, Castanea mollissima
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYLNTYDGRTIRYPDPIIKANDTIKLDLETGKITDFIKFDVGNVVMVTGGRNRGRVGVIKNREKHKGTFETVHIQDATGHEFATRLGNVYTIGKGTKPWVSLPKGKGIKLSIIEEAKKRLQGQQTTAA

SEQ ID NO: 8216 - protein, 262 aa, Gossypium hirsutum
MARGLKKHLKRLNAPRHWMLDKLGGAFAPKPSSGPHKSRECLPLVLILRNRLKYALTYREVIAILMQRHVMVDGKVRTDKTYPAGFMDVVSIPKTNEDFRLLYDTKGRFRLHAITGDESKFKLCKVRSVQFGQKGIPYLNTYDGRTIRYPDPLIKANDTIKFDLESNKIVDFIKFDVGNVVMVTGGRNRGRVGVIKNREKHKGSFETIHVQDAAGHEFATRLGNVFTIGKGTKPWVLLPKGKGIKLSIIEEARKRLAAQSAA

SEQ ID NO: 8217 - protein, 264 aa, Solanum melongena
MARGLKKHLKRLNAPKHWMLDKLGGAFAPKPSSGPHKSRECLPLVIILRNRLKYALTYREVISILMQRQVLVDGKVRTDKTYPAGFMDVVSIPKTNENFRLLYDTKGRFRLHSVRDEESKFKLCKVRSVQFGQKGIPYLNTYDGRTIRYPDPLIKANDSIKLDLESNKIVDFIKFDVGNVVMVTGGRNRGRVGIIKNREKHKGSFETLHIQDATGHEFATRLGNVFTLGKGTKPWVSLPKGKGIKLSIIEEARKRLAAQSATTA

SEQ ID NO: 8218 - protein, 264 aa, Solanum melongena
MARGLKKHLKRLNAPKHWMLDKLGGAFAPKPSSGPHKSRECLPLVIILRNRLKYALTYREVISILMQRQVLVDGKVRTDKTYPSGFMDVVSIPKTNENFRLLYDTKGRFRLHSVRDEEAKFKLCKVRSVQFGQKGIPYLNTNDGRTIRYPDPLIKANDTIKLDLESNKIVDFIKFDVGNVVMVTGGRNRGRVGIIKNREKHKGSFETLHIQDATGHEFATRLGNVFTLGKGTKPWVSLPKGKGIKLSIIEEARKRLAAQSASAA

SEQ ID NO: 8219 - protein, 264 aa, Fagopyrum esculentum
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLMYDTKGRFRLHSVRDDEAKFKLCKVRSVQFGQKGIPYINTYDGRTIRYPDPLIKANDTIKLDLETSKIVDFIKFDVGNVVMVTGGRNRGRVGVIKNREKHKGSFETIHVTDSQGHEFATRLGNVFIIGKGTKPWVSLPKGKGIKLTIIEEAKKRQQQAQATTA

SEQ ID NO: 8220 - protein, 264 aa, Ipomoea nil
MARGLKKHMKRLNAPKHWMLDKLGGAFAPKPSSGPHKSRECLPLVLIIRNRLKYALTYREVISILMQRHVLVDGKVRTDKTYPAGFMDVVSMPKTNENFRLLYDTKGRFRLHSIRDEESKFKLCKVRSVQFGKKGIPYINTYDGRTIRYPDPLIKANDTIKLDLESNKIVDFIKFDVGNVVMVTGGRNRGRVGVIKNREKHKGSFETVHIQDALGHEFATRLGNVYTIGKGTKPWVSLPKGKGIKLTIIEEAKKRLAAQSATTA

SEQ ID NO: 8221 - protein, 264 aa, Ipomoea nil
MARGLKKHMKRLNAPKHWMLDKLGGAFAPKPSSGPHKSRECLPLVLIIRNRLKYALTYREVISILMQRHVLVDGKVRTDKTYPAGFMDVVSIPKTNENFRLFYDTKGRFRLHSIRDEEAKFKLCKVRSVQFGKKGIPFINTYDGRTIRYPDPLIKANDTVKLDLESNKVVDFIKFDVGNVVMVTGGRNRGRVGVIKNREKHKGSFETVHIQDATGHEFATRLGNVFTIGKGTKPWVSLPKGKGIKLSIIEEAKKRLAAQSATTA

SEQ ID NO: 8222 - protein, 265 aa, Medicago truncatula
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIKANDTIKLDLEQNKITDFIKFDVGNVVMVTGGRNRGRVGFIKNRKKHMGTFETIHVQDAAGHEFATRLGNVFTIGRGPKPWVSLPKGRGIKLTVIEEARKRMAASQQAAAA

SEQ ID NO: 8223 - protein, 265 aa, Medicago truncatula
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNESFRLLYDTKGRFRLHSVRDDEAKFKLCKVRSVQFGQKGIPYLNTYDGRTIRYPDPVIRANDTIKLDLEENKIVDFIKFDVGNVVMVTGGKNRGRVGVIKNREKHKGTFETIHVQDATGHEFATRLVNVFTIGKGTKPWVSLPKGKGIKLTVIEEARKRAAAAQQAVAA

SEQ ID NO: 8224 - protein, 264 aa, Quercus alba
MARGLKKHLKRLNAPKHWMLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYLNTLDGRTIRYPDPIIKANDTIKLDLETGKITDFIKFDVGNVVMVTGGRNRGRVGVIKNREKHKGTFETVHIQDSTGHEFATRLGNVYTIGKGTKPWVSLPKGKGIKLSIIEEAKKRLQGQQTTAA

SEQ ID NO: 8225 - protein, 264 aa, Unknown
  Sequence found in Organisms: Solanum tuberosum, Solanum phureja
MARGLKKHLKRLNAPKHWMLDKLGGAFAPKPSSGPHKSRECLPLVIIMRNRLKYALTYREVISILMQRQVMVDGKVRTDKTYPAGFMDVVSIPKTNENFRLLYDTKGRFRLHSLRDEESKFKLCKVRSVQFGQKGIPYLNTYDGRTIRYPDPLIKANDTIKLDLESNKIVDFIKFDVGNVVMVTGGRNRGRVGVIKNREKHKGSFETLHIQDSQGHEFATRLGNVFTLGKGTKPWVSLPKGKGIKLTIIEDARKRLAAQSATPA

SEQ ID NO: 8226 - protein, 262 aa, Raphanus sativus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8227 - protein, 264 aa, Solanum phureja
MARGLKKHLKRLNAPKHWMLDKLGGAFAPKPSSGPHKSRECLPLVIIMRNRLKYALTYREVISILMQRQVMVDGKVRTDKTYPAGFMDVVSIPKTNENFRLLYDTKGRFRLHSLRDEESKFKLCKVRSVQFGQKGIPYLNTYDGRTIRYPDPLIKANDTIKLDLESNKIVDFIKFDVGNVVMVTGGRNRGRVGVIKNREKHKGSFETLHIQDSQGHEFATRLGNVFTLGKGTKPWVSLPKGKGIKLTIIEEARKKLAAQSATPA

SEQ ID NO: 8228 - protein, 264 aa, Nicotiana tabacum
MARGLKKHLKRLNAPKHWMLDKLGGAFAPKPSSGPHKSRECLPLIIILRNRLKYALTYREVIAILMQRQVMVDAKVRTDKTYPAGFMDVVSIPKTNENFRLLYDTKGRFRLHSIRDEEAKFKLCKVRSIQFGSKGIPYLNTYDGRTIRYPDPLIKANDTIKLDLESNKIVDFIKFDVGNVVMVTGGRNRGRVGVIKNREKHKGSFETVHIQDALGHEFATRLGNVFTLGKGTKPWVSLPKGKGIKLSIIEEARKRLAAQSATTA

SEQ ID NO: 8229 - protein, 264 aa, Nicotiana tabacum
MARGLKKHLKRLNAPKHWMLDKLGGAFAPKPSSGPHKSRECLPLIIIMRNRLKYALTYGEVISILMQRLVMVDGKVRTDKTYPAGFMDVVSIPKTNENFRLMYDTKGRFRLHSVRDEEAKFKLCKVRSVQFGQKGIPYLNTYDGRTIRYPDPLIKANDTIKLDLENNKIVDFIKFDVGNVVMVTGGRNRGRVGVIKNREKHKGSFETVHIQDAQGHEFATRLGNVVTLGKGTKPWVSLPKGKGIKLSIIEEARKRLAAQSATTA

SEQ ID NO: 8230 - protein, 264 aa, Nicotiana tabacum
MARGLKKHLKRLNAPKHWMLDKLGGAFAPKPSSGPHKSRECLPLIIILRNRLKYALTYREVIAILMQRQVMVDAKVRTDKTYPAGFMDVVSIPKTNENFRLLYDTKGRFRLHAIRDEEAKFKLCKVRSIQFGTKGIPYLNTYDGRTIRYPDPLIKANDTIKLDLESNKIVDFIKFDVGNVVMVTGGRNRGRVGVIKNREKHKGSFETVHIQDALGHEFATRLGNVFTLGKGTKPWVSLPKGKGIKLSIIEEARKRLAAQSATTA

SEQ ID NO: 8231 - protein, 265 aa, Trigonella foenum-graecum
MARGLKKHLKRLNAPKHWMLDKLGGAFAPKPSSGPHKSRECLPLILILRNRLKYALTYREVIAILMQRHVLVDGKVRTDKTYPAGFMDIVSIPKTNENFRLLYDTKGRFRLHSVRDDEAKFKLCKVRSVQFGQKGIPYLNTYDGRTIRYPDPVIRANDTIKLDLEENKIVDFIKFDVGNVVMVTGGKNRGRVGVIKNREKHKGTFETIHVQDATGHEFATRLVNVFTIGKGTKPWVSLPKGKGIKLTVIEEARKRAAAAQQAVAA

SEQ ID NO: 8232 - protein, 264 aa, Zostera marina
MARGLKKHLKRLNAPKHWSLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEEAKFKLCKVRSVQIGQKGIPYLNTYDGRTIRYPDPLIKPNDTIKFDLEENKIVDFIRFDVGNVVMVTGGRNTGRVGIIKNREKHKGTFETIHVQDSTGHEFATRLGNVFTIGKGAKPWVSLPKGKGIKLTIIEEARKREAVALAAAT

SEQ ID NO: 8233 - protein, 263 aa, Zostera marina
MARGLKKHLKRLNAPKHWSLDKLGGAFAPKPSSGPHKARECLPLILILRNKLKYALTYREVIAILMQRHVMVDGKVRTDKTYPAGFMDVVSIPKTNENFRLLYDTKGRFRLHSVRDEESKFKLCKVRSVQIGQKGIPYLNTYDGRTIRYPDPLIKPNDTIKLDLEENKIVDFIKFDVGNVVMVTGGRNTGRVGVIKNREKHKGTFETIHVQDSTGHEFATRLGNVFTIGKGLKPWVSLPKGKGIKLTIIEEARKREAAAAATI

SEQ ID NO: 8234 - protein, 210 aa, Brassica rapa
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHI

SEQ ID NO: 8235 - protein, 244 aa, Brassica juncea
MLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8236 - protein, 262 aa, Unknown
  Sequence found in Organisms: Brassica napus, Brassica juncea, Brassica rapa
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEARKRLSGQQAA

SEQ ID NO: 8237 - protein, 262 aa, Unknown
  Sequence found in Organisms: Brassica napus, Brassica rapa
MARGLKKHLKRLNAPKHWMLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPFIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8238 - protein, 262 aa, Brassica rapa
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8239 - protein, 264 aa, Cicer arietinum
MARGLKKHLKRLNAPKHWMLDKLGGAFAPKPSSGPHKSRECLPLILILRNKLKYALTYREVIAILMQRHVLVDNKVRTDKTYPAGFMDVVSIPKTNENFRLLYDTKGRFRLHSVRDDEAKFKLCKVRSVQFGQKGIPYLNTYDGRTIRYPDPLIKANDTIKLDLEQNKIADFIKFDVGNVVMVTGGRNRGRVGVIKNREKHKGTFETVHVQDATGNEFATRLSNVFTIGKGTKPWVSLPKGRGIKLTVIEEARKRIAAQQVAAA

SEQ ID NO: 8240 - protein, 262 aa, Gossypium hirsutum
MARGLKKHLKRLNAPRHWMLDKLGGAFAPKPSSGPHKSRECLPLVLILRNRLKYALTYREVIAILMQRHVMVDGKVRTDKTYPAGFMDVVSIPKTNEDFRLLYDTKGRFRLHAITGDESKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKLWVLLPKGKGIKLSIIEEARKRLAAQSAA

SEQ ID NO: 8241 - protein, 263 aa, Eschscholzia californica
MARGLKKHLKRLNAPSHWMLDKLGGAFAPKPSSGPHKSRECLPLILILRNRLKYALTYREVVAILMQRHILVDGKVRTDQRYPSGFMDVVSIPKTNENFRLLYDTKGRFRLHSIKDEEAKFKLCKVRNVQFGQKGIPYINTYDGRTIRYPDPLIKANDTIKLDLETNKITDFIKFDVGNVVMVTGGRNRGRVGVIKNREKHKGSFETIHVQDATGHEFATRLGNVFTIGKGTKPWLSLPKGKGIKLSIIEEARKRLAATESAK

SEQ ID NO: 8242 - protein, 264 aa, Carpinus betulus
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSIRDEEAKFKLCKVRSVQFGQKGIPYLNTHDGRTIRYPDPIIKAHDTIKLDLETNKITDFIKFDVGNVVMVTGGRNRGRVGVIKNREKHKGTFETVHIQDATGHEFATRLGNVYTIGKGTKPWVSLPKGKGIKLTIIEEARKRNQGQPLTAA

SEQ ID NO: 8243 - protein, 264 aa, Papaver somniferum
MARGLKKHMKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVSLPKGKGIKLSIIEEARKRLAAQGAATA

SEQ ID NO: 8244 - protein, 262 aa, Gossypium hirsutum
MARGLKKHLKRLNAPRHWMLDKLGGAFAPKPSSGPHKSRECLPLVLILRNRLKYALTYREVIAILMQRHVMVDGKVRTDKTYPAGFMDVVSIPKTNEDFRLLYDTKGRFRLHAITGDESKFKLCKVRSVQFGQKGIPYLNTYDGRTIRYPDPLIKANDTIKFDLESNKIVDFIKFDVGNVVMVTGGRNRGRVGVIKNREKHKGSFETIHVQDAAGHEFATRLGNVFTIGKGTKPWVLLPKGKGIKLSIIEEARKRLAAQSAT

SEQ ID NO: 8245 - protein, 251 aa, Antirrhinum majus
MARGLKKHLKRLNAPKHWMLDKLGGAFAPKPSSGPHKSRECLPLILIIRNRLKYALTYREVISILMQRHILVDGKVRTDKTYPAGFMDVVSIPKTNENFRLLYDTKGRFRLHSVRDEEAKFKLCKVRSVQFGKKGIPYINTFDGRTIRYPDPLIKANDTIKLDLEENKIVDFIKFDVGNVVMVTGGRNRGRVGVIKNREKHKGSFETIHIQDSTGHEFATRLGNVFTIGKGTKPWVSLPKGKGIKLSIIEE

SEQ ID NO: 8246 - protein, 264 aa, Arnica chamissonis
MARGLKKHLKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGQKGIPYINTYDGRTIRYPDPLIKANDTIKLDLDSNKIVDFIKFDVGNVVMVTGGRNTGRVGILKNREKHKGSFETVHIQDATGHEFATRLGNVFTLGKGSKPWVSLPKGKGIKLTIIEEARKRQAAAAASVA

SEQ ID NO: 8247 - protein, 263 aa, Arnica chamissonis
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGQKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQAATA

SEQ ID NO: 8248 - protein, 262 aa, Brassica juncea
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8249 - protein, 262 aa, Brassica juncea
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLAGQQAA

SEQ ID NO: 8250 - protein, 264 aa, Taraxacum officinale
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNEYFRLLYDTKGRFRLHSVRDEESKFKLCKVRSVQFGQKGIPYINTYDGRTIRYPDPLIKANDTIKLDLDTNKIVDFIKFDVGNVVMVTGGRNTGRVGILKNREKHKGSFETVHIQDSTGHEFATRLGNVFTVGKGSKPWVSLPKGKGIKLTIIEEARKRQAALAAQVA

SEQ ID NO: 8251 - protein, 264 aa, Taraxacum officinale
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGQKGIPYINTYDGRTIRYPDPLIKTNDTIKLDLDTNKIVDFIKFDVGNVVMVTGGRNTGRVGILKNREKHKGSFETVHIQDSTGHEFATRLGNVFTVGKGSKPWVSLPKGKGIKLTIIEEARKRQAALAAQVA

SEQ ID NO: 8252 - protein, 263 aa, Flaveria ramosissima
MARGLKKHLKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNRGRVGILKNREKHKGSFETVHIQDATGHEFATRLGNVFTLGKGSKPWVSLPKGKGIKLSIIEEARKRQAAAAAVA

SEQ ID NO: 8253 - protein, 262 aa, Heritiera littoralis
MARGLKKHLKRLNAPRHWMLDKLGGAFAPKPSSGPHKSRECLPLILILRNRLKYALTCREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLATQNAV

SEQ ID NO: 8254 - protein, 264 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGSKGIPYINTYDGRTIRYPDPLIKANDTIKLDLDTNKIVDFIKFDVGNVVMVTGGRNTGRVGILKNREKHKGSFETVHIQDSTGHEFATRLGNVFTLGKGTKPWVSLPKGKGIKLTIIEEARKRQAAPAAQVA

SEQ ID NO: 8255 - protein, 263 aa, Nuphar advena
MARGLKKHLKRLNAPKHWMLDKLGGAFAPKPSSGPHKSRECLPLILIIRNKLKYALTYRDVVSILMQRLVTVDGKVRTDQKYPCGFMDVVSIPKVNENYRLLYDTKGRFRLQSIKDEEAKFKLCKVRSVQFGQKGIPYLNTYDGRTIRYPDPLIKANDTIKLDIETNKIVDFIKFDVGNVVMVTGGRNRGRIGVIKNREKHKGSFEIIHVQDAAGHEFATRLGNVFTIGKGTKPWVSLPKGKGIKLSIIEEARKRNAAAVAAA

SEQ ID NO: 8256 - protein, 263 aa, Nuphar advena
MARGLKKHLKRLNAPKHWMLDKLGGAFAPKPSSGPHKSRECLPLILIIRNKLKYALTYRDVVSILMQRLVTVDGKVRTDQKYPCGFMDVVSIPKVNENYRLLYDTKGRFRLQSIKDEEAKFKLCKVRSVQFGQKGIPYLNTYDGRTIRYPDPLIKANDTIKLDIETNKIVDFIKFDVGNVVMVTGGRNRGRIGVIKNREKHKGSFEIIHVQDAAGHEFATRLGNVFTIGKGNKPWVSLPKGKGIKLSIIEEARKRKASAVAAA

SEQ ID NO: 8257 - protein, 263 aa, Populus trichocarpa
MARGLKKHLKRLNAPKHWMLDKLGGAFAPKPSSGPHKSRECLPLILILRNRLKYALTYREVIAILMQRHVFVDGKVRTDKTYPSGFMDVVSIPKTNESFRLLYDTKGRFRLHSLREDEAKFKLCKVRSVQFGQKGIPYLNTYDGRTIRYPDPLIKANDTIKLDLENYKIVDYIKFDVGNVVMVTGGRNRGRVGVIKNREKHKGSFETIHVQDATGHEFATRLGNVFTIGKGTKPWVSLPKGKGIKLSIIEEAKKRLAASQNAA

SEQ ID NO: 8258 - protein, 264 aa, Papaver somniferum
  misc_feature (87)..(87): Xaa can be any naturally occurring amino acid
MARGLKKHLKRLNAPKHWMLDKLGGAFAPKPSSGPHKSRECLPLILILRNRLKYALTYREVIAILMQRHILVDGKVRTDKTYPSGFXDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVSLPKGKGIKLSIIEEARKRLAAQGAATA

SEQ ID NO: 8259 - protein, 262 aa, Raphanus sativus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8260 - protein, 262 aa, Tripterygium wilfordii
MARGLKKHMKRLNAPKHWMLDKLGGAFAPKPSSGPHKSRECMPMILILRNRLKYALTYREVIAILMQRHVLVDGKVRTDKTYPTGFMDVVSIPKTNENFRLLYDTKGRFRLHSIRDDEAKFKLCKVRSVQFGQKGIPYLNTYDGRTIRYPDPLIKANDTIKLDLESSKIVDFIKFDVGNVVMVTGGRNRGRVGVIKNREKHKGSFETIHIQDATGHEFATRLSNVFTIGKGTKPWVSLPKGKGIKLTIIEEAKKRLAAEAAA

SEQ ID NO: 8261 - protein, 200 aa, Secale cereale
MQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 8262 - protein, 262 aa, Unknown
  Sequence found in Organisms: Brassica napus, Brassica rapa
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8263 - protein, 264 aa, Fagus grandifolia
MARGLKKHLKRLNAPKHWMLDKLGGAFAPKPSSGPHKSRECLPLILILRNRLKYALTYQEVVSILMQRHVLVDGKVRTDKTYPSGFMDVVSIPKTTENFRLLYDTKGRFRLHSIRDEEAKFKLCKVRSVQFGQKGIPYLNTYDGRTIRYPDPIIKANDTIKLDLEINKITDFIKFDVGNVVMVTGGRNRGRVGIIKSREKHKGSFETVHIQDALGHEFATRLGNVFTVGKGSKPWVSLPKGKGIKLSIIEEARKRLQGQQINAA

SEQ ID NO: 8264 - protein, 265 aa, Allium cepa
MARGLKKHMKRLNAPRHWMLNKLGGAFAPKPSSGPHKSRECLPLILILRNKLKYALTYREVIAILMQRHVMVDNKVRTDKTYPAGFMDVVSIPKTNENFRLLYDTKGRFRLHTIRDDEAKFKLCKVRSVQFGKKAIPFLNTYDGRTIRYPDPLIRANDTIKLDLETNKIVDFIKFDVGNVVMVTGGRNTGRVGIIKNREKHKGTFETIHVQDATGHEFATRLGNVFTIGKGTKPWVTLPKGKGIKLSIIEEARKRTAAAAAKATA

SEQ ID NO: 8265 - protein, 264 aa, Papaver somniferum
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVTLPKGKGIKLTIIEEARKRLAAQGAATA

SEQ ID NO: 8266 - protein, 263 aa, Unknown
  Sequence found in Organisms: Ambrosia trifida, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQAATA

SEQ ID NO: 8267 - protein, 262 aa, Brassica juncea
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLSGQQAA

SEQ ID NO: 8268 - protein, 262 aa, Arabidopsis lyrata
MARGLKKHLKRINAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPFLNTYDGRTIRYPDPLIKPNDTVKLDLEENKIVEFIKFDVGNVVMVTGGRNRGRVGVIKNREKHKGSFETIHIQDSTGHEFATRLGNVFTIGKGTKPWMSLPKGKGIKLTIIEEARKRLASQQAA

SEQ ID NO: 8269 - protein, 261 aa, Brassica juncea
ARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8270 - protein, 262 aa, Brassica juncea
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8271 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSLRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8272 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAWKRLSAQQAA

SEQ ID NO: 8273 - protein, 263 aa, Taraxacum officinale
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGQKGIPYINTYDGRTIRYPDPLIKANDTIKLDLESNKIVDFIKFDVGNVVMVTGGRNTGRVGILKNREKHKGSFETVHIQDSTGHEFATRLGNVFTVGKGSKPWVSLPKGKGIKLTIIEEARKRQAALAATA

SEQ ID NO: 8274 - protein, 263 aa, Flaveria ramosissima
MARGLKKHLKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNRGRVGILKNREKHKGSFETVHIQDATGHEFATRLGNVFTLGKGSKPWVSLPKGKGIKLSIIEEARKRQAAAATVA

SEQ ID NO: 8275 - protein, 263 aa, Flaveria ramosissima
MARGLKKHLKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDSNKIVDFIKFDVGNVVMVTGGRNRGRVGILKNREKHKGSFETVHIQDATGHEFATRLGNVFTLGKGSKPWVSLPKGKGIKLSIIEEARKRQAAAAAVA

SEQ ID NO: 8276 - protein, 263 aa, Flaveria ramosissima
MARGLKKHLKRLNAPKHWMLDKLGGAFAPKPLSGPHKSRECLPLILILRNRLKYALTYREVQSILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNRGRVGILKNREKHKGSFETVHIQDATGHEFATRLGNVFTLGKGSKPWVSLPKGKGIKLSIIEEARKRQAAAAAVA

SEQ ID NO: 8277 - protein, 263 aa, Gerbera hybrid cultivar
MARGLKKHLKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEESKFKLCKVRSVQFGQKGIPYINTYDGRTIRYPDPLIKANDTIKLHLDSNKIVDFIKFDVGNVVMVTGGRNRGRVGVLKNREKHKGSFETVHIQDATGHEFATRLGNVFTLGKGTKPWVSLPKGKGIKLTIIEEARKRQAALTATA

SEQ ID NO: 8278 - protein, 263 aa, Mesembryanthemum crystallinum
MARGLKKHLKRLNAPKHWMLDKLGGAFAPKPSSGPHKSRECLPLILILRNRLKYALVYREVIAILMQRHVLVDGKVRTDKTYPTGFMDVISIPKTNESFRLLYDVKGRFRLHSLRDEEAKFKLCKVRNVQFGSKGIPYINTYDGRTIRYPDPLIKANDTIKLDLEENKIVDFIKFDVGNVVMVTGGRNRGRVGVLKNREKHKGSFETIHIQDSQGHEFATRMANVFIIGKGTKPWVSLPKGKGIKLTVIEEARKRQAEKAATA

SEQ ID NO: 8279 - protein, 264 aa, Lotus japonicus
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSVRDDEAKFKLCKVRSVQFGQKGIPYLNTYDGRTIRYPDPVIRANDTIKLDLQENKIVDFIKFDVGNVVMVTGGRNRGRVGVIKSRDRQKGSFDTIHVQDATGHEFATRLGNVFTIGKGSKPWISLPKGKGIKLSIIEEARKRIAAQQATAA

SEQ ID NO: 8280 - protein, 263 aa, Mimulus guttatus
MARGLKKHLKRLNAPKHWMLDKLGGAFAPKPSSGPHKSRECLPLILILRNRLKYALTYREVIAILMQRHILVDGKVRTDKTYPSGFMDVVSIPKTNENFRLLYDTKGRFRLHSIRDEEAKFKLCKVRSIQFGKKGIPYLNTYDGRTIRYPDPLIKANDTIKLDLETNKIADFIKFDVGNVVMVTGGRNRGRVGILKNREKHKGSFETVHIQDSTGHEFATRLGNVYTIGKGSKPWVSLPKGKGIKLTIIEEARKRITSQSATA

SEQ ID NO: 8281 - protein, 264 aa, Petunia hybrida
MARGLKKHMKRLNAPKHWMLDKLGGAFAPKPSSGPHKSRECLPLTLILRNRLKYALTYREVIAILMQRQVMVDGKVRTDKTYPAGFMDVVSIPKTNENFRLLYDTKGRFRLHSVRDEESKFKLCKVRSIQFGQKGIPFLNTYDGRTIRYPDPLIKANDTIKLDLETNKIVDFIKFDVGNVVMVTGGRNRGRVGVIKNREKHKGSFETVHIQDALGHEFATRLGNVFTLGKGTKPWVSLPKGKGIKLTIIEEARKRLAAQSATTA

SEQ ID NO: 8282 - protein, 262 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQEAA

SEQ ID NO: 8283 - protein, 264 aa, Solanum lycopersicum
MARGLKKHLKRLNAPKHWMLDKLGGAFAPKPSSGPHKSRECLPLVIILRNRLKYALTYREVISILMQRQVMVDGKVRTDKTYPAGFMDVVTIPKTNESFRLLYDTKGRFRLHSLRDEEAKFKLCKVRSVQFGQKGIPYLNTYDGRTIRYPDPLIKANDTIKLDLDSNKIVDFIKFDVGNVVMVTGGRNRGRVGILKNREKHKGSFETVHIQDSLGHEFATRLGNVFTLGKGSKPWVSLPKGKGIKLSIIEEARKRMAAQSATAA

SEQ ID NO: 8284 - protein, 263 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEEAKFKLCKVRSVQFGSKGIPYINTYDGRTIRYPDPLIKANDTIKLDLDTNKIVDFIKFDVGNVVMVTGGRNTGRVGILKNREKHKGSFETVHIQDSTGHEFATRLGNVFTLGKGSKPWVSLPKGKGIKLTIIEEARKRRAAQDAVA

SEQ ID NO: 8285 - protein, 193 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPFIKPNDTIKLDLEENKIVEFIKFDVGNVVMVTGGRTGGVLV

SEQ ID NO: 8286 - protein, 149 aa, Brassica napus
MARGLKKHLKRLNAPKHWMLDKLGGAFAPKPSSGPHKSRECLPLVLIIRNRLKYALTYREVISILMQRHIQVDGKVRPTRPTLLVSWMLSLSPRLTRTSVFSMTPRVVSVFTPSGMRKPSLSFARFELSSRTEGNPLPQHIRWSHHPLP

SEQ ID NO: 8287 - protein, 182 aa, Flaveria ramosissima
MARGLKKHLKRLNAPKHWMLDKLGGAFAPKPSSGPHKSRECLPLILILRNRLKYALTYREVQSILMQRHVLVDNKVRTDKTTLLVLWMSSQFPKPMKTSDFYMIPRAGLGSTPSEMRNQSSSCAKSAQSNLVQKGFLTSTPMMVEPFATLIPSSKLMTPSNLTWTQTRLLISSSLMLGMLSW

SEQ ID NO: 8288 - protein, 210 aa, Panicum virgatum
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGQLRDHPC

SEQ ID NO: 8289 - protein, 267 aa, Eutrema parvulum
FILFLQARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQAA

SEQ ID NO: 8290 - protein, 267 aa, Eutrema parvulum
LNVSLQARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQAA

SEQ ID NO: 8291 - protein, 262 aa, Unknown
  Sequence found in Organisms: Brassica napus, Brassica rapa
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSVRDEEAKFKLCKVRTIQLGQKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8292 - protein, 263 aa, Centaurea maculosa
MARGLKKHLKRLNAPKHWNLDKLGGAFAPKPSSGPHKSRECLPLILILRNRLKYALTYREVISILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTIGKGSKPWVSLPKGKGIKLTIIEEARKRQAALTAIA

SEQ ID NO: 8293 - protein, 263 aa, Unknown
  Sequence found in Organisms: Centaurea maculosa, Cirsium arvense
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8294 - protein, 263 aa, Centaurea maculosa
MARGLKKHLKRLNAPKHWQLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8295 - protein, 263 aa, Gossypium hirsutum
MRARELKKHLKRLNALRHWMLEKLGGAFAPKPSSGPHKSREWLPLILILRNRLKYALTYREVIAILMQRHVMVDGKVRTDKTYPAGFMDVVSIPKTNEDFRLLYDTKGRFRLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKGKGIKLSIIEEARKRLAAQAAA

SEQ ID NO: 8296 - protein, 262 aa, Gossypium raimondii
MARGLKKHLKRLNAPRHWMLDKLGGAFAPKPSSGPHKSRECLPLILILQNRLKYALTYREVIAILMQRHVMVDGKVRTDKTYPTGFMDVVSIPKTNEDFRLLYDTKGRFRLHAITGDETKFKLCKVRSVQFGQKSIPYLNTYDGRTIRYPDPLIKANDTIKLDLESNKIVDFIKFDVGNVVMVTGGRNRGRVGVIKKREKHKGSFETIHVQDAAGHEFATRLGNVFTIGKGTKPWVSLPKGKGIKLSIIEEARKRLAAQATV

SEQ ID NO: 8297 - protein, 264 aa, Papaver somniferum
MARGLKKHMKRLNAPKHWMLDKLGGAFAPKPSSGPHKSRECLPLILILRNRLKYALTYREVIAILMQRHILVDGKVRTDQTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVTLPKGKGIKLSIIEEARKRLAAQGAATA

SEQ ID NO: 8298 - protein, 263 aa, Unknown
  Sequence found in Organisms: Ambrosia trifida, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAAAAVA

SEQ ID NO: 8299 - protein, 263 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQEAAA

SEQ ID NO: 8300 - protein, 263 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAASAVA

SEQ ID NO: 8301 - protein, 264 aa, Aquilegia formosa
MARGLKKHLKRLNAPKHWMLDKLGGAFAPKPSSGPHKARECLPLALILRNRLKYALTYREVIAILMQRHVLVDAKVRTDKTYPAGFMDVISIPKTNENFRLLYDTKGRFKIHAIKDEEAKFKLCKVRSVQFGQKGIPYLNTYDGRTIRYPDPLIRAHDTIKIDLETNKIIDFIKFNVGNVVMVTGGSNRGRVGIIKSREKHKGTFETIHLQDATGHEYATRLGNVFTIGKGTKPWVSLPKGKGIKLTIIEEAKKRAAAQGAATA

SEQ ID NO: 8302 - protein, 264 aa, Aquilegia formosa
MARGLKKHLKRVNAPKHWMLDKLGGAFAPKPSSGPHKSRECLPLVIILRERLKYGLTGHEVVSILMQRHVMVDGKVRTDKTYPAGFMDVVSIPKTNENFRLLYDTKGRFRMHAIKDEEAKVKLCKVRSVQFGQKGIPYLNTYDGRTIRYPDPLIKANDTIKIDLESNKILDFIKFDVGNVVMVTGGSNRGRVGVIKNREKHKGTFETIHLQDSTGHPFATRLGNVFTIGKGTKPWVSLPKGKGIKLTIIEEAKKRQAAQGAATA

SEQ ID NO: 8303 - protein, 262 aa, Brassica oleracea
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQLGQKGIPFLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8304 - protein, 263 aa, Euphorbia peplus
MARGLKKHQKRLNAPKHWMLGKLGGAFAPKPSSGPHKSRECLPLILILRDRLKYALTYREVVSILMQRHILVDGKVRTDKTYPSGFMDVLSIPKTNENFRLLYDTKGRFRLHAIRDDEAKFKLCKVRSIQFGQKGIPYLNTYDGRTIRYPDPLIKANDTIKLDLETNKITEFIKFDVGNVVMVTGGRNRGRVGVLKNREKHKGSFETVHIQDATGHEFATRLANVFTIGKGTKPWVSLPKGKGIKLTIIEEARKKQAAAQAAA

SEQ ID NO: 8305 - protein, 263 aa, Flaveria ramosissima
MARGLKKHLKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDSNKIVDFIKFDVGNVVMVTGGRNRGRVGILKNREKHKGSFETVHIQDALGHEFATRLGNVFTIGKGSKPWVSLPKGKGIKLTIIEEARKRQAAQESAA

SEQ ID NO: 8306 - protein, 263 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDSTGHEFATRLGNVFTLGKGSKPWVSLPKGKGIKLTIIEEARKRRAAQDAVA

SEQ ID NO: 8307 - protein, 264 aa, Solanum tuberosum
MARGLKKHLKRLNAPKHWMLDKLGGAFAPKPSSGPHKSRECLPLVIILRNRLKYALTYREVISILMQRQVMVDGKVRTDKTYPAGFMDVVTIPKTNESFRLLYDTKGRFRLHSLRDEEAKFKLCKVRSVQFGQKGIPYLNTYDGRTIRYPDPLIKANDTIKLDLDSNKIVDFIKFDVGNVVMVTGGRNRGRVGILKNREKHKGSFETVHIQDSLGHEFATRLGNVFTLGKGSKPWVSLPKGKGIKLSIIEEARKRMATQSATTA

SEQ ID NO: 8308 - protein, 262 aa, Raphanus sativus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTISLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLSGQQAA

SEQ ID NO: 8309 - protein, 262 aa, Raphanus sativus
MARGLKKHLKRLNAPHHWSLDKLGGAFAPKPSSGPHKSRECLPLVLIIRNRLKYALTYREVISILMQRHIQVDGKVRTDKTYPAGFMDVVSIPKTNENFRLLYDTKGRFRLHSLRDEEAKFKLCKVRTIQLGQKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLAGQQAA

SEQ ID NO: 8310 - protein, 262 aa, Raphanus sativus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSVRDEEAKFKLCKVRTISLGKKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8311 - protein, 264 aa, Silene vulgaris
MARGLKKHLKRLNAPKHWMLDKLGGAFAPKPSSGPHKARECLPLILILRNRLKYALVYREVIAILMQRQIMVDGKVRTDKTYPAGFMDVISIPKTNESFRLLYDVKGRFRLHSIRDDEAKFKLCKVRNVQFGNKGIPYLNTYDGRTIRYPDPLIKANDTIKLDLEENKIVEFVKFDVGNVVMVTGGRNRGRVGVIKNREKHKGSFETIHIQDSQGHEFATRMGNVFIIGKGTKPWVSLPKGKGIKLTIIEEARKRQAEKSAATA

SEQ ID NO: 8312 - protein, 264 aa, Thalictrum flavum
MARGLKKHLKRLNAPKHWMLDKLGGAFAPKPSSGPHKARECLPLALILRNRLKYALTYREVVAILMQRHVLVDAKVRTDKTYPAGFMDVISIPKTNENFRLLYDAKGRFKIHAIKDEEAKFKLCKVRSVQFGQKGIPYLNTYDGRTIRYPDPLIRANDTIKIDLETNKIIDFIKFNVGNVVMVTGGSNRGRVGVIKSREKHKGTFETIHLQDATGHEYATRLGNVFTIGKGTKPWVSLPKGKGIKLTIIEEAKKRAAAQGAATA

SEQ ID NO: 8313 - protein, 263 aa, Triphysaria pusilla
MARGLKKHLKRLNAPSHWMLDKLGGAFAPKPSSGPHKSRECLPLILILRNRLKYALTYREVIAILMQRHILVDGKVRTDKTYPAGFMDVVSIPKTNENFRLLYDTKGRFRLHSVRDEEAKFKLCKVRNVQFGKKGIPYINTYDGRTIRYPDPLIKANDTIKLDLETNKVVDFIKFDVGNVVMVTGGRNRGRVGVIKNREKQKGSFETIHVQDATGHEFATRLSNVYTIGKGTKPWVSLPKGKGIKLSILEEAKKRIAAQSATA

SEQ ID NO: 8314 - protein, 264 aa, Valeriana officinalis
MARGLKKHLKRLNAPKHWMLDKLGGAFAPKPSSGPHKARECLPLVLILRNRLKYALTYREVQSILMQRHVLVDGKVRTDKTYPSGFMDVVSIPKTNENFRLLYDTKGRFRLHSIRDEESKFKLCKVRSVQFGSKGIPYINTYDGRTIRYPDPLIKANDTIKFDLETQKITDFIKFDVGNVVMVTGGRNRGRVGILKNREKHKGSFETVHIQDSLGHEFATRLSNVYTIGKGSKPWVSLPKGKGIKLTIIEEAKKRLAAQSAATA

SEQ ID NO: 8315 - protein, 283 aa, Brassica rapa
LTTFTTRSELNERSRLDRRYAQARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPFIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8316 - protein, 267 aa, Eutrema parvulum
FFVNLQARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTIGKGTKPWVSLPKGKGIKLTIIEEARKRLSAQQAA

SEQ ID NO: 8317 - protein, 269 aa, Ocimum basilicum
MARGLKKHLKRLNAPKHWMLDKLGGAFAPKPSSGPHKSRECLPLILIIRNRLKYALSYREVISILMQRHVQVDGKVRTDKTYPAGFMDVVSIPKTNENFRLLYDTKGRFRLHSIRDEEAKFKLCKVRSVQFGKKGIPYLNTYDGRTIRYPDPLIKANDTIKLDLESNKIVDFIKFDVGNVVMVTGGRNRGRVGVIKNREKHKGSFETLHIQDATGHEFATRLSNVFTIGQGTKPWVSLLKGKGIKLSIIEEARKGFRPNLLQLLRSLCL

SEQ ID NO: 8318 - protein, 258 aa, Allium cepa
MKRLNAQDTGCSTNWRCICPKPSSGPHKSRECLPLILILRNKLKYALTYREVIAILMQRHVMVDGKVRTDKTYPAGFMDVVSIPKTNENFRLLYDTKGRFRLHTIRDDEAKFKLCKVRSYQLGHKGIPYLNTYDGRTIRYPDPLIRANDTIKIDLETNKIVDFIKFDVGNVIMVTGGRNTGRVGIIKNREKHKGTFETIHVVDATGHEFATRLSNVFTIGKGTKPWVTLPKGKGIKLSIIEEARKRNAAAAAAAKATA

SEQ ID NO: 8319 - protein, 245 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGRVSS

SEQ ID NO: 8320 - protein, 245 aa, Ambrosia trifida
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSNHGFLYPRVRVSS

SEQ ID NO: 8321 - protein, 195 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGIL

SEQ ID NO: 8322 - protein, 264 aa, Phaseolus coccineus
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDDEAKFKLCKVKSVQFGQKGIPYLNTFDGRTIRYPDPVIRANDTIKLDLEENKIVDFIKFDVGNVVMVTGGRNRGRVGVIKSRERQKGSFDTIHVQDATGHEFATRLANVFTIGKGTKPLISLPKGKGIKLSIIEEARKRTAAQQATAA

SEQ ID NO: 8323 - protein, 263 aa, Centaurea maculosa
MARGLKKHMKRLNAPKHWMLDKLGGAFAPKPSSGPHKSRECLPLILILRNRLKYALTYREVISILMQRHVLVDNKVRTDKIYPAGFMDVVSIPKTNENFRLLYDTKGRFRLHSIRDEEAKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8324 - protein, 263 aa, Unknown
  Sequence found in Organisms: Centaurea maculosa, Cirsium arvense
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8325 - protein, 263 aa, Centaurea maculosa
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSVRDEEAKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8326 - protein, 264 aa, Eschscholzia californica
MARGLKKHLKRLNAPSHWMLDKLGGAFAPKPSSGPHKSRECLPLILILRNRLKYALTYREVVAILMQRHILVDGKVRTDQRYPSGFMDVISIPKTNENFRLLYDTKGRFRLHSIKDEEAKFKLCKVRNVQFGQKGIPYINTYDGRTIRYPDPLIKANDTVKLDLETNKVIDFIKFDVGNVVMVTGGRNRGRVGVIKNREKHKGSFETIHVQDATGHEFATRLGNVFTIGKGTKPWLSLPKGKGIKLTIIEEARKRLAAKGETVA

SEQ ID NO: 8327 - protein, 263 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQYATA

SEQ ID NO: 8328 - protein, 263 aa, Ambrosia trifida
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQESAA

SEQ ID NO: 8329 - protein, 264 aa, Phaseolus coccineus
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDDEAKFKLCKVKSVQFGQKGIPYLNTFDGRTIRYPDPVIRANDTIKLDLEENKIVDFIKFDVGNVVMVTGGRNRGRVGVIKNRERQKGSFDTIHVQDATGHEFATRLANVFTIGKGTKPLISLPKGKGIKLSIIEEARKRTATQQATAA

SEQ ID NO: 8330 - protein, 263 aa, Cichorium intybus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGQKGIPYINTYDGRTIRYPDPLIKANDTIKLDLDSNKIVDFIKFDVGNVVMVTGGRNTGRVGILKNREKHKGSFETVHIQDATGHEFATRLGNVFTLGKGTKPWVSLPKGKGIKLTIIEEARKRQAALAATA

SEQ ID NO: 8331 - protein, 263 aa, Cichorium intybus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSLRDEESKFKLCKVRSVQFGSKGIPYINTYDGRTIRYPDPLIKANDTIKLDLDSNKIVDFIKFDVGNIVMVTGGRNTGRVGILKNREKHKGSFETVHIQDSTGHEFATRLGNVFTIGKGSKPWVSLPKGKGIKLTIIEEARKRKAAQESAA

SEQ ID NO: 8332 - protein, 263 aa, Cirsium arvense
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRAGQDTVA

SEQ ID NO: 8333 - protein, 263 aa, Cirsium arvense
MARGLKKHMKRLNAPKHWMLDKLGGAFAPKPSSGPHKSRECLPLILILRNRLKYALTYREVISILMQRHVLVDNKVRTDKTYPAGFMDIVSIPKTNENFRIVYDTKGRFRLHSVRDEESKFKLCKVRSVQFGQKGIPYINTYDGRTIRYPDPLIKANDTIKLDLDSNKIVDFIKFDVGNVVMVTGGRNTGRVGILKNREKHKGSFETVHIQDSTGHEFATRLGNVFTIGKGSKPWVSLPKGKGIKLTIIEEARKRQAALNASA

SEQ ID NO: 8334 - protein, 262 aa, Gossypium hirsutum
MARGLKKHLKRLNAPRHWMLDKLGGAFAPKPSSGPHKSRECLPLILILQNRLKYALTYREVIAILMQRHVMVDGKVRTDKTYPTGFMDVVSIPKTNEDFRLLYDTKGRFRLHAITGDETKFKLCKVRSVQFGQKSIPYLNTYDGRTIRYPDPLIKANDTIKLDLESNKIVDFIKFDVGNVVMVTGGRNRGRVGVIKKREKHKGSFETIHIQDAAGHEFATRLGNVFTIGKGTKPWVSLPKGKGIKLSIIEEARKRLAAQATV

SEQ ID NO: 8335 - protein, 263 aa, Cynara scolymus
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRGGQDPVA

SEQ ID NO: 8336 - protein, 263 aa, Fagopyrum esculentum
MARGLKKHMKRLNAPKHWMLNKLGGAFAPKPSSGPHKARECLPLILILRNRLKYALTYAEVISILMQRHVLVDNKVRTDKTYPAGFMDVVSIPKTNESFRLLYDTKGRFRLHSIRDEEAKFKLCKVRSVQFGQKGIPYINTFDGRTIRYPDPLIKANDSIKLDLENNKIVDFVKFDVGNVVMVTGGRNRGRVGVIKNREKHKGSFETIHIQDSQGHEFATRMGNVFIIGKGTKPWLSLPKGKGIKLTIIEEARKRLAAQTTTA

SEQ ID NO: 8337 - protein, 263 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDSTGHEFATRLGNVFTLGKGTKPWVSLPKGKGIKLTIIEEARKRQAAVAATA

SEQ ID NO: 8338 - protein, 263 aa, Lactuca sativa
MARGLKKHMKRLNAPKHWMLDKLGGAFAPKPSSGPHKSRECLPLILILRNRLKYALTYREVQSILMQRHILVDNKVRTDKTYPAGFMDVVSIPKTNENFRLLYDTKGRFRLHSVRDEESKFKLCKVRSVQFGQKGIPYINTYDGRTIRYPDPLIKANDTIKLDLDSNKIVDFIKFDVGNVVMVTGGRNTGRVGILKNREKHKGSFETVHIQDSTGHEFATRLGNVFTLGKGTKPWVSLPKGKGIKLTIIEEARKRQAAVAATA

SEQ ID NO: 8339 - protein, 263 aa, Mimulus guttatus
MARGLKKHLKRLNAPKHWMLDKLGGAFAPKPSSGPHKSRECLPLILILRNRLKYALTYREVIAILMQRHILVDGKVRTDKTYPAGFMDVVSIPKTNENFRLLYDTKGRFRLHSIRDEEAKFKLCKVRSVQFGKKGIPYINTYDGRTIRYPDPLIKANDTIKLDLDSNKIVDFIKFDVGNVVMVTGGRNRGRVGILKNREKHKGSFETVHIQDSTGNEFATRLSNVYTIGKGTKPWVSLPKGKGIKFTIIEEARKRLAAQSATA

SEQ ID NO: 8340 - protein, 264 aa, Phalaenopsis aphrodite
MARGLKKHLKRLNAPKHWMLDKLGGAFAPKPSSGPHKARECLPLILILRNRLKYALTNREVIAILMQRLVMVDGKIRTDKTYPAGFMDVVQIPKTNENFRLLYDTKGRFRLHSIRDEEAKLKLCKVRSVQFGQKGIPYLNTYDGRTIRYPDPLIKANDTIKLDLDTNKIVDFIKFDVGNVVMVTGGRNRGRVGVIKNREKHKGTFETIHVQDAAGQEFATRLGNVFTVGKGTKPWISLPKGKGVKLSIIEEARKRLAAASTVAA

SEQ ID NO: 8341 - protein, 263 aa, Lippia dulcis
MARGLKKHLKRLNAPKHWMLDKLGGAFAPKPSSGPHKSRECLPLILILRNRLKYAFTYREVIAILMQRHILVDGKVRTDKTYPTGFMDVVSIPKTNENFRLLYDTKGRFRLHSIRDEEAKFKLCKVRNIQFGKKGIPYLNTYDGRTIRYPDPLIKANDTIKLDLESNKITDFIKFDVGNVVMVTGGRNRGRVGILKNREKHKGSFETVHIQDATGHEFATRLGNVYTIGKGTKPWVSLPKGKGIKLSIIEEAKKRISAQAATA

SEQ ID NO: 8342 - protein, 264 aa, Solanum tuberosum
MARGLKKHLKRLNAPKHWMLDKLGGAFAPKPSSGPHKSRECLPLVIILRNRLKYALTYREVISILMQRQVMVDGKIRTDKTYPAGFMDVVTIPKTNESFRLLYDTKGRFRLHSLRDEEAKFKLCKVRSVQFGQKGIPYLNTYDGRTIRYPDPLIKANDTIKLDLDSNKIVDFIKFDVGNVVMVTGGRNRGRVGILKNREKHKGSFETVHIQDSLGHEFATRLGNVFTLGKGSKPWVSLPKGKGIKLSIIEEARKRMATQSATTA

SEQ ID NO: 8343 - protein, 263 aa, Carthamus tinctorius
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLESNKVVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8344 - protein, 263 aa, Carthamus tinctorius
  misc_feature (237)..(237): Xaa can be any naturally occurring amino acid
MARGLKKHMKRLNAPKHWMLDKLGGAFAPKPSSGPHKSRECLPLILILRNRLKYALTYREVVSILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDSTGHEFATRLGNVFTIGKGSKPWVXLPKGKGIKLTIIEEARKRQAALTASA

SEQ ID NO: 8345 - protein, 263 aa, Salvia sclarea
MARGLKKHLKRLNAPKHWMLDKLGGAFAPKPSSGPHKSRECLPLILILRNRLKYALTYREVIAILMQRHIQVDGKVRTDKTYPAGFMDVVSIPKTNENFRLLYDTKGRFRLHSIRDEEAKFKLCKVRNIHFGKKGIPYLNTYDGRTIRYPDPLIKANDTIKLDLESNKITDFIKFDVGNVVMVTGGRNRGRVGILKNREKHKGSFETVHIQDATGHEFATRLGNVYTIGKGTKPWVSLPKGKGIKLSIIEEAKKRISAQAATA

SEQ ID NO: 8346 - protein, 264 aa, Silene vulgaris
MARGLKKHLKRLNAPKHWMLDKLGGAFAPKPSSGPHKARECLPLILILRNRLKYALVYREVIAILMQRQIMVDGKVRTDKTYPAGFMDVISIPKTNENFRLLYDVKGRFRLHSVRDDEAKFKLCKVRNVQFGNKGIPYLNTYDGRTIRYPDPLIKANDTIKLDLEENKIVEFVKFDVGNVVMVTGGRNRGRVGVIKNREKHKGSFETIHIQDSQGHEFATRMGNVFIIGKGTKPWVSLPKGKGIKLTIIEEARKRQAEKSAVTA

SEQ ID NO: 8347 - protein, 264 aa, Solanum phureja
MARGLKKHLKRLNAPKHWMLDKLGGAFAPKPSSGPHKSRECLPLVIILRNRLKYALTYREVISILMQRQVMVDGKVRTDKTYPAGFMDVVTIPKTNESFRLLYDTKGRFRLHSLRDEEAKLKLCKVRSVQFGQKGIPYLNTYDGRTIRYPDPLIKANDTIKLDLDSNKIVDFIKFDVGNVVMVTGGRNRGRVGILKNREKHKGSFETVHIQDSLGHEFATRLGNVFTLGKGSKPWVSLPKGKGIKLSIIEEARKRMATQSATTA

SEQ ID NO: 8348 - protein, 263 aa, Euphorbia esula
MARGLKKHLKRLNAPKHWMLGKLGGAFAPKPSSGPHKSRECLPLILILRDRLKYALTYREVVSILMQRHILVDGKVRTDKTYPSGFMDVLSIPKTNENFRLLYDTKGRFRLHAIRDDEAKFKLCKVRSIQFGQKGIPYLNTYDGRTIRYPDPLIKANDTIKLDLETNKITEFIKFDVGNVVMVTGGRNRGRVGVLKNREKHKGSFETVHIQDATGHEFATRLANVFTIGKGTKPWVSLPKGKGIKLTIIEEARKKQAALQAAT

SEQ ID NO: 8349 - protein, 263 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQDATA

SEQ ID NO: 8350 - protein, 263 aa, Triphysaria pusilla
MARGLKKHLKRLNAPKNWNLDKLGGAFAPKPSSGPHKSRECLPLILILRNRLKYALTYREVIAILMQRHIQVDGKVRTDKTYPSGFMDVVSIPKTNENFRLLYDTKGRFRLHSVRDEEAKFKLCKVRSVQFGKKGIPYINTYDGRTIRYPDPLIKANDTIKFDLESSKIVDFIKFDVGNVVMVTGGRNRGRVGVIKNREKQKGSFETIHVQDASGHEFATRLSNVFTIGKGTKPWVSLPKGKGIKLTIIEEAKKRLAAQTAAA

SEQ ID NO: 8351 - protein, 263 aa, Helianthus annuus
MARGLKKHLKRLNAPKHWNLDKLGGAFAPKPSSGPHKSRECLPLILILRNRLKYALAYREVISILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGCVGILKNREKHKGSFETVHIQDATGHEFATRLGNVFTIGKGSKPWVSLPKGKGIKLTIIEEARKRQAALTASA

SEQ ID NO: 8352 - protein, 75 aa, Gossypium hirsutum
FFQARGLKKYLKRLSAPRHWMLDKLGGAKAIVWTPQVEGMFATYSHSAKQTEVCFDIQRSDCYSYAKACYGRWEG

SEQ ID NO: 8353 - protein, 195 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQLGQKGIPFLNTYDGRTIRYPDPLIKPNDTIKLDLEENKGRGLHQVRRRQRCDGDWREKQRACGCD

SEQ ID NO: 8354 - protein, 186 aa, Centaurea maculosa
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGG

SEQ ID NO: 8355 - protein, 231 aa, Cynara scolymus
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEESKFKLCKVRSVQFGQKGIPYINTYDGRTIRYPDPLIKANDTIKLDLDTNKIVDFIKFDVGNVVMVTGGRNTGRVGILKNREKHKGSFETVHIQDATGHEFATRLGNVFTLGKG

SEQ ID NO: 8356 - protein, 180 aa, Flaveria ramosissima
MQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDSNKIVDFIKFDVGNVVMVTGGRNRGRVGILKNREKHKGSFETVHIQDALGHEFATRLGNVFTIGKGSKPWVLYPRVRVSS

SEQ ID NO: 8357 - protein, 262 aa, Centaurea maculosa
ARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8358 - protein, 264 aa, Cichorium intybus
MARGLKKHMKRLNAPKHWILDKLGGAFAPKPSSGPHKSRECLPSILILRNRLKYALTYREVQSILMQRHVLVDNKVRTDKTYPAGFMDAVSIPKTNENFRLLYDTKGRFRLHSIRDEESKFKLCKVRSVQLGQKGIPYINTYDGRTIRYPDPLIKANDTIKLDLDSNKIVDFIKFDVGNVVMATGGRNTGRVGILKNREKHKGSFETVHIQDATGHEFATRLGNVFTLGKGTKPWVSLPKGKGIKLTIIEEARKRQAAQAAQVA

SEQ ID NO: 8359 - protein, 263 aa, Flaveria ramosissima
MARGLKKHMKRLNAPKHWMLDKLGGAFAPKPSSGPHKSRECLPLLLILRNRLKYALTYREVQSILMQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDTYKIVDFIKFDVGNVVMVTGGRNTGRVGILKNREKHKGSFETVHIQDATGHEFATRLSNVFTIGKGSKPWVSLPKGKGIKLSIIEEARKRRAAQDPVA

SEQ ID NO: 8360 - protein, 262 aa, Raphanus sativus
MARGLKKHLKRLNAPHHWGLDKLGGAFAPKPSSGPHKSRECLPLVLIIRNRLKYALTYREVISILMQRHIQVDGKVRTDKTYPAGFMDVVSIPKTNESFRLLYDTKGRFRLHSIRDEEAKFKLCKVRAILLGRKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8361 - protein, 262 aa, Raphanus sativus
MARGLKKHLKRLNAPIHWDLDKLGGAFAPKPSSGPHKSRECLPLVLIIRNRLKYALTYREVISILMQRHIQVDGKVRTDKTYPAGFMDVVSIPKTNESFRLLYDTKGRFRLHCIRDEEAKFKLCKVRAILLGRKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8362 - protein, 263 aa, Silene vulgaris
MARGLKKHLKRLNAPKHWMLDKLGGAFAPKPSSGPHKSRECLPLILILRNRLKYALNYREVVSILMQRQILVDGKVRTDKTYPAGFMDVVSIPKTNESFRLLYDTKGRFRLHSVRDEESKYKLCKVRSVQFGQKGIPYLNTYDGRTIRYPDPLIKANDTIKLDLESQKIVEFVRFDVGNVVMVTGGRNRGRVGVIKNREKHKGSFETIHIEDSAGHEFATRQGNVFVVGKGTKPWVSLPKGKGIKLTIIEEARKRMQKDAVAA

SEQ ID NO: 8363 - protein, 263 aa, Silene vulgaris
MARGLKKHLKRLNAPKHWMLDKLGGAFAPKPSSGPHKSRECLPLILILRNRLKYALNYREVVSILMQRQILVDGKVRTDKTYPAGFMDVVSIPKTNESFRLLYDTKGRFRLHSVRDEESKYKLCKVRSVQFGQKGIPYLNTYDGRTIRYPDPLIKANDTIKLDLESQKIVEFVRFDVGNVVMVTGGRNRGRVGVIKNREKHKGSFETIHIEDSAGHEFATRQGNVFVVGKGTKPWVSLPKGKGIKLTIIEEARKRMQKDAVTA

SEQ ID NO: 8364 - protein, 263 aa, Tragopogon dubius
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHLQDAAGNEFATRLGNVFTLGKGTKPWVSLPKGKGIKLTIIEEARKRQAALAATA

SEQ ID NO: 8365 - protein, 263 aa, Beta vulgaris
MARGLKKHMKRLNAPKHWMLDKLGGAFAPKPSSGPHKSRECLPLILILRNRLKYALTYREVIAILMQRHILVDNKVRTDKTYPAGFMDVVSIPKTNENFRLLYDTKGRFRLHSVRDEEAKYKLCKVRSIQFGQKGIPYLNTYDGRTIRYPDPLIKANDTIKLDLESNKIVDFIKFDVGNVVMVTGGRNRGRVGILKNREKHKGSFETIHIEDAAGHEFATRQGNVFIIGKGTKPWVSVPKGKGIKLTIIEEARKRQQKEATTA

SEQ ID NO: 8366 - protein, 263 aa, Centaurea maculosa
MARGLKKHQKRLNAPKNWNLDKLGGAFAPKPSSGPHKSRECLPLILILRNRLKYALTYREVISILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLSNVFTIGKGSKPWVSLPKGKGIKLTIIEEARKRQAALTASA

SEQ ID NO: 8367 - protein, 258 aa, Brassica napus
LKKHLKRLNAPKHWMLDKLGGAFAPKPSSGPHKSRECLPLVLIIRNRLKYALTYREVISILMQRHIQVDGKVRTDKTYPAGFMDVISIPKTNENFRLHYDTKGRFRLHSIRDEEAKFKLCKVRTIQVGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKPTIIEEAKKRLAGQQAA

SEQ ID NO: 8368 - protein, 263 aa, Unknown
  Sequence found in Organisms: Centaurea maculosa, Cirsium arvense
MARGLKKHQKRLNAPRHWNLDKLGGAFAPKPSSGPHKSRECLPLILILRNRLKYALTYREVISILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLSNVFTIGKGSKPWVSLPKGKGIKLTIIEEARKRQAALTASA

SEQ ID NO: 8369 - protein, 263 aa, Flaveria ramosissima
MARGLKKHMKRLNAPKHWMLDKLGGAFAPKPSSGPHKSRECLPLLLILRNRLKYALTYREVQSILMQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDSYKIVDFIKFDVGNVVMVTGGRNTGRVGILKNREKHKGSFETVHIQDATGHEFATRLSNVFTIGKGSKPWVSLPKGKGIKLSIIEEARKRRAAQEPVA

SEQ ID NO: 8370 - protein, 258 aa, Helianthus annuus
MARGLKKHLKRLNAPKHWNLDKLGGAFAPKPSSGPHKSRECLPLILILRNRLKYALAYREVISILMQRHVLVDNKVRTDKTYPAGFMDVVSIPKTNENFRLVYDTKGRFRLHSIRDEESKFKLCKVRSVQFGSKGIPYINTYDGRTIRYPDPLIKANDTIKLDLDSNKIVDFIKFDVGNVVMVTGGRNTGCVGILKNREKHKGSFETVHIQDATGHEFATRLGNVFTIGKGSKPWVSLPKGKGIKLTIIEEARKRQAA

SEQ ID NO: 8371 - protein, 256 aa, Papaver somniferum
MLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNRESIREVSIPFTSRTLQAMNLPPVWPMCSPLVRVPSHGFTPKGKGIKLSIIEEAEETCCSRSCNRIKLMEGVSHHEV

SEQ ID NO: 8372 - protein, 244 aa, Brassica juncea
MLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPFIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 8373 - protein, 258 aa, Tragopogon dubius
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKSRENIREVSRRFISKMLQVTIMLRGWGTCLLLERGRSRGCLCPRGRGLSLLLLRRLGKGRLP

SEQ ID NO: 8374 - protein, 265 aa, Primula obconica
MARGLKKHLKRLNAPSHWMLDKLGGAFAPKPSSGPHKSRECLPLILILRNRLKYALTYREVQSIVMQRHIQVDGKVRTDKTYPTGFMDVVSIPKTNENFRLLYDTKGRFRLHSLRDEEAKFKLCKVRSLRYGSKAIPYVNTFDGRTIRYPDPLIKANDTIKLDLETMKIVDFIKFDVGNVVMVTGGRNRGRVGVIKSREKHKGSFETIHVQDSKGHEFATRMGNVFTIGKGSKPWVSLPKGKGIKLTIIEEARKRQNPEAPQVAA

SEQ ID NO: 8375 - protein, 263 aa, Flaveria ramosissima
MARGLKKHMKRLNAPKHWMLDKLGGAFAPKPSSGPHKSRECLPLLLILRNRLKYALTYREVQSILMQRHVLVDNKVRTDKTYPAGFMDVVSIPKTNENFRLLYDTKGRFRLHSIRDEESKFKLCKVRSVQFGSKGIPYINTYDGRTIRYPDPLIKANDTIKLDLDSYKIVDFIKFDVGNVVMVTGGRNTGRVGILKNREKHKGSFETVHIQDATGHEFATRLSNVFTIGKGSKPWVSLPKGKGIKLSIIEEARKRRAGQDPVA

SEQ ID NO: 8376 - protein, 262 aa, Raphanus sativus
MARGFKKHLKRLNAPHHWGLDKLGGAFAPKPSSGPHKSRECLPLVLIIRNRLKYALTYREVISILMQRHIQVDGKVRTDKTYPAGFMDVVSIPKTNDSFRLLYDTKGRFRLHCIRDEEAKFKLCKVRAILLGRKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8377 - protein, 263 aa, Triphysaria pusilla
MARGLKKHLKRLNAPKIWDLDKLGGAFAPKPSSGPHKSRECLPLSLILRNRLKYALTYREVIAILMQRHVQVDGKVRTDKTYPSGFMDVVSIPKTNENFRMLYDTKGRFRLHSVRDEEAKFKLCKIRSVQFGKKGIPFINTYDGRTIRYPDPLIKANDTIKLDLESGKIIDFIKFDVGNVVMVTGGRNRGRVGVIKNREKQKGSFETIHVQDASGHEFATRLGNVFTIGKGTKPWVSLPKGKGIKLTIIEEAKKRLAAQTTAA

SEQ ID NO: 8378 - protein, 245 aa, Taraxacum officinale
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDSTGHEFATRLGNVFTVGKGSKPWVSLPRGRVLS

SEQ ID NO: 8379 - protein, 267 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQELLLRCVW

SEQ ID NO: 8380 - protein, 224 aa, Lippia dulcis
MARGLKKHLKRLNAPSHWMLDKLGGAFAPKPSSGPHKSRECLPLILILRNRLKYALTYREVIAILMQRHIQVDGKVRTDKTYPAGFMDVVSIPKTNENFRLLYDTKGRFRLHSIRDEEAKFKMCKVRSVQFGKKGIPYINTFDGRTIRYPDPLIKANDYLSSWYLESNKIVDFIKYDVGNVVMVTGGRNRGRVGVIKNREKHKGSFETLHIQDCHRPRVCNQIR

SEQ ID NO: 8381 - protein, 245 aa, Centaurea maculosa
MLDKLGGAFAPKPSSGPHKSRECLPLILILRNRLKYALTYREVISILMQRHVLVNNKVRTDKTYPAGFMDVVSIPKTNENFCLLYDTKGRFRLHSIRDEEAKFKLCKVRSVQFGSKGIPYFNTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8382 - protein, 259 aa, Brassica napus
MTRGLKKHLKRLNAPKIWGLDKLGGAFAPKPSSGPHKSRECLPLVLIIRNKLKYALTYREVISILMQRHIQVDGKVRTDKTYPAGFMDVVSIPKTNENFRLLYDTKGRFRLHSIKDEEAKFKLCKVRTISFGQKGIPYLNTYDGRTIRYPDPLIKPNDTIKLDLEENKVVEFIKFDVGNVVMVTGGRNRGRVGVIKNREKHKGSFETIHIQDATGHEFATRLGNVFTLGKGTKPWVSLPKGKGIKLTIIEEARKRLAAQ

SEQ ID NO: 8383 - protein, 261 aa, Brassica napus
ARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQLGQKGIPFLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGFKLTIIEEARKRVSVEDGA

SEQ ID NO: 8384 - protein, 263 aa, Tragopogon dubius
MARGLKKHMKRLNAPRHWGLDKLGGAFAPKPSSGPHKSRECLPLILILRNRLKYALTYREVQSILMQRHVCVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHLQDATGNEFATRLGNVFTLGKGTKPWVSLPKGKGIKLTIIEEARKRRAAQETAA

SEQ ID NO: 8385 - protein, 82 aa, Lippia dulcis
MVTGGRNRGRVGILKNREKHKGSFETVHIQDATGHEFATRLGNVYTIGKGTKPWVSLPKGKGIKLPIIEEAKKRISAQAVTA

SEQ ID NO: 8386 - protein, 263 aa, Cedrus atlantica
MARGLKKHLKRLNAPKHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLIKANDTIKIDLETGKIKEFIKFDVGNVVMVTGGRNRGRVGVIKHREKHKGSFEIIHVQDAAGQEFATRQGNVFTIGKGTKPWVSLPKGKGVKLSIIEEARKRHAAATAAA

SEQ ID NO: 8387 - protein, 251 aa, Centaurea maculosa
MARGLKKHLKRLNAPKHWNLDKLGGAFAPKPSSGPHKSRECLPLILILRNRLKYALTYREVISILMQRHVLVDNKVRTDKTYPAGFMDVVSIPKTNENFRLVYDTKGRFRLHSIRDEESKFKLCKVRSVQFDSKGIPYINTYDGRTIRYPDPLIKANDTIKLDLDSNKIVDFIKFDVGNVVMVTGGRNTGRVGILKNREKHKGSFETVHIQDATGHEFATRLGNVFTIGKGSKPWVSLPKGKGIKLTIIEE

SEQ ID NO: 8388 - protein, 263 aa, Distylium racemosum
MARGLKKHLKRLNAPKHWMLDKLGGAFAPKPSPGPHKGRECLPLVVLLRNRLKYALTYREVIAIVMQRLISVDGKVRTDKCYPAGFMDVISIAKTNENFRLLYDAKGRFRLHAIKDEEAKYKLCKVRGVQFGDKGIPYLNTYDGRTIRYPDPLIKANDTIKIDLETGKIQDFIKFDVGNVVMVTGGRNRGRVGVIKNREKHKGSFEIIHVQDAAGQEFATRQGNVFTIGKGTKPWVSLPKGKGVKLSIIEEARKRHAAGTAAA

SEQ ID NO: 8389 - protein, 262 aa, Raphanus sativus
MAKGLKKHLKRLNAPDHWGLDKLGGAFAPKPSSGPHKSRECLPLVLIIRNKLKYALTYREVISILMQRHIQVDGKVKTDKTYPAGFMDVVSIPKTNESFRLLYDTKGRFRLHSIRDEEAKFKLCKVRTIQLGTKGIPLLNTYDGRTIRYPDPLIKPNDTIKLDLEENKIVEFIKFDVGNVVMVTGGRNRGRVGVIKNREKHKGSFETIHIQDATGHEFATRLGNVFTLGKGTKPWVSLPKGKGIKLTIIEEARKRLSAQQAA

SEQ ID NO: 8390 - protein, 263 aa, Senecio madagascariensis
MARGLKKHLKRLNAPRNWMLGKLDGAFAPKPSSGPHKARECLPLILILRNRLKYALTYREVQSILMQRHVLVDNKVRTDKTYPAGFMDVVSIPKTNESFRLLYDTKGRFRLHSIRDEESKFKLIKVRSVQFGSKGIPYINTYDGRTIRYPDPLIKANDTIKFDLESQKIVDFIKFDVGNVVMVTGGRNTGRVGILKNREKHKGSFETVHIQDSTGHEFATRLGNVFTLGKGSKPWVSLPKGKGIKLTIIEEARKRRAAQEATA

SEQ ID NO: 8391 - protein, 247 aa, Primula obconica
MLDKLGGAFAPKPSSGPHKSRECLPLILILRNRLKYALTYREVQSIVMQRHIQVDGKVRTDKTYPTGFMDVVSIPKTNENFRLLYDTKGRFRLHSLRDEEAKFKLCKVRSLRYGSKGIPYVNTFDGRTIRYPDPLIKANDTIKLDLDTMKIVDFIKFDVGNVVMVTGGRNRGRVGVIKSREKHKGSFETIHVQDSKGHEFATRMGNVFTIGKGSKPWVSLPKGKGIKLTIIEEARKRQNPEAPQVAA

SEQ ID NO: 8392 - protein, 197 aa, Linum usitatissimum
MQRHVMVDNKVRTDKTFPAGFMDVVSIPKTNENFRLLYDTKGRFRLHSIRDEEAKFKLCKVRNIQFGSKGIPYLNTYDGRTIRYPDPLIKANDTIKLDLDSTKIVDFIKFDVGNVVMVTGGRNRGRVGILKNREKHKGSIETVHIQDSTGHEFATLLSNVFTIGKGSKPWVSLPKGKGIKLTIIEEAKKRIAAQAAA

SEQ ID NO: 8393 - protein, 196 aa, Solanum lycopersicum
MARGLKKHLKRLNAPKHWMLDKLGGAFAPKPSSGPHKSKECLPLVIILRNRLKYALTYREVISILMQRQVMVDGKVRTDKTYPAGFMDVVTIPKTNECFRLLYDTKGQFRLHSLRDEKAKFKLCKVRLVQFGQKGIPYLNTYEGRTIRYPNPLIKANDTIKLDLDSNKIVDFIKFDVGNVVMVTGGRNRGRWNSEE

SEQ ID NO: 8394 - protein, 259 aa, Brassica napus
MARGLKKHLKRLNAPTIWGLDKLGGAFAPKPSSGPHKSRECLPLVLIIRNKLKYALTYREVIAILMQRHIQVDGKVRTDKTYPAGFMDVVSIPKTNECFRLLYDTKGRFRLHSIKDEEAKFKLCKVRTISFGQKGIPYLNTYDGRTIRYPDPLIKPNDTIKLDLEENKVVEFIKFDVGNVVMVTGGRNRGRVGVIKNREKHKGSFETIHIQDATGHEFATRLGNVFTLGKGTKPWVSLPKGKGIKLTIIEEARKRLAAQ

SEQ ID NO: 8395 - protein, 263 aa, Distylium racemosum
MARGLKKHLKRLNAPKHWMLDKLGGAFAPKPSAGPHKGRECLPLVVLLRNRLKYALTYREVIAIVMQRLISVDGKVRTDKCYPAGFMDVISIAKTNENFRLLYDAKGRFRLHAIKDEEAKYKLCKVRGVQFGDKGIPYLNTYDGRTIRYPDPLIKANDTVKIDLETGKIKDFIKFDVGNVVMVTGGRNRGRVGVIKNREKHKGSFEIIHVQDAAGQEFATRQGNVFTIGKGTKPWVSLPKGKGVKLSIIEEARKRHAAVTAAA

SEQ ID NO: 8396 - protein, 263 aa, Medicago truncatula
MARGLKKHLKRLNAPKHWMLDKLGGAFAPKPSAGPHKGRECLPLVVLLRNRLKYALTYREVIAIVMQRLIAVDGKVRTDKCYPAGFMDVVSIAKTNENFRLLYDAKGRFRLHSIKDEEAKYKLCKVRGVQFGDKGIPYLNTYDGRTIRYPDPLIKANDTIKIDLETGKIKDFIKFDVGNVVMVTGGRNRGRVGVIKNREKHKGSFEIIHVQDSAGQEFATRQGNVFTIGKGTKPWVSLPKGKGVKLSIIEEAKKRHAAPTAAA

SEQ ID NO: 8397 - protein, 263 aa, Pseudotsuga menziesii
MARGLKKHLKRLNAPKHWMLDKLGGAFAPKPSAGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKIDLETGKIKEFIKFDVGNVVMVTGGRNRGRVGVIKHREKHKGSFEIIHVQDAAGQEFATRQGNVFTIGKGTKPWVSLPKGKGVKLSIIEEARKRHAAATAAA

SEQ ID NO: 8398 - protein, 263 aa, Pseudotsuga menziesii
MARGLKKHLKRLNAPKHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKIDLETGKIKEFIKFDVGNVVMVTGGRNRGRVGVIKHREKHKGSFEIIHVQDAAGQEFATRQGNVFTIGKGTKPWVSLPKGKGVKLSIIEEARKRHAAATAAA

SEQ ID NO: 8399 - protein, 259 aa, Brassica rapa
MARGLKKHLKRLNAPTIWGLDKLGGAFAPKPSSGPHKSRECLPLVLIIRNKLKYALTYREVIAILMQRHIQVDGKVRTDKTYPAGFMDVVSIPKTNECFRLLYDTKGRFRLHSIKDEEAKFKLCKVRTISFGQKGIPYLNTYDGRPIRYPDPLIKPNDTIKLDLEENKVVEFIKFDVGNVVMVTGGRNRGRVGVIKNREKHKGSFETIHIQDATGHEFATRLGNVFTLGKGTKPWVSLPKGKGIKLTIIEEARKRLAAQ

SEQ ID NO: 8400 - protein, 263 aa, Unknown
  Sequence found in Organisms: Abies balsamea, Picea glauca
MARGLKKHLKRLNAPRHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKIDLETGKIKEFIKFDVGNVVMVTGGRNRGRVGVIKHREKHKGSFEIIHVQDAAGQEFATRQGNVFTIGKGTKPWVSLPKGKGVKLSIIEEARKRHAAATAAA

SEQ ID NO: 8401 - protein, 263 aa, Cephalotaxus harringtonia
MARGLKKHLKRLNAPKHWMLDKLGGAFAPKPSAGPHKGRECLPLVVLLRNRLKYALTYREVIAIVMQRLIAVDGKVRTDKCYPAGFMDVVSIAKTNENFRLLYDAKGRFRLHSIKDEEAKYKLCKVRGVQFGDKAIPYLNTYDGRTIRYPDPLIKANDTIKIDLETGKIKDFIKFDVGNVVMVTGGRNRGRVGVIKNREKHKGSFEIIHIQDSAGQEFATRQGNVFTIGKGTKPWVSLPKGKGVKLSIIEEARKRHAAGTAAA

SEQ ID NO: 8402 - protein, 262 aa, Gnetum gnemon
MARGLKKHLKRLNAPRHWMLDKLGGAFAPKPSAGPHKGRECLPLVVLLRNRLKYALTYREVIAIVMQRLIAVDGKVRTDKCYPAGFMDVVSIAKTNENFRLLYDAKGRFRLHSIKDDEAKYKLCKVRSVQFGEKGIPFLNTYDGRTIRYPDPLIKANDTIKIDLETGKIIDHIKFDVGNVVMVTGGRNRGRVGVIKNREKHKGSFEIIHIQDAAGHEFATRQGNVFTIGKGTKPWVSLPKGKGIKLSIIEEARKRHAATAAA

SEQ ID NO: 8403 - protein, 263 aa, Sciadopitys verticillata
MARGLKKHLKRLNAPKHWMLDKLGGAFAPKPSAGPHKGRECLPLVVLLRNRLKYALTYREVIAIVMQRLISVDAKVRTDKCYPAGFMDVVSIAKTNENFRLLYDAKGRFRLHSIKDEEAKYKLCKVRGVQFGDKGIPYLNTYDGRTIRYPDPLIKANDTIKLDLETGKIKDFIKFDVGNVVMVTGGRNRGRVGVIKNREKHKGSFEIIHVQDSAGQEFATRQGNVFTIGKGTKPWVSLPKGKGVKLSIIEEARKRHAAGTAAA

SEQ ID NO: 8404 - protein, 263 aa, Sequoia sempervirens
MARGLKKHLKRLNAPKHWMLDKLGGAFAPKPSAGPHKGRECLPLVVLLRNRLKYALTYREVIAIVMQRLICVDGKVRTDKCYPAGFMDVVSIAKTNENFRLLYDAKGRFRLHSIKDEEAKYKLCKVRGVQFGDKGIPYLNTFDGRTIRYPDPLIKANDTIKIDLETGKIKDFIKFDVGNVVMVTGGRNRGRVGVIKNREKHKGSFEIIHVQDSAGQEFATRQGNVFTIGKGTKPWVSLPKGKGVKLSIIEEAKKRNAAPTAAA

SEQ ID NO: 8405 - protein, 263 aa, Sequoia sempervirens
MARGLKKHLKRLNAPKHWMLDKLGGAFAPKPSAGPHKGRECLPLVVLLRNRLKYALTYREVIAIVMQRLIEVDGKVRTDKCYPAGFMDVVSIAKTNENFRLLYDTKGRFRLHSIKDEEAKYKLCKVRGVHFGDKGIPYLNTYDGRTIRYPDPLIKANDTVKIDLETGKIKEFIKFDVGNVVMVTGGRNRGRVGVIKNREKHKGSFEIIHVQDSAGHEFATRQGNVFTIGKGTKPWVSLPKGKGVKLSIIEEAKKRNAAQTAAA

SEQ ID NO: 8406 - protein, 239 aa, Centaurea maculosa
MARGLKKHMKRLNAPTHWMLDKLGGAFAPKPSSGPHKSRECLPLILILRNRLKYALDYREVNAILMQRHVLVDGKVRTDKAYPAGFMDVVSIPKTNENFRLLYDTKGRFRLHSIRDEEAKFKLCKVRSVQFGHKGIPYLNTYDGHTIRYPDPLIKANYTIKYDLESNKIVDFIKFDVGNVVMVTGGRNRGRVGIIKNKEKHKGSFEIIHIQDATGQEFATRVGYVFNPRQGYQTMGEPS

SEQ ID NO: 8407 - protein, 162 aa, Eschscholzia californica
MARGLKKHLKRLNAPSHWMLDKLGGAFAPKPSSGPHKSRECLPLILILRNRLKYALTYREVVAILMQRHILVDGKVRTDQRYPSGFMDVVSIPKTNENFRLLYDTKGRFRLHSIKDEEAKFKLCKVRNVQFGQKGIPYINTYDGRTIRYPDPLIKANDTDRT

SEQ ID NO: 8408 - protein, 196 aa, Phaseolus coccineus
  misc_feature (58)..(58): Xaa can be any naturally occurring amino acid
MCLLMAKSEQTRHILLVSWMLYLYLKQTRTSACSMTPKVVSVFTLSGMMRQSLSSARXKSVQFGQKGIPYLNTFDGRTIRYPDPVIRANDTIKLDLEENKIVDFIKFDVGNVVMVTGGRNRGRVGVIKSRERQKGSFDTIHVQDATGHEFATRLANVFTIGKGTKPLISLPKGKGIKLSIIEEARKRTVAQQATAA

SEQ ID NO: 8409 - protein, 248 aa, Zingiber officinale
  misc_feature (3)..(3): Xaa can be any naturally occurring amino acid
MLXKLGGAFAPKPSSGPHKSRECLPLILILRNKLKYALVYREAIAILMQRHIMVDGKVRTDKTYPAGFMDVVSIPKTNENFRLLYDTKGRFRLHSVRDEEAKFKLCKVRSVRFGHKGIPYLNTYDGRTIRYPDPLIKANDTIKFDLETNKIVDFIKFDVGNVVMVTGGRNTGRVGVLKNREKHKGSFETVHIQDATGHEFATRLGNVFTIGKGTKPWISLPKGKGIKLSIIEEARKRLAATAGTAATA

SEQ ID NO: 8410 - protein, 263 aa, Picea glauca
MARGLKKHLKRLNAPRHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKIDLETGKIKEFIKFDVGNVVMVTGGRNRGRVGVIKHREKHKGSFEIIHVQDAAGQEFATRQGNVFTIGKGTKPWVPLPKGKGVKLSIIEEARKRHAAATAAA

SEQ ID NO: 8411 - protein, 246 aa, Citrullus lanatus
MLDKLGGAFAPKPSSGPHKSRECLPLILILRNRLKYALTYREVIAILMQRHVLVDAKVRTDKTYPAGFMDVVSIPKTNENFRLLYDTKGRFRLHSIRDEEAKFKLCKVRSVQFGQKGIPYLNTYDGRTIRYPDPLIKANDTIKLDLDSNKIADFIKFDVGNVVMVTGGRNRGRVGVIKNREKHKGSFETIHIQDATGHEFATRLGNVFTIGKGTKPWVSLPKGKGIKLSIIEEARKRLASQAAVTA

SEQ ID NO: 8412 - protein, 255 aa, Ambrosia trifida
MKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQESAA

SEQ ID NO: 8413 - protein, 264 aa, Artemisia annua
MARGLKKHMKRINAPKHWMLDKIHGVFAPKPSSGPHKARECLPLVLILRNRLKYALTYREVQSILMQRHVLVDGKVRTDKTYPAGFMDVVTIPKTNESFRLLYDTKGRFRMHAIRDEESKFKLCKVRSVQFGSKGIPYINTYDGRTIRYPDPLIKANDTIKLDLETQKIVDFIKFDVGNVVMVTGGHNTGRVGILKNREKHKGSYETVHIQDASGNEFATRLGNVFTVGKGTKPWVSLPKGKGIKLTIIEEARKRQAALAAKVA

SEQ ID NO: 8414 - protein, 246 aa, Persea americana
MLDKLGGAFAPKPSSGPHKARECLPLILILRNKLKYALTYREVISILMQRHVLVDGKVRTDKTYPAGFMDVVSIPKTNENFRLLYDTKGRFRLHSIRDEEAKFKLCKVRSVQFGQKGIPYLNTYDGRTIRYPDPLIKANDTIKLDLETYKIVDFIKFDVGNVVMVTGGRNRGRVGVIKNREKHKGTFETIHVQDATGHEFATRLANVFTIGKGTKPWVSLPKGKGIKLTIIEEARKRLAAAAATTA

SEQ ID NO: 8415 - protein, 244 aa, Centaurea maculosa
MARGLKKHMKRLNAPKHWMLDKLGGAFAPKPSSGPHKSRECLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTVGKGTKPWVSLPKGKGI

SEQ ID NO: 8416 - protein, 263 aa, Cryptomeria japonica
MARGLKKHLKRLNAPKHWMLDKLGGAFAPKPSAGPHKGRECLPLVVLLRNRLKYALTYREVIAIVMQRLIAVDGKVRTDKCYPAGFMDVVSIAKTNENFRLLYDAKGRFRLHSIKEEEAKYKLCKVRGVQFGDKGIPYLNTYDGRTIRYPDPLIKANDTIKIDLETGKITEFIKFDVGNVVMVTGGRNRGRVGVIKNREKHKGSFEIIHVQDSAGHEFATRQGNVFTIGKGTKPWVSLPKGKGVKLSITEEAKKRNAAQTAAA

SEQ ID NO: 8417 - protein, 263 aa, Sciadopitys verticillata
MARGLKKHLKRLNAPRHWMLDKLGGAFAPKPSAGPHKGRECLPLVVLLRNRLKYALTYREVIAIVMQRLISVDAKVRTDKCYPAGFMDVVSIAKTNENFRLLYDAKGRFRLHSIKDEEAKYKLCKVRGVQFGDKGIPYLNTYDGRTIRYPDPLIKANDTIKLDLETGKIKDFIKFDVGNVVMVTGGRNRGRVGVIKNREKHKGSFEIIHVQDSAGQEFATRQGNVFTIGKGTKPWVSLPKGKGVKLSIIEEARKRHAAGTAAA

SEQ ID NO: 8418 - protein, 246 aa, Papaver somniferum
MLDKLGGAFAPKPSSGPHKSRECLPLILILRNRLKYALTYREVIAILMQRHILVDGKVRTDKTYPSGFMDVVSIPKTNENFRLLYDTKGRFRLHSIKDEEAKFKLCKVRNVHFGSKGIPYINTFDGRTIRYPDPLIKANDTIKLDLESNKIVDFIKFDIGNVVMVTGGRNRGRVGVIKNREKHKGSFDTLHIQDSTGHEFATRLANVFTIGKGTKPWVSLPKGKGIKLTIIEEARKRLAAQGAATA

SEQ ID NO: 8419 - protein, 150 aa, Papaver somniferum
LNAPKHWMLDKLGGAFAPKPSSGPHKSRECLPLILILRNRLKYALTYREVIAILMQRHILVDGKCEQTRPIHLDSWMLFRFPRRTRTSVSCMTPRVASVSTQSRMKKLSSSSARLEMYTLDLRVSHTLTPLMVAPFVTLTLLSRLMTPSS

SEQ ID NO: 8420 - protein, 246 aa, Citrullus lanatus
MLDKLGGAFAPKPSSGPHKSRECLPLILILRNRLKYALTYREVIAILMQRHVLVDGKVRTDKTFPAGFMDVVSIPKTNENFRLLYDTKGRFRLHSVRDEEAKYKLCKVRSVQFGQKGIPYLNTYDGRTIRYPDPLIKANDTIKLDLESNKIADFIKFDVGNVVMVTGGRNRGRVGVIKNREKHKGSFETIHIQDATGHEFATRLGNVFTIGKGTKPWVSLPKGKGIKLSIIEEARKRLASQAAVTA

SEQ ID NO: 8421 - protein, 263 aa, Unknown
  Sequence found in Organisms: Pinus pinaster, Pinus taeda
MARGLKKHLKRLNAPRHWMLDKLGGAFAPKPSPGPHKGRECLPLVVLLRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLIKANDTIKLDLETGKIMEFIKFDVGNVIMVTGGRNRGRVGVIKHREKHKGSFEIIHVQDAAGQEFATRQGNVFTIGKGTKPWVSLPKGKGVKLSIIEEARKRHAAGTAAA

SEQ ID NO: 8422 - protein, 243 aa, Platanus occidentalis
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIKDEEAKFKLCKVRSVQFGQKGIPYINTYDGRTIRYPDPLIKANDTIKLDLESNKIIDFIKFDVGNVVMVTGGRNRGRVGVIKNREKHKGSFETIHVQDATGHEFATRLGNVYTIGKGTKPWVSLPRARV

SEQ ID NO: 8423 - protein, 263 aa, Picea glauca
MARGLKKHLKRLNAPRHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKVDLETGKIKEFIKFDVGNVIMVTGGRNRGRVGVIKHREKHKGSFEIIHVQDAAGQEFATRQGNVFTIGKGTKPWVSLPKGKGVKLSIIEEARKRHAAATAAA

SEQ ID NO: 8424 - protein, 266 aa, Cajanus cajan
MARGLKKHLKRLNAPKHWMLDKLGGAFAPKPSSGPHKSRECLPLILILRNRLKYALTYREVIAILMQRHVLVDGKVRTDKTYPSGFMDVVSIPKTNENFRLLYDTKGRFRLHSVRDEEAKFKLCKVRSVQFGQKGIPYLNTYDGRTIRYPDPLIRANDTIKLDLEENKIVDFIKFDVGNVVMVTGGRNRGRVGVIKNRERHKGSFETIHVQDATGHEFTTRMGNVFTIGKGTKPWISLPKGKVLSYQSLRKLGKGLLPKSNCCLNF

SEQ ID NO: 8425 - protein, 290 aa, Picea glauca
MARGLKKHLKRLNAPRHWMLDKLGGAFAPKPSPGPHKGRECLPLVVLIRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKVDLETGKIKEFIKFDVGNVIMVTGGRNRGRVGVIKHREKHKGSFEIIHVQDAAGQEFATRQGNVFTIGKGTKPWVPYPRVRVSSCPSLKRPGNVMQLQLLQHKFCSSENLMVLIVIIFKFVSLVYCHCY

SEQ ID NO: 8426 - protein, 249 aa, Secale cereale
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGHQAVGEPPQGQGYQAHHH

SEQ ID NO: 8427 - protein, 246 aa, Cucumis sativus
MLDKLGGAFAPKPSSGPHKSRECLPLILILRNRLKYALTYREVIAILMQRHVLVDGKVRTDKTFPAGFMDVVSIPKTSENFRLLYDTKGRFRLHSVRDEEAKYKLCKVRSVQFGQKGIPYLNTYDGRTIRYPDPLIKANDTIKLDLESNKIADFIKFDVGNVVMVTGGRNRGRVGVIKNREKHKGSFETIHIQDATGHEFATRLGNVFTVGKGTKPWVSLPKGKGIKLSIIEEARKRLASQAAVTA

SEQ ID NO: 8428 - protein, 245 aa, Lactuca sativa
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDSTGHEFATRLGNVFTLGKGSKPWVSLPKGKGIK

SEQ ID NO: 8429 - protein, 263 aa, Pinus pinaster
MARGLKKHLKRLNAPRHWMLDKLGGAFAPKPSPGPHKGRECLPLVVLLRNRLKYALTYREVIAIVMQRLISVDGKVRTDKCYPAGFMDVLSIAKTNENFRLLYDAKGRFRLHSIKDEEAKYKLCKVRSVQFGDKGIPYLNTYDGRTIRYPDPLVKANDTIKIDLETGKIKEFIKFDVGNVVMVTGGRNRGRVGTIKHREKHKGSFEIIHVQDAAGQEFATRQGNVFTIGKGTKPWVSLPKGKGVKLSIIDEARKRNAAATAAA

SEQ ID NO: 8430 - protein, 241 aa, Orobanche aegyptiaca
MARGLKKHLKRLNAPKHWMLDKLGGAFAPKPSSGPHKSRECLPLILILRNRLKYALTYREVISILMQRHILVDGKVRTDKTYPAGFMDVVSIPKTNENFRLLYDTKGRFRLHSVRDEEAKFKLCKVRQVQFGNKGIPYVNTYDGRTIRYPDPLIKANDTIKLDLENNKIVDFIKFDVGNVVMVTGGRNRGRVGVLKNREKHKGSFETVHIQDSTGHEFATRLGNVFTIGKGTKPWVSLPKG

SEQ ID NO: 8431 - protein, 263 aa, Podocarpus macrophillus
MARGLKKHLKRLNAPKHWMLDKLGGAFAPKPSPGPHKGRECLPLVVLLRNRLKYALTYREVIAIVMQRLISVDGKVRTDKCYPAGFMDVVSISKTNENFRLLYDAKGRFRLHSIKDEEAKYKLCKVRGVQFGDKAIPYLNTYDGRTIRYPDPLIKANDTVKIDLETGKIKDFIKFDVGNVVMVTGGRNRGRVGVIKNREKHKGSFEIIHVQDAAGQEFATRQGNVFTIGKGTKPWISLPKGKGVKLSIIEEARKRHAAGTTAA

SEQ ID NO: 8432 - protein, 263 aa, Podocarpus macrophillus
MARGLKKHLKRLNAPKHWMLDKLGGAFAPKPSPGPHKGRECLPLVVLLRNRLKYALTYREVIAIVMQRLICVDGKVRTDKCYPAGFMDVVSIAKTNENFRLLYDAKGRFRLHSIKDEEAKYKLCKVRGVQFGDKAIPYLNTYDGRTIRYPDPLIKANDTVKIDLETGKIKDFIKFDVGNVVMVTGGRNRGRVGVIKNREKHKGSFEIIHVQDAAGQEFATRQGNVFTIGKGTKPWISLPKGKGVKLSIIEEARKRRTVGTAAA

SEQ ID NO: 8433 - protein, 263 aa, Taxus baccata
MARGLKKHLKRLNAPKHWMLDKLGGAFAPKPSAGPHKGRECLPLVVLLRNRLKYALTYREVIAIVMQRLIAVDGKVRTDKCYPAGFMDVVSIAKTNENFRLLYDAKGRFRLHTIKDEEAKYKLCKVRGVKFGDKGIPYLNTYDGRTIRYPDPLIKANDTIKIDIETGKIKEFIKFDVGNVVMVTGGRNRGRVGVIKNREKHKGSFEIIHVQDSAGQEFATRQGNVFTIGKGTKPWISLPKGKGVKLSIIEEARKRHAAGTPAA

SEQ ID NO: 8434 - protein, 263 aa, Zamia vazquezii
MARGLKKHLKRLNAPKHWMLDKLGGAFAPKPSPGPHKGRECLPLVVLLRNRLKYALTYREVIAIVMQRLICVDGKVRTDKCYPAGFMDVVSIAKTNENFRLLYDTKGRFRLHSIKEEEAKFKLCKVRSARFGDKGIPFINTYDGRTIRYPDPLIKANDTIKIDLETGKVKDFIKFDVGNVVMVTGGRNRGRVGVIKHREKHKGSFEIIHVQDAAGQEFATRQGNVFTIGKGTKPWVSLPKGKGVKLSIIEEAKKRHAAATAAA

SEQ ID NO: 8435 - protein, 268 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKVLSSPSSRKPGRGSLGNKLLKFSTFS

SEQ ID NO: 8436 - protein, 245 aa, Manihot esculenta
MLDKLSGAFAPKPSSGPHKSRECLPLILILRNRLKYALTYREVISILMQRHVLVDGKVRTDKTYPVGFMDVVSIPKTNENFRLLYDTKGRFRLHSIRDDEAKFKLCKVRSVQFGQKGIPYLNTYDGRTIRYPDPLIKANDTIKLDLESNKITEFIKFDVGNVVMVTGGRNRGRVGIIKNREKHKGSFETIHIQDATGHEFATRLGNVFTIGKGTKPWVSLPKGKGIKLSIIEESRKRLAAAQTVA

SEQ ID NO: 8437 - protein, 263 aa, Cycas rumphii
  misc_feature (263)..(263): Xaa can be any naturally occurring amino acid
MARGLKKHLKRLNAPKHWMLDKLGGAFAPKPSPGPHKGRECLPLVVLLRNRLKYALTYREVIAIVMQRLICVDGKVRTDKCYPAGFMDVVSIAKTNENFRLLYDTKGRFRLHSIKDEEAKFKLCKVRAAQFGDKGIPYINTYDGRTIRYPDPLIKANDTIKIDLETGKVKEFIKFDVGNVVMVTGGRNRGRVGVIKHREKHKGSFEIIHVQDAAGQEFATRQGNVFTIGKGTKPWVSLPKGKGVKLSIIEEARKRHAAGTPAX

SEQ ID NO: 8438 - protein, 261 aa, Gnetum gnemon
MARGLKKHLKRLNAPRHWMLDKLGGAFAPKPSPGPHKGRECLPLVVLLRNRLKYALTYREVIAIVMQRLIAVDGKIRTDKCYPAGFMDVVSIAKTNENFRLLYDAKGRFRLHSIKDEEAKFKLCKVRTVQFGDKGIPYLSTFDGRTIRYPDPLIKANDTIKIDLETGKIIDFIKFDVGNVVMVTGGRNRGRVGVIKNREKHKGSFEIIHIQDAAGHEFATRQGNVFTIGKGTRPWVALPKGRGIKLSIIEEARKRHAAEAA

SEQ ID NO: 8439 - protein, 240 aa, Glycyrrhiza uralensis
MARGLKKHLKRLNAPKHWMLDKLGGAFAPKPSSGPHKSRECLPLILILRNRLKYALTYREVIAILMQRHVLVDNKVRTDKTYPAGFMDVVSIPKTNENFRLLYDTKGRFRLHSVRDEEAKFKLCKVRSVQFGQKGIPYLNTYDGRTIRYPDPVIRANDTIKLDLEENKIVDFIKFDVGNVVMVTGGRNRGRVGVIKSREKHKGSFETIHVQDATGHEFATRLGNVFTIGKGTKPWISLPK

SEQ ID NO: 8440 - protein, 248 aa, Saccharum officinarum
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTNDGRTIRYPDPLIKANDTIKIDLETNKIVDFIKFDVGNVVMVTGGRNTGRVGVIKNREKHKGSFETIHVEDSLGPSLPPVWATVHHRKGQQAVGEPAQRQGYKAEHH

SEQ ID NO: 8441 - protein, 236 aa, Taraxacum officinale
MPPSIACSINSVVLLHPSRHQDHTNPAIYLPLILILRNRLKYALTYREVQSILMQRHVLVDNKVRTDKTYPAGFMDVVSIPKTNEYFRLLYDTKGRFRLHSVRDEESKFKLCKVRSVQFGQKGIPYINTYDGRTIRYPDPLIKANDTIKLDLDTNKIVDFIKFDVGNVVMVTGGRNTGRVGILKNREKHKGSFETVHIQDSTGHEFATRLGNVFTVGKGSKPWVSLPKGRGLSDYY

SEQ ID NO: 8442 - protein, 256 aa, Centaurea maculosa
  misc_feature (12)..(12): Xaa can be any naturally occurring amino acid
  misc_feature (18)..(18): Xaa can be any naturally occurring amino acid
  misc_feature (33)..(33): Xaa can be any naturally occurring amino acid
GIERLNAPKHWXLDKLGXAFAPKPSSGPHKSRXCLPLILILRNRLKYALTYREVISILMQRHVLVDNKVRTDKTYPAGFMDVVSIPKTNENFRLLYDTKGRFRLHSIRDEEAKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTVGKGTKPWVSLPKGKGIKLTIIEEARKRRAGQDPVA

SEQ ID NO: 8443 - protein, 243 aa, Parthenium argentatum
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLDSNKIVDFIKFDVGNVVMVTGGRNTGRVGILKNREKHKGSFETVHIQDATGHEFATRLGNVFTIGKGSKPWVSLPKGKG

SEQ ID NO: 8444 - protein, 265 aa, Ananas comosus
MARGLKKHLKRLNAPKHWMLDKLGGAFAPKPTQGPHKARECLPLVLILQNKLKYALSYNEVTSILMQRHVMIDGKVRTDKTYPAGFMDVVTIPKTSENFRLLYDTKGRFRLRSISDEEAKFKLCKVRSVQFGERGIPHLNTYDGRTIRYPDPLIKANDTIKLDLETYKITDFIKFEVGNVVMVTGGRNRGRVGVIKNREKHPGTFETVHIQDATRQEFATRLGNVFIIGKGTKPWVALPKDKGIKLSIIEEARRRRAASSGSATA

SEQ ID NO: 8445 - protein, 241 aa, Raphanus sativus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKG

SEQ ID NO: 8446 - protein, 259 aa, Triticum aestivum
MARGLKKHVKRLNAPKHWMVEKLGGAFAPKPSSGPHKARECLPLILMLRNRLKYALTYSEVVSIMMQRHIMVDGKVRTDKTYPAGFMDVVSIPKTGENFRLLYDTKGRFRLHSIKDEEAKFKLCKVRTVQCGQKGVPSLNTYDGRTIRYPDPAIKPNDTIKIDLETNKIVDFIKFEVGNFVMVTGGRNTGRIGVIKSRERHEGSFETIHVEDALGHQFATRLANVFSIGKDRKSWVSLPKGKGIKLTIIEEARKRIAAA

SEQ ID NO: 8447 - protein, 268 aa, Triticum aestivum
MARGLKKHVKRLNAPKHWMVEKLGGAFAPKPSSGPHKARECLPLILMLRNRLKYALTYREVVSIMMQRHIMVDGKVRTDKTYPAGFMDVVSIPKTGENFRLLYDTKGRFRLHSIKDEEAKFKLCKVRTVQCGQKGIPSLKTYDGRTIRYPDPAIKPNDTIKIDLENNKIVDFIKFEVGNFVMMTGGRNTGRIGVIKSREKHEGSFETIHVEDALGHQFTTRLANVFTIGKDRKAWVSLPKGKGIKLTIIEEARKRVTAAAVSEPSENK

SEQ ID NO: 8448 - protein, 231 aa, Musa acuminata
MARGLKKHLKRLNAPKHWMLDKLGGAFAPKPSSGPHKARECLPLILILRNKLKYALTYREVIAILMQRHVMVDGKVRTDKTYPAGFMDVVSIPKTNENFRLLYDTKGRFRLHSIRDEEAKFKLCKVRSVQFGQKGIPYLNTYDGRTIRYPDPLIKANDTIKLDLETNKIVDFIKFDVGNVVMVTGGRNTGRVGVIKNREKHKGSFETIHIQDATGHEFATRLGMSSPSVSD

SEQ ID NO: 8449 - protein, 140 aa, Gossypium hirsutum
MTRGLKKHLKRLNAPRHWMFGKLGGAFAPKPSCGPHKSRECLPLILILRNRLKYALTYREVIAILMQRHVMVDGKMLYRFQRRMRTSASFMTQKVVFAFMPSPVMRPSLSSAKFGLSNLVKRVSPTLIRTMDAPSATQIL

SEQ ID NO: 8450 - protein, 245 aa, Taraxacum officinale
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNENFRLLYDTKGRFRLHSVRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDSTGHEFATRLGNVFTVGKGSKPWVSLPKGRVLS

SEQ ID NO: 8451 - protein, 197 aa, Raphanus sativus
MQRHIQVDGKVRTDKTYPAGFMDVVSIPKTNENFRLLYDTKGRFRLHSIRDEEAKFKLCKVRTIQLGQKGIPYLNTYDGRTIRYPDPLIKPNDTIKLDLEENKVVEFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 8452 - protein, 127 aa, Cynodon dactylon
MPRRSGGRSAPRPAPRAAPVRNPPQPARQAPPPAPAQQNGGGSILGGIGSTIAQGMAFGTGSAMAHRAVDAVMGPRTIQHETVVSEAAASAPAAPSVNTDSCSIHSKAFQDCINFYGSRHQQVPVLP

SEQ ID NO: 8453 - protein, 139 aa, Sorghum bicolor
MPRRSSGRSAPRPAPRAAPVRNPPQPARQAPPPAPVRDGGGSILGGIGSTIAQGMAFGTGSAMAHRAVDAVMGPRTIQHETVVSEAAAAAPAAPAMNTDACGIHSKAFQDCLNNYGSDISKCQFYLDMLNECRRGGVSA

SEQ ID NO: 8454 - protein, 139 aa, Panicum virgatum
MPRRSSGRSASRPAPRAAPMRNPPQPARQAPPPAPAQSGGGSILGGIGSTIAQGMAFGTGSAMAHRAVDAVMGPRTIQHETVVSEAAAAAPAAPMMNADSCGNHSKAFQDCLNHYGSDISKCQFYLDMLNECRRGGATA

SEQ ID NO: 8455 - protein, 139 aa, Cenchrus ciliaris
MPRRSSAGRSSRPAPRAAPVRNPPQPARQAPPPAPAQSGGGSILGGIGSTIAQGMAFGTGSAVAHRAVDAVMGPRTIQHETVVSEAAATAPAPMMNAADSCGNHSKAFQDCLSHYGSDISKCQFYLDMLNECRRGGATA

SEQ ID NO: 8456 - protein, 139 aa, Saccharum officinarum
MPRRSSGRSAPRPAPRAAPVRNPPQPARQAPPPAPVRDGGGSILGGIGSTIAQGMAFGTGSAMAHRAVDAVMGPRTIQHETVVSEAAAAAPAAPAMNTDACGIHSKAFQDCLNNYGSEISKCQFYLDMLNECRRGGVSA

SEQ ID NO: 8457 - protein, 140 aa, Setaria italica
MPRRSSGRSASRPAPRAAPLRNPPQPARQAPPPAPAQSGGGSILGGIGSTIAQGMAFGTGSAMAHRAVDAVMGPRTIQHETVVSEAAAAAPAAPMMNGADSCGNHSKAFQDCLNHYGSDISKCQFYLDMLNECRRGGATA

SEQ ID NO: 8458 - protein, 139 aa, Panicum virgatum
MPRRSSGRSAPRPAPRAAPMRNPPQPARQAPPPAPAQSGGGSILGGIGSTIAQGMAFGTGSAMAHRAVDAVMGPRTIQHETVVSEAAAAAPASPMMNADACGNHSKAFQDCLNHYGSDISKCQFYLDMLNECRRGGATA

SEQ ID NO: 8459 - protein, 135 aa, Triticum aestivum
SSGRSAPRPAPRAAPVRNPPQPARQAPPPAPVRDGGGSILGGIGSTIAQGMAFGTGSAMAHRAVDAVMGPRTIQHETVVSEAAAAAPAAPAMNTDACGIHSKAFQDCLNNYGSDISKCQFYLDMLNECRRGGVSA

SEQ ID NO: 8460 - protein, 139 aa, Zea mays
MPRRSSGRSAPRPAPRAAPVRNPPQPARQAPPPAPVRDGGGSMFGGIGSTIAQGMAFGTGSAMAHRAVDAVLGPRTIQHETVASEAAAAAPAPPVMNADACSIHSKAFQDCLNNYGSEISKCQFYLDMLNECRRGGVSA

SEQ ID NO: 8461 - protein, 144 aa, Pennisetum glaucum
MPRRSSGRSSRPAPRPAPRAAPVRNPPQPAHQAPPPAPAQSGGGSILGGIGSTIAQGMAFGTGSAMAHRAVDAVLGPRTIQHETVVSEAAAAAPAPAPMMNGADSCGNHSKAFQDCLNHYGSDISKCQFYLDMLNECRRGGATA

SEQ ID NO: 8462 - protein, 143 aa, Triticum aestivum
MARRSGGGRSSRPAPRAAPVRNPPAPARQAPPPATTQSSGGGIMSGIGSTIAQGMAFGTGSAMAHRAVDAVMGPRTIQHETVVGEAAASMTPMDNAADDKCGNPSKAFQDCINHYGSDISKCQFYLDMLNECRRGGAGAGATL

SEQ ID NO: 8463 - protein, 145 aa, Avena sativa
MPRRSGGGGRSRPAPRAAPVRNPPQPARQAPPPAPAPQSSGGGIMSGIGSTIAQGMAFGTGSAVAHRAVDAVMGPRTIQHETVVSEAASSMTPMGNTAGSDSCDNSSKAFQDCINHYGSDISKCQFYLDMLNECRRGGAGAGSTL

SEQ ID NO: 8464 - protein, 149 aa, Avena sativa
MPRRSGGGGRSRPAPRPAPRAAPVRNPPQPARQAPPPAPAPQSSGGGIMSGIGSTIAQGMAFGTGSAVAHRAVDAVMGPRTIQHETVVSEAASSMTPMGNTAGSDSCDNSSKAFQDCINHYGSDISKCQFYLDMLNECRRGGAGAGSTL

SEQ ID NO: 8465 - protein, 145 aa, Secale cereale
MARRSGGGRSSRPAPRAAPVRSPPAPARQAPPPATTTQSSGGGIMSGIGSTIAQGMAFGTGSAMAHRAVDAVMGPRTIQHETVVGEAAASMTPMDNAAGDKCGNPSKAFQDCINHYGSDISKCQFYLDMLNECRRGGAGAGAATL

SEQ ID NO: 8466 - protein, 139 aa, Triticum aestivum
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSKAFQDCINHYGSDISKCQFYLDMLNECRRGGATL

SEQ ID NO: 8467 - protein, 149 aa, Avena sativa
MPRRSGGGGRSRPAPRAAPRAAPVRNPPQPARQAPPPAPAPQSSGGGIMSGIGSTIAQGMAFGTGSAVAHRAVDAVMGPRTIQHETVVSEAASSMTPMGNTAGSDSCDNSSKAFQDCINHYGSDISKCQFYLDMLNECRRGGAGVGSTL

SEQ ID NO: 8468 - protein, 149 aa, Avena sativa
MPRRSGGGGRSRPAPRPAPRAAPVRNPPQPARQAPPPAPAPQSSGGGIMSGIGSTIAQGMAFGTGSAVAHRAVDAVMGPRTIQHETVVSEAASSMTPMGNTAGSDSCDNSSKAFQDCINHYGSDISKCQFYLDMLNECRRGGAGVGSTL

SEQ ID NO: 8469 - protein, 143 aa, Hordeum vulgare
MARRSGGGRSSRPAPRAAPVRNPPAPARQAPPPATTQSSGGGIMSGIGSTIAQGMAFGTGSAMAHRAVDAVMGPRTIQHETVVSEAAASMTPMDNAADDKCGNPSKAFQDCINHYGSDISKCQFYLDMLNECRRGGAGAGSTL

SEQ ID NO: 8470 - protein, 143 aa, Triticum aestivum
MARRSGGGRSSRPAPRAAPVRNPPAPARQAPPPATTQNSGGGIMSGIGSTIAQGMAFGTGSAMAHRAVDAVMGPRTIQHETVVGEAAASMTPMDNAADDKCGNPSKAFQDCINHYGSDISKCQFYLDMLNECRRGGAGAGATL

SEQ ID NO: 8471 - protein, 142 aa, Brachypodium distachyon
MPRRSSGRSAPRPAPRAAPVRNPPQPVRQAPPPAPTQSGGGGILSGIGSTIAQGMAFGTGSAVAHRAVDAVMGPRTIQHENVVSEAVATPAPMGNTAGSGSCDNPSKAFQDCINHYGSDISKCQFYLDMLNECRRGGAGSTL

SEQ ID NO: 8472 - protein, 140 aa, Aristolochia fimbriata
MPRRSSGGRPARPAPRAAPVRNPPQPATHAPPPAPVQSGGGSLLGGIGSTIAQGMAFGTGSAVAHRAVDAVMGPRTIQHETVVSEAAAAAPANSTSMDSCGIHSKAFQDCVNANGTDISKCQFYLDMLHECRRSGAGLGA

SEQ ID NO: 8473 - protein, 139 aa, Triticum aestivum
MPRRSSGRSAPRPAPRAASLRNPPQPARQAPPPAPVRDGGGSMFGGIGSTIAQGMAFGTGSAMAHRAVDSVLGPRTIQHETLATEAPAAAPAAPAMNADACSFHSKAFQDCLNNYGSDISKCQFYLDMLNECRRGGVSA

SEQ ID NO: 8474 - protein, 444 aa, Brachypodium distachyon
MRMGKYEMGRTLGEGHFGKVRLARHADDGRAFAIKILDRQRILAMKIHEQIKREIATLKLLKHPNVVRLYEVSASKTKIYMVLEYVNGGELFDKIALKGKLSEKEGRRLFQQLMDAVSYCHEKGVYHRDLKPENVLVDAKGNIKVSDFGLSALPQHQRKDGLLHTTCGSPNYIAPEVLLNRGYDGSMSDIWSCGVILYVMLTGNLPFDDENMVVLYQKILKGSVHIPKWLSPSAQDILRKILDPNPITRFGMDGIRAHDWFNQSYTPAVPIDDDDDNYIGDDNPQITEQNDIQDNPAINQINAFQLIGMSSCLDLSGFFEKEDVSERKTRFASNHSPSYLFEKIESNVTNMGFQVQKNNGKLKVIQDRKGPSNPRGHELLLISAEVFEINESLYVVELKRSSGDCSLYRQLCATLSDDLGICKSQQPLKKDSIRQELYRYNSSF

SEQ ID NO: 8475 - protein, 444 aa, Hordeum vulgare
MRMGKYEMGRTLGEGHFGKVRLARHADTGRPFAIKILDRQRILAMKIDEQIKTEIATLKLLKHPNVVRLYEVAASKTKIYMVLEYVNGGELFEKIALKGKLPEKEGRKLFQQLMDAVSYCHERGVYHRDLKPENVLVDAKGNIKVSDFGLSALPQHQRKDGLLHTTCGSPNYIAPEVLLNKGYDGSMSDVWSCGVILYVMLTGNLPFDDENMVVLYQKILKGDYRIPKWLSPGAQDILRKLLDPNPITRLGMDGMRAHDWFNQCYTPAVPFDDDDDNYVGDDNSHMTKHNGIQDNPAINQMNAFQLIGMSSCLDLSGFFEKEDVSERKIRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKKDSMRQELYRYNSSF

SEQ ID NO: 8476 - protein, 444 aa, Triticum aestivum
MRMGKYEMGRTLGEGHFGKVRLARHADTGRAFAIKILDRQRILAMKIDEQIKTEIATLKLLKHPNVVRLYEVAASKTKIYMVLEYVNGGELFEKIALKGKLPEKEGRKLFQQLMDAVSYCHERGVYHRDLKPENVLVDAKGNIKVSDFGLSALPQHQRKDGLLHTTCGSPNYIAPEVLLNKGYDGSMSDVWSCGVILYVMLTGNLPFDDENMVVLYQKILKGDYRIPKWLSPGAQDILRKLLDPNPITRLGMDGLREHDWFNQSYTPAVPFDDDDDNYVGDDNSHMTKHNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 8477 - protein, 216 aa, Triticum aestivum
MAFAGAQDILRKLLDPNPITRLGMDGLREHDWFNQSYTPAVPFDDDDDNYVGDDNSHMTKHNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 8478 - protein, 444 aa, Setaria italica
MRMGKYEMGRTLGEGHFGKVRLARHAETGRAFAIKILDRQRILAMKIDEQIKREIATLKLLKHPNVVRLYEVSASKTKIYMVLEYVNGGELFDKIALKGKLTEKEGRKLFQQLIDAVGYCHEKGVYHRDLKPENVLVDAKGNIKVSDFGLSALPQNQRKDGLLHTTCGSPNYIAPEVLLNKGYDGSMADIWSCGVILYVMLTGNLPFDDQNVVVLYQKILKGNAHIPKWLSQGAQDILRKILDPNPITRIDVDGIRAHDWFKQGYTPAVPFTDDEDISMDEGSLNVTEHNGIQDNIAINQINAFQLIGMSSCLDLSGFFEKEDASERKIRFASNHSPAYLFEKIGSIVRKMGFQVHKSNGKLKVIQDCKGSANSRGKESLLISAEVFEINESLYVVELKKSSGDCSLYRKLCETLSEDLGICKSQQLLKQDSIKQEIGRYNSSF

SEQ ID NO: 8479 - protein, 444 aa, Sorghum bicolor
MRMGKYEMGRTLGEGHFGKVKLARHADTGRTFAIKILDRQRILAMKINEQIKREIATLKLLKHPNVVRLYEVSASKTKIYMVLEYVNGGELFDKIALKGKLTEKEARKLFQQLIDAVAYCHEKGVYHRDLKPENVLVDAKGNIKVSDFGLSALPQNQRKDGLLHTTCGSPNYIAPEVLLNKGYDGSMSDIWSCGAILYVMLTGNLPFDDQNVVVLYQKILKGNAHIPKWLSQGAQDILRKILDPNPITRIDVDGIRAHDWFKQGYAAAVPFNDDEDISIDEDSLHMTERNGIQDKIAINQINAFQLIGMSSCLDLSGFFEKEDASERKIRFASNYSPAYLFEKIESIVRKMGFQVHKSNGKLKVIQDCKGLAKSRGQELLLISAEVFEINESLYVVELKKSSGDCSLYRKLCETLSEDLGTRKSQQFLKQDSIRQEIGRYNSSF

SEQ ID NO: 8480 - protein, 442 aa, Panicum virgatum
  misc_feature (121)..(121): Xaa can be any naturally occurring amino acid
  misc_feature (124)..(124): Xaa can be any naturally occurring amino acid
  misc_feature (156)..(156): Xaa can be any naturally occurring amino acid
MGKYEMGRRLGEGHFGKVKLARHAETGRAFAIKILDRQRILAMKIDEQIKREIATLKLLKHPNVVRLYEVSASKTKIYMVLEYVNGGELFDKIALKGKLTEKEGRKLFQQLMDAIGYCHEXGVXHRDLKPENVLVDAKGNIKVSDFGLSALPQNQXKDGLLHTTCGSPNYIAPEVLLNKGYDGSMSDIWSCGVILYVMLTGNLPFDDQNMVVLYQKILKGNAHIPKWLSQGAQDILRKILDPNPITRIDLDGIRAHNWFKQGYAPAVPFNDDEDISMSEGSLNMTEHNGIQGNIAINQINAFQLIGMSSCLDLSGFFEKEDASERKIRFASNHSPAYLFEKIESIVRKMGLQVHKSNGKLKVIQDCKGPANSRGLESLLVSAEVFEINESLYVVELKKSSGDCSLYRKLCETLSEDLGICKSQQLLKQDSIKQEIVRYNSSF

SEQ ID NO: 8481 - protein, 445 aa, Zea mays
MRMGKYEMGRTLGEGHFGKVRLARHADTGRPFAIKILDRQRILAMKIHDQIKREIATLKLLKHPNVVRLYEVSASKTKIYMVLEYVNGGELFDKIALKGKLTEKEGRKLFQQLIDAVGYCHEKGVYHRDLKPENVLVDAKGNIKVSDFGLSALPQNQQKDGLLHTTCGSPNYIAPEVLLNKGYDGSISDVWSCGVILYVMLTGNLPFDDQNVVVLYQKILKGNAHIPKWLSQGAQDILRKILDPNPVTRIDVDGIRAHDWFKQGYAPAMPFSDDEEDISMDEDSLNITEHNDIQDKIAINQINAFQLIGMSSCLDLSGFFEKEDVSERKIRFASNYSPAYLFEKIESIVRKMGFQVHKSNGKLKVIQDCKGLANSRGQESLLISAEVFEINEYLYVVELKKSSGDCSLYRKLCETLSEDLGTCKSQQFLKQDSIRQDIGRYNSSF

SEQ ID NO: 8482 - protein, 438 aa, Pennisetum glaucum
EMGRTLGEGHFGKVKLARHAETGRAFAIKILDRQRILAMKIDEQIKREIATLKLLKHPHVVRLYEVSASKTKIYMVLEYVNGGELFDKIALKGKLTEKEARKLFQQLIDAVAYCHEKGVYHRDLKPENVLVDAKGNIKVSDFGLSALPQNQRKDGLLHTTCGSPNYIAPEVLINKGYDGSMADIWSCGVILYVMLTGNLPFDDQNVVVLYQKILKGNAHIPKWLSQGAQDILRKILDPNPITRIDVDGIRAHDWFKQGYTPAVPFTDDEDISMDGGGLNVTEHNGIEENIPINQINAFQLIGMSSCLDLSGFFEKEDASERKIRFASNHSPAYLFEKIESIVRKMGFQVHKSNGKLKVIQDCKGPANSKGKASLLVSAEVFEINESLYVVELKKSSGDCSLYRKLCETLSEDLGICKSQQLLKQDSIKQDIGRHNSSF

SEQ ID NO: 8483 - protein, 467 aa, Zea mays
MRRAWTPADERAATTTSEHRRRRRMGKYEMGRTLGEGHFGKVRLARDAGTGRSFAIKILDRQRILAMKIDEQIKREIATLKLLKHPNVVRLYEVSASKTKIYMVLEYVNGGELFDKIALKGKLTEKEGRKLFQQLIDAVGYCHEKGVCHRDLKPENVLVDAKGNIKVSDFGLSALPQNQRKDGLLHTTCGSPNYIAPEVLLNKGYDGSVSDVWSCGVILYVMLTGSLPFDDQNMVVLYQKILKGNAHIPKWLSQGAQDLLRKILDPNPITRVDVDGIRAHDWFKQGYAPSAPFNDDEEDINVDEEDSLNMTENGIQDKIAINQINAFQLIGMSSCLDLSGFFEKEDASERKIRFASNYPPAYLFEKIESIVRKMGFQVHKSNGKLKVIQDCKGLANLRGKESLLISAEVFEINESLYVVELKKSSGDCSLYRKLCETLSEDLGTCKSQQFLKQDSIRQEIGRHNSSF

SEQ ID NO: 8484 - protein, 415 aa, Leymus cinereus x Leymus triticoides
MRMGKYEMGRTLGEGHFGKVRLARHADTGRAFAIKILDRQRILAMKIDEQIKTEIATLKLLKHPNVVRLYEVSASKTKIYMVLEYVNGGELFEKIALKGKISEKEGRKLFQQLMDAVSYCHERGVYHRDLKPENVLVDAKGNIKVSDFGLSALPQHQRKDGLLHTTCGSPNYIAPEVLLNKGYDGSMSDVWSCGVILYVMLTGNLPFDDENMVVLYQKILKGDYRIPKWLSPGAQDILRKLLDPNPITRLGMDGIRAHDWFNQSYTPAVPFDDDDDNYVGDDNSHMTKHNGIQDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATL

SEQ ID NO: 8485 - protein, 261 aa, Triticum aestivum
MASTSCFLHQSTARLGASPRVAAAPRSAQLFVCKAQQKQQQDAAAVDQSDVSRRAALALFAGVAAVSAKVSPAAAAYGEAANVFGKPKTNTEYIAYNGDGFKLLIPSKWNPSKEREFPGQVLRYEDNFDANSNVSVIIQPTSKKTITEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 8486 - protein, 261 aa, Triticum aestivum
MASTSCFLHQSTARLGASPRVAAAPRSAQLFVCKAQQKQQQDAAAVDQSDVSRRAALALFAGVAAVSAKVSPAAAAYGEAANVFGKPKTNTEYIAYNGDGFKLLIPSKWNPSKEREFPGQVLRYEDNFDANSNVSVIIQPTSKKTITEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAPPSFSVA

SEQ ID NO: 8487 - protein, 329 aa, Sorghum bicolor
MDPCMHGNGALLSLCCSHVQSKEHIHKHALYVVHPLMKPNHQRNNNPGRCSTISLLCDAEGGGGLLDALPGALEPPLVAGLRLADVELAVGDGGRDELVLAALVAVRRPCQHGDAVVLLAVHHGRGALQHVGRGHRADLGVGAAAEGLLAEEEVDLGEELLGGAVLGDGLLGGGLDDDGDVAVGVEVVLVAEHLPRELPLLAGVPLGRDQQLEPVAVVRDVLRVRLGLAEHVGCGGGGADLGADGGDAGEERERGAARDVALIHGGGVLLLLLLGLADEQLGAAWRGRDARRRAEAGGGLVEEAGGGRHRYQAACFALLLPPASGLLEA

SEQ ID NO: 8488 - protein, 341 aa, Sorghum bicolor
MDPCMHGNGALLSLCCSHVQSKEHIHKHALYVVHPLMKPNHQRNNNPGRCSTISLLCDAEGGGGLLDALPGALEPPLVAGLRLADVELAVGDGGRDELVLAALVAVRRPCQHGDAVVLLAVHHGRGALQHVGRGHRADLGVGAAAEGLLAEEEVDLGEELLGGAVLGDGLLGGGLDDDGDVAVGVEVVLVAEHLPRELPLLAGVPLGRDQQLEPVAVVRDVLRVRLGLAEHVGCGGGGADLGADGGDAGEERERGAARDVALIHGGGVLLLLLLGLADEQLGAAWRGRDARRRAEAGGGLVEEAGGGRHRYQAACFALLLPPASGLLEARVWMTLASARVC

SEQ ID NO: 8489 - protein, 255 aa, Saccharum officinarum
MASTSCFLHQSTARLGASPRLAAPRSSQLFVCKAQKQDAADQSDVSRRAALALFAGVAAVGAKVSPAAAAYGEAANVFGKVKTNTDYIAYSGDGFKLLIPSKWNPSKEREFPGQVLRYEDNFDSNSNVSVIIQPTSKKTITEYGSPEEFLSQVDFLLGKQAFGGKTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 8490 - protein, 258 aa, Zea mays
MASTSCFLHQSTARVAAPSPRLAAPPRSAQLFVCKAQKQQAAAAESDVSRRAALALLAGVAAVGAKASPAAAAYGEAANVFGKTKKNTDFISYVGDGFKLLIPSKWNPSKEREFPGQVLRYEDNFDANSNVSVIIQPTSKKAITEYGSPEEFLSQVDYLLGKQAYGGKTDSEGGFETDAVATANVLESSTPVVDGKQYYSITVLTRTADGDEGGKHQLITATVSDGKLYICKAQAGDKRWFKGARKGVEKAAASFSVA

SEQ ID NO: 8491 - protein, 260 aa, Zea mays
MASTSCCLLHQSTARLGASPRLAAAPPRSAQLLVCKARKQEAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSEGGFETGAVATANVLESSTPVIDGKQYYAVSVLTRTADGDEGGKHQLIAATVSDGKLYICKAQAGDKRWFKGARKGVEKAASSFSVA

SEQ ID NO: 8492 - protein, 260 aa, Panicum virgatum
MASTTCFLHQSTARFGAAAASARPQAPRAQQLVCRAQKPQDAAAEGDAAVTRRAALTLLAGAAAVGAKVNPAAAAYGEAANVFGKPKTNTEFIAYSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 8493 - protein, 260 aa, Setaria italica
MASTSCFLLQSTARLGAAAASARPQVPRAQLVCKAQRQDAAAESGDAAAVTRRAALTLLAGVAAVGAKVSPAAAAYGEAANVFGKPKANTDFIAYSGDGFKLLIPSKWNPSKEREFPGQVLRYEDNFDANSNVSVMVQPTTKKTITEFGSPEQFLAQVDYLLGKQAYSGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 8494 - protein, 257 aa, Pennisetum glaucum
MASTSCFLIQSTARLGAAAASARPQVPRAQLVCKAQRQDAAEGGDAVTRRAALTLLAGVAAVGAKVSPAAAAYGEAANVFGKQKPSTEYIAYSGDGFKLLIPSKWNPSKEREFPGQVLRYEDNFDANSNVSVIVQPTTKKTITEFGSPEEFLAQVDYLLGKQAYSGKTASEGGFENDAVATANILESSAPVVDGKQYYSVSVLTRTADGDEGGKHQLITATVSDGKLYICKAQAGDKRWFKGARKGVEKAASSFSVA

SEQ ID NO: 8495 - protein, 102 aa, Zea mays
MASTSCCLLHQSTARLGASPRLAAAPPRSAQLLVCKARKQEAAADQSDVSRRAALALLAGVTAAAGAKVGPAAAAYGEAGKCSASPRRARSTSRTAATASSC

SEQ ID NO: 8496 - protein, 258 aa, Panicum virgatum
MASTTCFLHQSSARFGAAASARPQQAPRAQQLACRAQKLDAAEGDAAVTRRAALTLLAGAAAVGAKVNPAAAAYGEAANVFGKPKTNTDFMAYSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 8497 - protein, 254 aa, Oryza sativa
MASTSCFLHQSTARVAARVASPSPATRTHLLVCRAQKQDDADVSRRAALALLAGATAAVGVKVAPAAAAYGEAANVFGKPKTNTEFIAYSGEGFKLLIPSKWNPSKEREFPGQVLRYEDNFDANSNVSVIINPTTKKTITEFGSPEEFLAQVDFLLGKQAYSGKTDSEGGFESDAVATANILESSAPVVGGKQYYSVTVLTRTADGDEGGKHQLITATVNDGKLYICKAQAGDKRWFKGARKFVESAASSFSVA

SEQ ID NO: 8498 - protein, 259 aa, Leymus cinereus x Leymus triticoides
MASTSCFLHQSTARLAASARPAPAVGRTQLFVCKAQKNDEAASDAAVVTSRRAALSLLAGAAAVAVKVSPAAAAYGEAANVFGKAKKNTDFVAYSGDGFKLMIPAKWNPSKEREFPGQVLRYEDNFDATSNLSVIINPTTKKTITEYGSPEEFLSQVGFLLGQQSYGGKTDSEGGFESDAVATANVLESSAPVVDGKQYYSITVLTRTADGDEGGKHQLITATVADGKLYVCKAQAGDKRWFKGAKKFVENAAGSFSVA

SEQ ID NO: 8499 - protein, 243 aa, Saccharum officinarum
MAPRVADKSPLPPATGLGLGVGGGVGGVGMGPHYRGVRKRPWGRYAAEIRDPAKKSRVWLGTYDTAEEAAKAYDAAAREFRGAKAKTNFPFASQCPVAAGGAGSPCSNSTVDSSGGGSGACGVQAPMQAILLPPALDLDLFHRAAAVNAVSAGGMRFPFKGYPVARPTSHQYFFYEQAAAAAAAAAGYRMLKVAPPPVTVAAVAQSDSDSSSVVDHTPSPPAVTAKKEVGFELDLNWPPPAEN

SEQ ID NO: 8500 - protein, 241 aa, Setaria italica
MAPRAADKSPVPPATGLGLGVGGGVGGVGMGPHFRGVRKRPWGRYAAEIRDPAKKSRVWLGTYDTAEEAARAYDAAAREFRGAKAKTNFPFASQCPVAAGAGSPSSNSTVDSSGGGSACGVQAPMQAMPLPPALDLDLFHRAAAVTAVSSGGMRFPFKGYPVARPTPHPYFFYEQAAAAAAAAAGYRMLKVAPPPVTVAAVAQSDSDSSSVVDHTPSPPPVTTKKEVSFDLDLNWPPPAEN

SEQ ID NO: 8501 - protein, 237 aa, Zea mays
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRAAAVNAVSTGMRFPFKGYPVACPTPQQYFFYEQAAAAASGYRMLKVAPPAVTVAAVAQSDSDSSSVVDHSPSPPAVTANKVGFELDLNWPPPAEN

SEQ ID NO: 8502 - protein, 241 aa, Cenchrus ciliaris
  misc_feature (138)..(138): Xaa can be any naturally occurring amino acid
  misc_feature (143)..(143): Xaa can be any naturally occurring amino acid
  misc_feature (147)..(147): Xaa can be any naturally occurring amino acid
MAPRAADKSLLPPATGLGLGVGGGVGGVATGPHFRGVRKRPWGRYAAEIRDPAKKSRVWLGTYDTAEEAARAYDAAAREFRGAKAKTNFPFASQCPVAAGAGSPSSNSTVDSSGGGSGCGVQAPMQAMPLPPALDLDXFHRAXAVTXVSSGGMRFPFKGYPVARPATHPYFFYEQAAAAAAAAAGYRMLKVAPPPVTVAAVAQSDSDASSVVDHTPSPPPVTTKKEVSLDLDLNWPPPAEN

SEQ ID NO: 8503 - protein, 233 aa, Panicum virgatum
MAPPSAHKSPVPPATGLGLGVVGGVGGVGMGPHFRGVRKRPWGRYAAEIRDPAKKSRVWLGTYDTAEEAARAYDAAAREFRGAKAKTNFPFASKCPVAAGAGSPSSNSTVESGGGGGGGVQAPMQAMPLPPALDLDLFHRAAAVTAVSPGGMRFPFKGFPVARPTPNPYFFYEQASGYRMLKVAPPPVTVAAVAQSDSDSSSVVDHTPSPPAVTAKKEVSFDLDLNWPPPAEN

SEQ ID NO: 8504 - protein, 241 aa, Zea mays
MAPRVADKSPLPLATGLKLGVGGGVGGMGLGPHYRGVRKRPWGRYAAEIRDPAKKSRVWLGTYDTAEEAAKAYDVAAREFRGAKAKTNFPFPLAVAVAGGAGSPSSDSTTLESSCGGSGCGVEAPVQAAMPLTPALDLDLFHRAAAVSAVTTGGMPFPFKAFPVVRPTPHQYFLYNQAAAAAAAGYRMVKVASAPVTVAAVAQSDSDSSSVVDRTCSPPAVTAKKEVSFELDLNWPPPAEN

SEQ ID NO: 8505 - protein, 240 aa, Leymus cinereus x Leymus triticoides
MAPRAAEKAPVSPATGLVLGVGGGVGVVAGGAHYRGVRKRPWGRYAAEIRDPAKKSRVWLGTYDTAEEAARAYDTAAREFRGAKAKTNFPFPSSSSPVAGGGSPSSNSTVDSSGGGSGGCVQAPMQAMPLPPALDLDLFHRAAAVTAVAAGGMRFPFNGYPVAPRQPLHPYFFYEQAAAAAAASGYRTLKMAQPVTVAAVAQSDSDSSSVVDLSPSPPAVTAHKAVAFDLDLNRPPPSED

SEQ ID NO: 8506 - protein, 156 aa, Saccharum officinarum
MMWSHEPAAEQKAAAASPPTRQRSSVAKLTTASSSLANLLSVFVGANNNNSPADPRPPPRRSFDEGGGVGLGIVAAMSHACLTGAEPIAIGAAARRRAREEDESYTCVITHVAGAGGGSVRKRVYFGFGDGGGWLVEADEEAPGAGARLPEPVLPL

SEQ ID NO: 8507 - protein, 219 aa, Zea mays
MMWSHEPAAEQKAAASAPPTRQRSSVAKLTTASSSLANLLSAFVSANNSSPDPRPPPPRRSFDERGAVGLGIVAAMGHGAEPIAIGAAARRRAREDDESYTCVIKHVAGAGGASVRKRVYFGFGDGGGGWLVEADDAAPAPAPDFLSRCCLCDKRLDGLDIYMYRGEKAFCSSECRCQQMLLDDRAAKCGSSEALIRSGDYSVSPHSAPMAFSPSVAAA

SEQ ID NO: 8508 - protein, 382 aa, Zea mays
MERMLARLMRRRSSVPLSGLLHHGGAPAPLQAAGATGASPLILSHQQQQQHTAASAVLPGLKIRDSASQLIGRTPMVYLNKVTEGCGARVAAKLEFLQPSFSVKDRPAISMLEDAEKRGLITPGKTTLIEPTSGNMGIGLAFMAALKGYELVLTMPSYTSLERRVTMRAFGANLVLTDPAKGMGGTVRKATELYERHPSAHMLQQFQNPANVKVHYDTTGPEIWEDTLGQVDIFVMGIGSGGTVTGVGKYLKEKNPNAKIYGVEPAEANVLNGGKPGPHLITGNGVGFKPDILDMDVMEKVLEVKGEDAVKMARELAVKEGLLVGISSGANTVAALELAKRPENKGKLIVTVLPSLGERYLSSALFDELRKEAQAMEPVAVD

SEQ ID NO: 8509 - protein, 376 aa, Saccharum officinarum
MERMLARLMRRRSSPLPGLLYQGGAAAAAAPASLQDSSLFSHHHQQHTAAALPGLKIRDSASQLIGRTPMVYLNKVTEGCGARIAAKLEFLQPSFSVKDRPAISMLEDAEKRGLITPGKTTLIEPTSGNMGIGLAFMAALKGYELILTMPSYTSLERRVTMRAFGANLVLTDPTKGMGGTVRKAAELYEKHPSAYMLQQFQNPANVKIHYETTGPEIWEDTLGQVDIFVMGIGSGGTVTGVGKYLKEKNPNAKIYGVEPAEANVLNGGKPGPHLITGNGVGFKPDILDMDVMEKVLEVKSEDAVKMARELAVKEGLLVGISSGANTVAALELAKKPENKGKLIVTVLPSLGERYLSSALFDELRKEAEAMEPVAVD

SEQ ID NO: 8510 - protein, 380 aa, Pennisetum glaucum
MERMLARLVRRRSLLHQGAAAAAAPMAALAGAGGSPSLFSTQQQRQQVAADPGVLPAGLNIRDSASQLIGRTPMVYLNKVTEGCGARIAAKLEFLQPSFSVKDRPAISMLEDAEKKGLITPGKTTLIEPTSGNMGIGLAFMAALKGYELVLTMPSYTSLERRVTMRAFGANLVLTDPTKGMGGTVRKATELYEKHPSAYMLQQFQNPANVKVHYETTGPEIWEDTLGQVDIFVMGIGSGGTVTGVGKYLKEKNPNAKIYGVEPAEANVLNGGKPGPHLITGNGVGFKPDILDMDVMEKVLEVKSEEAVKMARELALKEGLLVGISSGANTVAALELAKKPENKGKLIVTVLPSLGERYLSSALFDELRKEAEAMEPVPVD

SEQ ID NO: 8511 - protein, 374 aa, Panicum virgatum
MERMLARLMRRRSSLLHQGAVAAAPISLAGSSSLFSTQQLQAVAADPGVLPGLKIRDSASQLIGRTPMVYLNKVTEGCGARIAAKLEFLQPSFSVKDRPAISMLEDAEKKGLITPGKTTLIEPTSGNMGISLAFMAALKGYELILTMPSYTSLERRVTMRAFGANLVLTDPTKGMGGTVRKATELYEKHPSAYMLQQFQNPANVKIHYETTGPEIWEDTLGQVDIFVMGIGSGGTVTGVGKYLKEKNPNAKIYGVEPAEANVLNGGKPGPHLITGNGVGFKPDILDMDVMEKVLEVKSEDAVKMARELAVKEGLLVGISSGANTVAALELAKKPENKGKLIVTVLPSLGERYLSSALFDELRKEAEAMEPVPVD

SEQ ID NO: 8512 - protein, 376 aa, Setaria italica
MERMLARLVRRRSLLHQGAAAASMELASAGGSPSLFSTQQQQAAAADPGVLPAGLNIRDSASQLIGRTPMVYLNKVTEGCGARIAAKLEFLQPSFSVKDRPAISMLEDAEKKGLITPGKTTLIEPTSGNMGIGLAFMAALKGYELVLTMPSYTSLERRVTMRAFGANLVLTDPTKGMGGTVRKATELYEKHPSAYMLQQFQNPANVKIHYETTGPEIWEDTLGQVDIFVMGIGSGGTVTGVGKYLKEKNPNAKIYGVEPAEANVLNGGKPGPHLITGNGVGFKPDILDMDVMEKVLEVKSEDAVKMARELAVKEGLLVGISSGANTVAAIELAKKPENKGKLIVTVLPSLGERYLSSALFDELRKEAEAMEPVPVD

SEQ ID NO: 8513 - protein, 377 aa, Oryza sativa
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPEILNMDIMEKVIEVKGEDAVKMARELALKEGLLVGISSGANTVAALELAKKPENKGKLIVTVLPSLGERYLSSALFEELRAEAEAMQPVPVD

SEQ ID NO: 8514 - protein, 378 aa, Brachypodium distachyon
MERMVMRLMRRKSLLHGGSGGLLAASTANGSVVSGAGGSPFFSTQQQQQEDPILPALKIRDTAAHLIGRTPLVYLNKVTEGCGARIAAKLEFLQPSFSVKDRPAISMMEDAEKKGLITPGKTTLIEPTSGNMGIGLAFMAALKGYELVLTMPSYTSLERRVVMRAFGAQLVLTDPAKGMGGTVRKATQLYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALKEGLLVGISSGANTVAAIELAKRPENKGKLIVTVHPSAGERYLSAALFEDLRKEAEAMQPVPVD

SEQ ID NO: 8515 - protein, 381 aa, Secale cereale
MERMVMRLMRNKNHSLRQLQGAAAGGLASPSSSSASGAAASSFSTLQQQQQEDHPAPGALNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALQEGLLVGISSGANTVAAIELAKRPENKGKLIVTVHPSAGERYLSSALFEGLRKEAEAMQPVPVD

SEQ ID NO: 8516 - protein, 381 aa, Secale cereale
MERMVMRLMRNKNHSLRQLQGATAGGLAPSSSASGAAASSFSTLQQQQQQQEDRPAPGALNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALQEGLLVGISSGANTVAAIELAKRPENKGKLIVTVHPSAGERYLSSALFEGLRKEAEAMQPVPVD

SEQ ID NO: 8517 - protein, 378 aa, Triticum aestivum
MERMVMRLMRNKNQSLRQLQGAAAGVLASSSSASSAAGAAASPFSTLQQQEDHPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAKQLALQEGLLVGISSGANTVAAIELAKRPENKGKLIVTVHPSAGERYLSSALFEGLRKEAEAMQPVPVD

SEQ ID NO: 8518 - protein, 378 aa, Triticum aestivum
MERMVMRLMRNKNQSLRQLQGAAAGGLASSSSASSTAGAAASPFSTLQQQEDHPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAKQLALQEGLLVGISSGANTVAAIELAKRPENKGKLIVTVHPSAGERYLSSALFEGLRKEAEAMQPVPVD

SEQ ID NO: 8519 - protein, 379 aa, Secale cereale
MERMVMRLMRNKNHSLRQLQGATAGGLAPSSSASGAAASSFSTLQQQQQEDHPAPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALQEGLLVGISSGANTVAAIELAKRPENKGKLIVTVHPSAGERYLSSALFEGLRKEAEAMQPVPVD

SEQ ID NO: 8520 - protein, 373 aa, Hordeum vulgare
MERMVMRLMRNKSLLAGASSRGGGGLASSSIVDSSPFSTLQQQQQQEDPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYDNHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALQEGLLVGISSGANTVAAIELAKRPENKGKLIVTVHPSAGERYLSSALFEGLRKEAEAMQPVPVD

SEQ ID NO: 8521 - protein, 378 aa, Triticum aestivum
MERMVMRLVRNKQSLRQLQGAAAGGLASSSSASSTAGAAASSFSTLQQQQEDHPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKSEDAVKMAQQLALQEGLLVGISSGANTVAAIELAKRPENKGKLIVTVHPSAGERYLSSALFEGLRKEAEAMQPVPVD

SEQ ID NO: 8522 - protein, 370 aa, Avena sativa
MERMVMRLARRNRSLFQAGGGGGIRVVSGAGGSSFFSTQQQLVEDPPALKIRDTAAHLIGRTPLVYLNKVTEGCGARVAAKLEFLQPSFSVKDRPAISMIEDAEKKGLITPGKTTLIEPTSGNMGIGLAFMAALKGYELILTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKSEDAVKMAQQLALKEGLLVGISSGANTVAAIELAKRPENKGNLIVTVHPSAGERYLSSALFEGLRKEAEAMQPVPVE

SEQ ID NO: 8523 - protein, 377 aa, Leymus cinereus x Leymus triticoides
  misc_feature (15)..(16): Xaa can be any naturally occurring amino acid
  misc_feature (19)..(19): Xaa can be any naturally occurring amino acid
  misc_feature (27)..(32): Xaa can be any naturally occurring amino acid
  misc_feature (34)..(34): Xaa can be any naturally occurring amino acid
  misc_feature (38)..(38): Xaa can be any naturally occurring amino acid
  misc_feature (49)..(49): Xaa can be any naturally occurring amino acid
  misc_feature (54)..(54): Xaa can be any naturally occurring amino acid
  misc_feature (140)..(140): Xaa can be any naturally occurring amino acid
  misc_feature (170)..(170): Xaa can be any naturally occurring amino acid
  misc_feature (172)..(172): Xaa can be any naturally occurring amino acid
  misc_feature (314)..(314): Xaa can be any naturally occurring amino acid
  misc_feature (318)..(318): Xaa can be any naturally occurring amino acid
  misc_feature (354)..(354): Xaa can be any naturally occurring amino acid
MERMVMRLMRNKFLXXGAXRGGLASSXXXXXXGXDSSXFSTLQQQQQEXHPRAXMLNIRDTAAHLIGRTPLVYLNKVTEGCGARVAAKLEFLQPSFSVKDRPAISMIEDAEKKGLITPGKTTLIEPTSGNMGIGLAFMAXLKGYELVLTMPSYTSLERRVVMKAFGAQLXLXDPAKGMGGTVRKATQLYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPDILDMDIMEKVLEVKGEDAVKMAQQLALXEGLXVGISSGANTVAAIELAKRPENKGKLIVTVHPSAGEXYLSSALFEGLRKEAEAMQPVPVD

SEQ ID NO: 8524 - protein, 556 aa, Zea mays
MDRLGANPANSCPLTPLGFLERTATVYGDCPSVVYHDTVYTWSQTHRRCLRLASALVSLGVSRGDIVSVLLPNVPAMYEMHFGVPMSGAVLNTINTRLDARTVSVLLRHAGSKLVFADPASMPLVRDALSQLPPGHPAPRVVPVEDPHETEFPAAAPGALTYEALLDGGDPEFAWVRPASEWDPMILNYTSGTTSAPKGVVHCHRGIFLVTVDALVEWAVPPRPTYLWTLPMFHANGWCFPWGMAAVGGTNVCLRRVDAAEVYDAIARRGVDHLCGAPVVLNMLANAPDAARRPLPGKVRILTAGAPPPAAVLHRTESIGFEVTHGYGLTETAGLVVCCAWKREWNKLPASERARLKARQGVRTPGMNEVDIVDGETGRSVPRDGSTMGEIVLRGGGVMLGYLNDDKATRAAIRDNGWFYTGDVGVMHPDGYMEIRDRSKDVIISGGENISSVEVESVLYNHPAVNEAAVVARPDEFWGETPCAFVSLKEGSGAVTAADVIAWCRDRMPHYMVPKTVVLRAELPKTSTGKIQKYVLRNLAKEMGPTRKGASSSSRM

SEQ ID NO: 8525 - protein, 557 aa, Setaria italica
MDRLGANPANSCPLTPLGFLERSATVFGDCPSVVYHDTVFTWSQTHRRCLRLASALVSLGISRGDIVSVLLPNVPAMYEMHFGVPMSGAVLNTINTRLDARTVAVLLHHSGSKLVFADPASLPLIRDAMKQLPPGHPAPRVIPVEDPHEKEFPAAPPGTLTYERLLEKGDPEFAWVRPASEWDPMILNYTSGTTSAPKGVVHCHRGIFLVTMDSLVAWAVPPQPTYLWTLPMFHANGWSFPWGVAVVGGTNVCLRRVDATEVYATIARRGVNHLCGAPVVLNMLANAPDGVRQPLQGKVRILTAGAPPPAAVLNRTESIGFEVSHGYGLTETAGLVMSCAWKGEWNKLPASERARLKARQGVRTPGMAEVDIIDGETGRSVPRDGSTMGEIVLRGGCLMLGYLDDDKATRAAIRDDGWFYTGDVGVMHPDGYMEIRDRSKDVIISGGENISSVEVESVLYNHPAVNEAAVVARPDEFWGETPCAFLSLKEGSPGAVTASDVMAWCRERMPRYMVPKTVVFRAELPKTSTGKIQKYVLRNLAKEMGPTRKGASSSSKM

SEQ ID NO: 8526 - protein, 554 aa, Zea mays
MDRLGANPANSCPLTPLGFLERSATVFGDCHSVVYHDTVFTWSQTHRRCLRLASALVSLGINRGDIVSVLLPNVPAMYEMQFGVPMSGAVLNNINMRLDARTVAVLLRHSGSKLVFVDPASLTLIRDALKQLPQGHPAPRVIPVEDPHEKGLPAAPPGSLTYEGLLEKGDPEFAWVRPASEWDPMVLNYTSGTTSEPKGVVHCHRGIFLITLDSLIEWAVPPQPTYLWTLPMFHANGWSFPWGMAVVGGTNVCLRRVDAAEVYATIAGRGVSHLCGAPVVLNMLANAPEGVRRPLPGKVRILTAGAPPPAAVLHRTESIGFEVIHGYGLTETAGLVVCCAWKGEWNKLPASERARLKARQGVRTPGMAEVDIVDGETGRSVPRDGSTMGEIVLRGGCVMLGYLDDDKATKAAIRDNGWFYTGDVGVMHPDGYMEIRDRSKDVIISGGENISSVEVESVLYSHPAVNEAAVVARPDDFWGETPCAFVSLKEEGSTAADVIAWCRQRMPHYMVPRTVVFRDELPKTSTGKIQKYVLRNLAKEMGSTHKGASRISKM

SEQ ID NO: 8527 - protein, 558 aa, Sorghum bicolor
MDRLGSNPANSCPLTPLGFLERAATVFGDCSSVVYHDTVFTWSQTHRRCLRLASALVSLGITRGDIVSVLLPNVPAMYEMQFGVPMSGAVLNNINTRLDARTVAVLLRHSGCKLVFVDPASLTLITDALKQLPHGHPAPRVILVEDPHEKGLPAAPAGSLTYERLLENGDPEFAWVRPASEWEPMILNYTSGTTSEPKGVVHCHRGLFLITLDSLIEWAVPPQATYLWTLPMFHANGWSFPWGMAVVGGTNVCLRRVDAGEVYATIAARGVTHLCGAPVVLNMLANAPEVVRRPLPGKVRILTAGAPPPAAVLHRTESIGFEVSHGYGLTETAGLVVCCSWKREWNKLPASERARLKSRQGVRTPGMAEVDIVDGETGRSVPRDGSTMGEIVLRGGCVMLGYLNDDKATGAAIREDGWFYTGDVGVMHPDGYMEIRDRSKDVIISGGENISSVEVESVLYSHPAVNEAAVVARPDDFWGETPCAFVGLKEGASAGAVTAADVIAWCRQRMPHYMVPRTVVFRDELPKTSTGKIQKYVLRNLAKEMGSTRKGGSSISKM

SEQ ID NO: 8528 - protein, 558 aa, Oryza sativa
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRILTAGAPPPAAVLYRTEAIGFEVSHGYGLTETAGLVLSCAWKGEWDKLPASERARLKARQGVRTPGMAEVDVVDGETGRSVPRDGSTMGEIVLRGGCITLGYLNDEAATKAAIRDNGWFYTGDVGVMHPDGYVEIRDRSKDVIISGGENISSVEVESVLYGHPAVNEAAVVARPDEFWGETPCAFVSLKQGGGAVTAADVVAWSRERMPRYMVPKTVIFRDELPKTSTGKIQKYVLRNIAKEMGPTTGTNTKRNSKM

SEQ ID NO: 8529 - protein, 555 aa, Hordeum vulgare
MEKLGANPANSCPLTPLGFIERAATVYGDCPSVVYGDTVFTWSQTHRRCLRLASALASLGVSRRDVVSVLLPNVPAMYEAHFGVPMSGAVLNSINTRLDARTVSVLLRHSGSRLILVDPALVPVLGEALRLLPPGHPAPRVVLVEDPQEKDFSPAPAAALTYEKLLEMGDPEFRWVRPASEWDPMILNYTSGTTSAPKGVVHCHRGIFVVTMDSLVSWSVPEQPTYLWTLPMFHANGWSFPWGMAVVGGTNVCLRRVDAAEVYDTIARRGVTHLCGAPVVLNMLANAPEGVRRPLPGKVHILTAGAPPPAAVLGRTEAIGFDVSHGYGLTETAGLVLLCAWKGEWNKLPASERARLKARQGVRTPGMAEVDIVDGETGRSVPRDGATMGEIVLRGGCVTMGYFKDEDATRAAIRDDGWFYTGDVGVMHPDGYLEIRDRSKDVIISGGENISSVEVESLLYGHPAVNEAAVVARPDEFWGETPCAFVSLKEGAGGAVTAAEVIAWSRERMPGYMVPKTVVFRAELPKTSTGKIQKYVLRNLAKEMGPTRRGVSSKM

SEQ ID NO: 8530 - protein, 558 aa, Secale cereale
MEKLGANPANSCPLTPLGFLERAATVYGDCPSVVYGDTVFTWSQTHRRCLRLASALASLGVSRRDVVSVLLPNVPAMYEAHFGVPMSGAVLNSINTRLDARTVSVLLRHSGSRLILVDPALVPVLDEALRLLPPGHPAPRVVLVEDPQEKDFSPAPAAALTYEKLLEMGDPEFRWVRPVSEWDPMILNYTSGTTSAPKGVVHCHRGIFVVTMDSLVSWSVPEQPTYLWTLPMFHANGWSFPWGMAVVGGTNVCLRRVDAGEVYDTIARRGVTHLCGAPVVLNMLANAPEGVRRPLPGKVQILTAGAPPPAAVLGRTEAIGFDVSHGYGLTETAGLVLLCAWKGEWNKLPASERARLKARQGVRTPGMAEVDIVDGETGRSVAHDGATMGEIVLRGGCVTMGYFKEEDATRAAIRDDGWFYTGDVGVMHPDGYLEIRDRSKDVIISGGENISSVEVESLLYGHPAVNEAAVVARPDEFWGETPCAFVSLKEGAAGTVTAAEVIAWSRERMPGYMVPKTVVFRAELPKTSTGKIQKYVLRNLAKEMGPTRRGASTTTSKM

SEQ ID NO: 8531 - protein, 556 aa, Avena sativa
MEKLGANPANSCPLTPLGFLERAATVYGDCPSVVYHGTVFTWSQTYRRCLRLASALVSLGVSRRDIVSVLLPNVPAMYEAHFGVPMSGAVLNSINTRLDARTVSVLLRHSGSKLILVDPALLPVLDEALRLLPPGHQAPRVVLVEDPHEKEFPPAPAAALTYERLLETKGDPEFRWVRPASEWDPMILNYTSGTTSAPKGVVHCHRGIFVVTLDSLVSWSVPERPTYLWTLPMFHANGWSFPWGMAVVGGTNVCLRRVDAGEVYDTIADRGVTHLCGAPVVLNMLANAPEGVRRALPGKVRILTAGAPPPAAVLGRTEAIGFDVSHGYGLTETAGLVISCAWKGEWNRLPASERARLKSRQGVRTPGMAEVDIVDGETGRSVPRDGSTMGEIVLRGGCVTMGYFKDEEATKAAIREDGWFYTGDVGVMHPDGYLEIRDRSKDVIISGGENISSVEVESVLYGHPAVNEAAVVARPDEFWGETPCAFVSLKEGAAATSAAEVMAWSRERMAGYMVPKTVVFRAELPKTSTGKIQKYVLRNLAKEMGPTRRGVSSSKM

SEQ ID NO: 8532 - protein, 552 aa, Sorghum bicolor
MGNLDSNPANSCPLTPLGFLERAATVFGDCPSVVYQDTVFTWSQTHRRCLRLASALVSLGITRGDIVSVLLPNVPAMYEMQFGVPMSGAVLNNINTRLDARTVAVLLRHSGSKLVFVDASSLQLISDALRLLPPGHPAPRVIPVEDPHEEDEFPADTLTYERLLADGDPEFAWVQPASEWDPMVLNYTSGTTSEPKGVVHCHRGLFLITVDSLMEWAVPTRPTYLWTLPMFHANGWSFPWGMAVVGGTNVCLRRVNAATVYAAIASRGVTHLCCAPVVLNMLANAHDGVRRPLPGKVRIRTAGAPPPAAVLQRTEAIGFEISHGYGLTETAGLPVSCTWKGEWDSLPAPERARLKARQGVRTPATGKVDVIDSETGRSVPRDGATMGEIVVRGGCVMLGYLNDDEATKAAIREDGWFYTGDVGVMHPDGYLEIRDRSKDVIINAGENISSVEVESVLYDHPAVNEAAVVARPDELRGETPCAFVSLKEDAAGTVTAADVIAWCRERMPQYMVPRTVVFHAELPKTSTGKIQKYVLRNLAMEMGPAHKGDGRR

SEQ ID NO: 8533 - protein, 576 aa, Setaria italica
ETSPFAQRKAEPGRIRPPHATGYLGANPANSCPLTPLGFLERAATVFGHCPSVVYHDTVFTWSQTHRRCLRLASALASLGISRGDIVSVLLPNVPAMYEVHFGVPMSGAVLNTINTRLDARTVAVLLRHSGSKIVFVDPASLPLIRDAMKQLPPGHPAPRVVPVEDPHEEEFPAAPPGTLTYERLLEKGDPEFKWVRPASEWDPMVLNYTSGTTSAPKGVVHCHRGLFLITLDWLVEWAMPPRATYLWTLPMFHANGWSFPWGMAAVGGANVCLRRVNAATVYAAIAIRGVTHLCCAPVVLNMLANAPEGVRRPLPGKVRVLTAGAPPPAAVLQRTEAIGFEVSHGYGLTETAGLPVSCTWKREWDKLPAPERARLKARQGVRLPGMAEVDVIDGETGLSVPHDGSTMGEIVLRGGCVMLGYLNDDEATRAAIRDDGWFYTGDVGVVHPDGYLEIRDRSKDVIINAGENISSVEVESVLYGHPAVNEAAVVARPDELRGETPCAFVSLKEDAAGAVTAADLMAWCRERMPQYMVPRTVVFRAELPKTSTGKIQKYVLRNLAMEMGPARKGGGTAVA

SEQ ID NO: 8534 - protein, 355 aa, Zea mays
MASEDVVGKSRGDTAVTTIVNLAEEAKLAREGVKAPGHQILTICKSLVAGGVAGGVSRTAVAPLERLKILLQVQNPHSIKYNGTVQGLKYIWRTEGLRGLFKGNGTNCARIVPNSAVKFFSYEQASKGILWAYRQQTGEEDAQLTPLLRLGAGACAGIIAMSATYPMDMVRGRITVQTDKSPYQYRGMFHALGTVYREEGFRALYKGWLPSVIGVVPYVGLNFAVYESLKDWLLQTNSFGLANDNELHVVTRLGCGAVAGTIGQTVAYPLDVIRRRMQMVGWSHADSIVTGQGKEALQYNGMIDAFRKTVRHEGVGALYKGLVPNSVKVVPSIAIAFVTYEVVKDVLGVEMRISD

SEQ ID NO: 8535 - protein, 225 aa, Saccharum officinarum
MASEDVVGKSRGDTAVTTIVNLAEEAKLAREGVKAPGHQILTIGKSLVAGGVAGGVSRTAVAPLERLKILLQVQNPHSIKYNGTVQGLKYIWRTEGLRGLFKGNGTNCARIVPNSAVKFFSYEQASKGILWAYRQQTGEEDAQLTPLLRLGAGACAGIIAMSATYPMDMVRGRITVQTDKSPYQYRGMFHALGTVYREEGFRALYRGWLHLYRNCSVRWPQLCCI

SEQ ID NO: 8536 - protein, 355 aa, Pennisetum glaucum
MASEDVVGKSRGDTAVTTIVNLAEEAKLAREGVKGPGHQLLTICKSLVAGGVAGGVSRTAVAPLERLKILLQVQNPHSIKYNGTIQGLKYIWRTEGLRGLFKGNGTNCARIVPNSAVKFFSYEQASKGILWAYRQQTGDEDAQLSPLLRLGAGACAGIIAMSATYPMDMVRGRITVQTDKSPYQYRGMFHALGTVYREEGFRALYRGWLPSVIGVVPYVGLNFAVYESLKDWLLQTNPFGLANDNELHVFTRLGCGAVAGTIGQTVAYPLDVIRRRMQMVGWSHADSIVTGQGKEALQYNGMIDAFRKTVRHEGVGALYKGLVPNSVKVVPSIAIAFVTYEVVKDVLGVEMRISD

SEQ ID NO: 8537 - protein, 355 aa, Setaria italica
MASEDVVGKSRGDTAVTTIVNLAEEAKLAREGVKGPGHQVLTICKSLVAGGVAGGVSRTAVAPLERLKILLQVQNPHSIKYNGTIQGLKYIWRTEGLRGLFKGNGTNCARIVPNSAVKFFSYEQASKGILWAYRQRTGDEDAQLSPLLRLGAGACAGIIAMSATYPMDMVRGRITVQTDKSPYQYRGMFHALGTVYREEGFRALYRGWLPSVIGVVPYVGLNFAVYESLKDWLLQTNPFGLANGNELHVVTRLGCGAVAGTIGQTVAYPLDVIRRRMQMVGWSHADSIVTGQGKEALQYNGMIDAFRKTVRHEGVGALYKGLVPNSVKVVPSIAIAFVTYEVVKDVLGVEMRISD

SEQ ID NO: 8538 - protein, 354 aa, Festuca arundinacea
  misc_feature (40)..(40): Xaa can be any naturally occurring amino acid
MASEDVVGKSRGDTAVNTIVNLAEEAKLAREGVKGPGHQXLTVCKSLFAGGVAGGLSRTAVAPLERLKILLQVQNPHSIKYNGTVQGLKYIWRTEGLRGLFKGNGTNCARIVPNSAVKFFSYEQASRGVLYLYRQQTGDENAQLTPVLRLGAGACAGIIAMSATYPMDMVRGRITVQTDKSPYQYRGMFHALGTVYREEGFRALYRGWLPSVIGVVPYVGLNFAVYESLKDWILRTNAFGLADNNELHVVTRLGCGAVAGTIGQTVAYPLDVVRRRMQMVGWNHAASIITGEGKEALQYNGMIDAFRKTVRHEGFGALYKGLVPNSVKVVPSIAIAFVTYEAVKDVLGVEMRID

SEQ ID NO: 8539 - protein, 355 aa, Oryza sativa
MASEDVVGKSRGDTAVTTIVNLAEEAKLAREGVKGPGYQVLSICKSLFAGGVAGGVSRTAVAPLERMKILLQVQNPHSIKYNGTIQGLKYIWRTEGLRGLFKGNGTNCARIVPNSAVKFFSYEQASSGILWLYRQQTGNEDAQLSPLLRLGAGACAGIIAMSATYPMDMVRGRITVQTEKSPYQYRGMFHALGSVYREEGFRALYRGWLPSVIGVVPYVGLNFAVYESLKDWLLQTNPYDLGKDNELHVVTRLGCGAVAGTIGQTVAYPLDVIRRRMQMVGWNNAASIVTGEGKEALQYNGMIDAFRKTVRYEGVGALYKGLVPNSVKVVPSIAIAFVTYEFVQKVLGVEMRISD

SEQ ID NO: 8540 - protein, 354 aa, Hordeum vulgare
MASEDVVGKSRGDTAVNTIVNLAEEAKLAREGVKGPGHQVLTICKSLFAGGVAGGLSRTAVAPLERLKILLQVQNPHSIKYNGTVQGLKYIWRTEGLRGLFKGNGTNCARIVPNSAVKFFSYEQASRGILYLYRQQTGDENAQLSPILRLGAGATAGIIAMSATYPMDMVRGRITVQTEKSPYQYRGMFHALGTVYREEGFRALYRGWLPSVIGVVPYVGLNFAVYESLKDWLLQSNAFDLAKDNELHVVTRLGCGAVAGTIGQTVAYPLDVVRRRMQMVGWSHAASIVTGEGKEALQYNGMVDAFRKTVRHEGFGALYKGLVPNSVKVVPSIAIAFVTYEAVKDVLGVEMRID

SEQ ID NO: 8541 - protein, 354 aa, Unknown
  Sequence found in Organisms: Secale cereale, Triticum aestivum
MASEDVVGKSRGDTAVNTIVNLAEEAKLAREGVKGPGHQVLTVCKSLFAGGVAGGLSRTAVAPLERLKILLQVQNPHSIKYNGTVQGLKYIWRTEGLRGLFKGNGTNCARIVPNSAVKFFSYEQASRGILYLYRQQTGDENAQLSPILRLGAGATAGIIAMSATYPMDMVRGRITVQTEKSPYQYRGMFHALGTVYREEGFRALYRGWLPSVIGVVPYVGLNFAVYESLKDWLLQSNAFDLAKDNELHVVTRLGCGAVAGTIGQTVAYPLDVVRRRMQMVGWSHAASIVTGEGKEALQYNGMIDAFRKTVRHEGFGALYKGLVPNSVKVVPSIAIAFVTYEAVKDVLGVEMRID

SEQ ID NO: 8542 - protein, 354 aa, Avena sativa
MASEDVVGKSRGDTAVNTIVNLAEEAKLAREGVKGPGHQVLTVCKSLFAGGVAGGLSRTAVAPLERLKILLQVQNPHSIKYNGTVQGLKYIWRTEGLRGLFKGNGTNCARIVPNSAVKFFSYEQASRGVLYLYRQQTGDENAQLSPVLRLGAGACAGIIAMSATYPMDMVRGRITVQTDKSPYQYRGMFHALGTVYREEGFRALYRGWLPSVIGVVPYVGLNFAVYESLKDWILRTNAFGLADNNELHVVTRLGCGAVAGTIGQTVAYPLDVVRRRMQMVGWNHAASIVTGEGKAALQYNGMIDAFRKTVRHEGFGALYKGLVPNSVKVVPSIAIAFVTYEAVKDVLGVEMRID

SEQ ID NO: 8543 - protein, 354 aa, Brachypodium distachyon
MASEDVVGKSRGDTAVNTIVNLAEEAKLAREGVKGPGHQVLTICKSLFAGGVAGGLSRTAVAPLERLKILLQVQNPHSIKYNGTVQGLKYIWGTEGFRGLFKGNGTNCARIVPNSAVKFFSYEQASRGILYLYRQQSGDEDAQLSPVLRLGAGATAGIIAMSATYPMDMVRGRITVQTEQSPYQYRGMFHALGTVYREEGFRALYRGWLPSVIGVVPYVGLNFAVYESLKDWLLQTNTLGLAKDNELHIVTRLGCGAVAGTIGQTVAYPLDVVRRRMQMVGWNHAASIVTGEGKEALQYNGMIDAFRKTVRHEGFGALYKGLVPNSVKVVPSIAIAFVTYEAVKDVLGVEMRID

SEQ ID NO: 8544 - protein, 357 aa, Elaeis guineensis
MASEDVVGKSTSESAVTTIVNLAEEAKLAREGVKAPGHELLSICKSLVAGGVAGGVSRTAVAPLERLKILLQVQNPHNIKYNGTMQGLKYIWRSEGVRGLFKGNGTNCARIVPNSAVKFFSYEQAASGILWLYRRQSGNEDAQLTPVLRLGAGACAGIIAMSATYPMDMVRGRITVQTEKSPYQYRGMFHALGTVYREEGFRALYKGWLPSVIGVIPYVGLNFAVYESLKDWLVKSNPLGLVEDSELSVVTRLACGAVAGTIGQTVAYPLDVIRRRMQMVGWNHAASIVAGQGGSKAPLEYTGMVDAFRKTVRSEGFGALYKGLVPNSVKVVPSIAIAFVTYEVVKDVLGVEMRISD

SEQ ID NO: 8545 - protein, 357 aa, Musa acuminata
MASEDVVGKSTGESAVTRIVNLAEEAKLAREGVKAPGHAILSICKSLVAGGVAGGVSRTAVAPLERLKILLQVQNPHSIQYNGTIQGLKYIWKSEGFRGLFRGNGTNCARIVPNSAVKFFSYEQASSGILWLYRRQSGNEDAQLTPVLRLGAGACAGIIAMSATYPMDMVRGRITVQTEKSPYQYRGMFHALGTVYREEGFRALYKGWLPSVIGVIPYVGLNFAVYESLKDWLIKSNPYGLVEDSELSVVTRLACGAVAGTIGQTVAYPLDVIRRRMQMVGWNNAASVVAGEGRSKGSLEYTGMIDAFRKTVHHEGFGALYKGLVPNSVKVVPSIAIAFVTYEVVKDILGVEMRISD

SEQ ID NO: 8546 - protein, 357 aa, Musa acuminata
MASEDVVGKSTGDSAVTTIVNLAEEAKLAREGVKAPGHAILSICKSLVAGGVAGGVSRTAVAPLERLKILLQVQNPHSIQYNGTIQGLKYIWKSEGFRGLFRGNGTNCARIVPNSAVKFFSYEQASSGILWLYRRQSGNEDAQITPVLRLGAGACAGIIAMSATYPMDMVRGRITVQTEKSPYQYRGMFNALGTVYREEGFRALYKGWLPSVIGVIPYVGLNFAVYESLKDWLVKSKPYGLVEDSELSVVTRLACGAVAGTIGQTVAYPLDVIRRRMQMVGWKDAASVVTGEGRSKAPLEYAGMIDAFRKTVHHEGFGALYKGLVPNSVKVVPSIAIAFVTYEVVKDILGVEMRISD

SEQ ID NO: 8547 - protein, 357 aa, Aristolochia fimbriata
MASEDVVGKTTGESAVSTFVNLAEEAKLASEGVKAPGHAILTICKSLVAGGVAGGVSRTAVAPLERLKILLQVQNPHSIKYNGTIQGLKYIWRTEGVRGLFKGNGTNCARIVPNSAVKFFSYEQASRGILWLHRQQPGNEDAQLTPLLRLEAGACAGIIAMSATYPMDMVRGRLTVQTDKSPYQYRGMFHALSTVLREEGPRALYKGWLPSVIGVIPYVGLNFAVYESLKDWLLKTKPFGLVENDELGVATRLACGAAAGTVGQTVAYPLDVIRRRMQMVGWKDASSVVTGDGRGKAPLEYTGMIDAFRKTVRHEGVGALYKGLVPNSVKVVPSIAIAFVTYEVVKDVLGVEMRISD

SEQ ID NO: 8548 - protein, 358 aa, Musa acuminata
MASENVVGKNTGESAVTTIVNLAAEEAKLAREGVKAPGHAILSICKSLVAGGVAGGVSRTAVAPLERLKILLQVQNPHSIQYNGTIQGLKYIWKSEGFRGLFKGNGTNCARIIPNSAVKFFSYEQASSGILWLYRRHSGKEDAQLTPVLRLGAGACAGIIAMSATYPMDMVRGRITVQTEKSPYQYRGMFHALRTVYCEEGFRALYKGWLPSVIGVIPYVGLNFAVYESLKDWLIKTNPYGLVEDSELSIVTRLGCGAVAGTVGQTVAYPLDVIRRRMQMVGWKDAASIVTGHGRSKAPLEYNGMVDAFRKTVRNEGFGALYKGLVPNSVKVVPSIAIAFVTYEVVKDVLGVEMRISD

SEQ ID NO: 8549 - protein, 354 aa, Populus trichocarpa
MASEDVKTSESAVTTIVNLAEEAKLAREGVKAPSHAILSICKSLVAGGVAGGVSRTAVAPLERLKILLQVQNPHNIKYNGTIQGLKYIWRTEGFRGLFKGNGTNCARIVPNSAVKFFSYEQASKGILSLYQQQTGNEDAQLTPLLRLGAGACAGIIAMSATYPMDMVRGRLTVQTDKSPYQYRGMFHALSTVLRQEGPRALYKGWLPSVIGVVPYVGLNFAVYESLKDWLVKARPFGLVEDSELSVTTRLACGAAAGTIGQTVAYPLDVIRRRMQMVGWKDAASIVTGDGRSKAPLEYNGMIDTFRKTVRHEGFGALYKGLVPNSVKVVPSIAIAFVTYEMVKDVLGVEIRISD

SEQ ID NO: 8550 - protein, 356 aa, Amorphophallus konjac
MASEDVVGKTTGESAVTTIVNLAEEAKLAREGVKAPGHAILTICKSLAAGGIAGGVSRTAVAPLERLKILLQVQNPHNIKYNGTIQGLKYIWRTEGFRGLFKGNGTNCARIVPNSSVKFFSYEQASSGILWLYRQQTGNEDAELTPVLRLGAGACAGIIAMSATYPLDMVRGRITVQTEKSPYQYRGMFHALTTVYRQEGFRALYKGWLPSVIGVVPYVGLNFAVYESLKDWLVKSRPFGLVQDSELSVTTRLACGAAAGTVGQTVAYPLDVIRRRMQMVGWKDAAPVVAGQGSKASLQYNGMVDAFRQTVRNEGFGALYKGLVPNSVKVVPSIAIAFVTYEVVKDVLGVEMRISD

SEQ ID NO: 8551 - protein, 357 aa, Musa acuminata
MASEDVVGKSTGESAVTTIVNLAEEAKLAREGVKAPGYAVVSICKSLVAGGVAGGVSRTAVAPLERLKILLQVQNPHSIQYNGTIQGLKYIWKSEGLRGLFRGNGTNCARIVPNSAVKFFSYEQASSGILWLYRQQSGNEEAQLTPVLRLGAGACAGIIAMSATYPMDMVRGRITVQTEKSPYQYRGMFHALGTVYREEGFRALYKGWLPSVIGVIPYVGLNFAVYESLKDWLIKSNPYGLVEDSELSVVTRLGCGAVAGTVGQTVAYPLDVIRRRMQMVGWKDAASVVTGQGRSSAPLEYTGMVDAFRKTVHHEGFGALYKGLVPNLVKVVPSIAIAFVTYEVVKDLLEVEMRISD

SEQ ID NO: 8552 - protein, 354 aa, Actinidia deliciosa
MASEDVKTGESAVSAIVNLAEEAKLAREGVKAPSYAVLSICKSLVAGGVAGGVSRTAVAPLERLKILLQVQNPHNIKYNGTVQGLKYIWRTEGFRGLFKGNGTNCARIVPNSAVKFFSYEQASKGILWYYRQQTGNEDAQLTPLLRLGAGACAGIIAMSATYPMDMVRGRLTVQTEKSPYQYRGMFHALSTVLREEGPRALYKGWLPSVIGVVPYVGLNFAVYESLKDWLIKSRPFGLVEDSELSVTTRLACGAAAGTIGQTVAYPLDVIRRRMQMVGWSNAASVITGDGRSKAPLEYRGMIDAFRKTVRHEGFRALYKGLVPNSVKVVPSIAIAFVTYEQVKDILGVEIRISD

SEQ ID NO: 8553 - protein, 358 aa, Aquilegia formosa
MASEDVVGKSRSDSAVSTIVNLAEEAKLASEGVKAPSHAAIFSICKSLVAGGVAGGLSRTAVAPLERLKILLQVQNPHNIKYNGTLQGLKYIWRTEGFRGLFKGNGTNCARIVPNSAVKFFSYEQASRGILWLYRQQPGNEDASLTPLLRLGAGACAGIIAMSATYPMDMVRGRLTVQTDKSPYQYRGMFHALSTVLREEGARALYKGWLPSVIGVVPYVGLNFAVYESLKDWLVKSRPFGLVEDAELSVPIRLACGAAAGTVGQTVAYPLDVIRRRMQMVGWSNASSVVTGDGRAKASLEYNGMIDAFRKTVRNEGFRALYKGLVPNSVKVVPSIAIAFVTYESVKDVLGVEMRISD

SEQ ID NO: 8554 - protein, 354 aa, Beta vulgaris
MASEDVKTTESAVSTIVNLAEEAKIAREGVKAPSHAILSICKSLVAGGVAGGVSRTAVAPLERLKILLQVQNPHSIKYNGTIQGLKYIYQTEGFRGLFKGNGTNCARIVPNSAVKFFSYEQASKGILWLYQRQTGNENAQLTPVLRLGAGACAGIIAMSATYPMDMVRGRITVQTEKSPFQYRGMVHALSTILREEGPRALYKGWLPSVIGVVPYVGLNFAVYESLKDWLAKARPFGLIQDGELSVTTRLACGAVAGTIGQTVAYPLDVIRRRMQMVGWNHASSIVTGDGRGKVPLEYNGMVDAFRKTVRHEGFGALYKGLVPNSVKVVPSIAIAFVTYEMVKDVLGVEMRISD

SEQ ID NO: 8555 - protein, 353 aa, Eucalyptus grandis
MASEDVVSERRESAVSTIVNLAEEASEGVKAPSHALLSICKSLVAGGVAGGVSRTAVAPLERLKILLQVQNPHSIKYNGTMQGLKYIWRTEGLRGLFKGNGTNCARIVPNSAVKFFSYEQASHGILWLYRQQPGKEDAQLTPLLRLGAGACAGIIAMSATYPMDMVRGRLTVQTEKSPRQYRGIYHALSTVFKEEGPRALYRGWLPSVIGVVPYVGLNFAVYESLKDYLLQTNPFGLVEDNELSVTTRLACGAAAGTIGQTVAYPLDVIRRRMQMVGWKGASSVIVGEGRSKAPLEYTGMVDAFRKTVRYEGFGALYKGLVPNSVKVVPSIAIAFVTYEVVKDVLGVEMRISD

SEQ ID NO: 8556 - protein, 357 aa, Phalaenopsis aphrodite
MATEDVVGKSTGETAVTTIVNLAEEAKLAREGVKAPSHAILSVCKSLVAGGVAGGVSRTAVAPLERLKILLQVQNSLNIKYNGTIQGLKYIWRTEGFRGLFKGNGTNCARIIPNSAVKFFSYEQASRGILWLYRQQTGNEDAQLTPVLRLGAGACAGIIAMSATYPMDMVRGRITVQTEKSPYHYRGMFHALGTVYKEEGFRALYKGWLPSVIGVIPYVGLNFAVYESLKEWLVVSKPFGIADDEELGVVTKLACGAAAGTVGQTVAYPLDVIRRRMQMVGWKDAAYIVRSDGRTKGPLEYSGMIDAFRKTVRHEGFKALYKGLVPNSVKVVPSIAIAFVTYEVVKDVLGVEMRISD

SEQ ID NO: 8557 - protein, 355 aa, Elaeis guineensis
MASEDVKSTSESAVKTIVNLAEEAKLAREGVRAPGHALLSICKSLVAGGVAGGVSRTAVAPLERLKILLQVQNPHNIKYNGTIQGLKYIWRTEGFRGLFKGNGTNCARIVPNSAVKFFSYEQASSGILWLYRRQSGNEDAKLTPVLRLGAGACAGIIAMSATYPMDMVRGRITVQTEKSPYQYRGMFHALGTVYREEGFRALYKGWLPSVIGVIPYVGLNFAVYESLKDWLIKSRPLGLVEDSELSVVTKLACGAVAGTVGQTVAYPLDVIRRRMQMVGWNHAASVVAGQGRSKAPLEYTGMVDAFRKTVHNEGFGALYKGLVPNSVKVVPSIAIAFVTYEVVKDILGVEMRISD

SEQ ID NO: 8558 - protein, 355 aa, Cajanus cajan
MASENVKTGESAVTTIVNLAEEAKLAREGVVKAPSYALGSICKSLVAGGVAGGVSRTAVAPLERLKILLQVQNPHNIKYNGTIQGLKYIWRTEGFRGLFKGNGTNCARIVPNSAVKFFSYEQASKGILYLYQQQTGNEDAQLTPLLRLGAGACAGIIAMSATYPMDMVRGRITVQTEASPYQYRGMFHALSTVLREEGPRALYKGWLPSVIGVIPYVGLNFAVYESLKDWLLKSNPFGLVENSELSVTTRLACGAAAGTVGQTVAYPLDVIRRRMQMVGWNHAASVLTADGRSKVPLEYTGMIDAFRKTVQHEGFGALYKGLVPNSVKVVPSIAIAFVTYEVVKDVLGVEIRISD

SEQ ID NO: 8559 - protein, 355 aa, Glycine max
MASENVKTGDSAVTTIVNLAEEAKLAREGVVKAPSYALASICKSLVAGGVAGGVSRTAVAPLERLKILLQVQNPHNIKYNGTVQGLKYIWRTEGFRGLFKGNGTNCARIVPNSAVKFFSYEQASKGILHLYKQQTGNEDAQLTPLLRLGAGACAGIIAMSATYPMDMVRGRITVQTEASPYQYRGMFHALSTVLREEGARALYKGWLPSVIGVIPYVGLNFAVYESLKDYLIKSNPFDLVENSELSVTTRLACGAAAGTVGQTVAYPLDVIRRRMQMVGWNHAASVLTGDGRGKVPLEYTGMIDAFRKTVQHEGFGALYKGLVPNSVKVVPSIAIAFVTYEVVKDVLGVEIRISD

SEQ ID NO: 8560 - protein, 354 aa, Fagus grandifolia
MASEDVKTSESAVSTIVNLAEEAKLAREGVKAPSYAVLSICKSLVAGGVAGGVSRTAVAPLERLKILLQVQNPHNIKYNGTIQGLKYIWRTEGFRGLFKGNGTNCARIVPNSAVKFFSYEQASKGILHLYQQQTGNEDAQLTPLLRLGAGACAGIIAMSATYPMDMVRGRLTVQTENSPYQYRGIFHALSTVLREEGPRALYRGWLPSVIGVVPYVGLNFAVYESLKDWLVKARPFGLVQDSELSVTTRLACGAAAGTVGQTIAYPLDVIRRRMQMVGWNNAASVITGDGRSKAPLEYTGMVDAFRKTVRHEGFGALYKGLVPNSVKVVPSIAIAFVTYEVVKDILGVEIRISD

SEQ ID NO: 8561 - protein, 357 aa, Unknown
  Sequence found in Organisms: Solanum tuberosum, Solanum phureja
MASEDVVGKRSESAVTTIVNLAEEAKMASEGVKAPSHAAIFSVCKSLAAGGIAGGVSRTAVAPLERLKILLQVQNSHSIKYNGTVQGLKYIWRTEGLRGMFKGNGTNCARIVPNSAVKFFSYEEASKGILWFYRQQTGNEDAELTPLLRLGAGACAGIIAMSATYPMDLVRGRITVQTDKSPSQYRGIFHALRTVFVEEGPRALYKGWLPSVIGVIPYVGLNFAVYESLKDWLVKTRPFGLAQDTELSVMTKLGCGAVAGTIGQTVAYPLDVIRRRMQMGGWKNAASVVIGDGKSNAPIEYSGMIDAFRKTVRHEGVGALYKGLVPNSVKVVPSIAIAFVTYEVVKDILGVEMRISD

SEQ ID NO: 8562 - protein, 356 aa, Prunus persica
MASEDVKRTSETAVSTIVNLAEEAKLASEGVKAPTSHALLSIAKSLVAGGVAGGVSRTAVAPLERLKILLQVQNPHSIKYSGTIQGLKYIWRTEGLRGLFKGNGTNCARIVPNSAVKFFSYEEASKGILWFYRQQTGNEDAQLTPLLRLGAGACAGIIAMSATYPMDMVRGRLTVQTERSPRQYRGIAHALSTVFREEGPRALYRGWLPSVIGVVPYVGLNFAVYESLKDWLIKTRPFGLVEDSELSVTTRLACGAAAGTVGQTVAYPLDVIRRRMQMVGWKDAASVVVGDGKSKAPLEYTGMVDAFRKTVRHEGFGALYKGLVPNSVKVVPSIAIAFVTYEVVKDVLGVEMRISD

SEQ ID NO: 8563 - protein, 355 aa, Glycine max
MASENVKTGDSAVTTIVNLAEEAKLAREGVVKAPSYALASICKSLVAGGVAGGVSRTAVAPLERLKILLQVQNPHNIKYNGTVQGLKYIWRTEGFRGLFKGNGTNCARIVPNSAVKFFSYEQASKGILHLYQQQTGNEDAQLTPLLRLGAGACAGIIAMSATYPMDMVRGRITVQTEASPYQYRGMFHALSTVLREEGPRALYKGWLPSVIGVIPYVGLNFAVYESLKDYLIKSNPFGLVENSELSVTTRLACGAAAGTVGQTVAYPLDVIRRRMQMVGWNHAASVLTGDGRGKVPLEYTGMVDAFRKTVQHEGFGALYKGLVPNSVKVVPSIAIAFVTYEVVKDILGVEIRISD

SEQ ID NO: 8564 - protein, 351 aa, Mesembryanthemum crystallinum
  misc_feature (85)..(85): Xaa can be any naturally occurring amino acid
  misc_feature (97)..(97): Xaa can be any naturally occurring amino acid
MASEDVKTSESAVSTIVNLAEEAKIAREGVKAPSYAILSICKSLVAGGVAGGVSRTAVAPLERMKILLQVQNSHSIKYNGTIQGXKYIWSTEGVRGXFKGNGTNCARIVPNSAVKFFSYEQASKGILWLYRQQTGNEDAELTPLLRLGAGACAGIIAMSATYPMDLARGRITVQTEKSAYQYRGMFHALSTVLREEGARALYKGWLPSVIGVIPYVGLNFAVYESLKDWLVKARPFGLVEDTELSVTTRLGCGAVAGTIGQTVAYPLDVIRRRMQMGGWKDASSIVTGGKAPVQYEGMIDAFRQTVRHDGFGALYKGLVPNSVKVVPSIAIAFVTYEVVKDVLGVEMRISD

SEQ ID NO: 8565 - protein, 358 aa, Cannabis sativa
MASEDAVTKTTSESAVTTIVNLAEEAKHASEGVKAPSHAFISVGKSLIAGGVAGGVSRTAVAPLERLKILLQVQNPHSIKYNGTVQGLKYIWRTEGLRGLFKGNGTNCARIVPNSAVKFYSYEQASKSILWFYRQQTGNEEAQLTPLLRLGAGACAGIIAMSATYPMDMVRGRLTVQTEKSPHQYRGIFHALSTVLREEGFRALYRGWLPSVIGVVPYVGLNFAVYESLKDYLVKTKPFGLVNDSGELSVTTRLACGAAAGTVGQTIAYPLDVIRRRMQMVGWKDASSIVTGDGKGKPSLEYTGMVDAFRKTVRYEGFGALYKGLVPNSVKVVPSIAIAFVTYEVVKDILGVEMRISD

SEQ ID NO: 8566 - protein, 355 aa, Phaseolus coccineus
MASENVKTGESAVTTIVNLAEEAKLAREGVVKAPSYAFATICKSLVAGGVAGGVSRTAVAPLERLKILLQVQNPHNIKYNGTIQGLKYIWRTEGLRGLFKGNGTNCARIVPNSAVKFFSYEQASKGILYMYQQQTGNEDAQLTPLLRLGAGACAGIIAMSATYPMDMVRGRITVQTEASPYQYRGMFHALSTVLREEGPRALYKGWLPSVIGVIPYVGLNFAVYESLKDWLVKSNAFGLADNSELSVTTRLACGAAAGTVGQTVAYPLDVIRRRMQMVGWNHAASVLTGDGRGKVPLEYTGMVDAFRKTVQHEGFGALYKGLVPNSVKVVPSIAIAFVSYEMVKDILGVEIRISD

SEQ ID NO: 8567 - protein, 354 aa, Unknown
  Sequence found in Organisms: Gossypium hirsutum, Gossypium raimondii
MASEDVKTSESAVSTIVNLAEEAKLAREGVKAPSYAILSICKSLVAGGVAGGLSRTAVAPLERLKILLQVQNPHSIKYNGTVQGLKYIWRTEGFRGLFKGNGTNCARIVPNSAVKFFSYEQASKGILYLYQQQTGNEDAQLTPLLRLGAGACAGIIAMSATYPMDMVRGRLTVQTDSSPFQYRGMFHALSTVLRQEGPRALYKGWLPSVIGVIPYVGLNFAVYESLKDWLIKNKQFGFAEDSELSVTTRLACGAAAGTVGQTVAYPLDVIRRRMQMVGWKDAASVVTGDGRNKAPLEYTGMIDAFRKTVRHEGFGALYKGLVPNSVKVVPSIAIAFVTYEVVKDILGVEIRISD

SEQ ID NO: 8568 - protein, 354 aa, Citrullus lanatus
MASEDVKRSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASRGILYFYREQTGEQDAQLTPLLRLGAGACAGIIAMSATYPMDMVRGRLTVQTDKSPYQYRGIFHALSTVLREEGPRALYKGWLPSVIGVVPYVGLNFAVYESLKDWLIKNKPFGIVEDSELSVTTRLACGAAAGTVGQTVAYPLDVIRRRMQMVGWNNAASVVTGDGRSKAALEYTGMVDAFRKTVRYEGFRALYKGLVPNSVKVVPSIAIAFVTYEMVKDVLGVEIRISD

SEQ ID NO: 8569 - protein, 350 aa, Amorphophallus konjac
GKRTGESAVTTIVNLAEEAKLAREGVKAPGHAIFSVCKSLVAGGVAGGVSRTAVAPLERLKILLQVQNPHSIKYNGTIQGLKCIWKTEGFRGLFKGNGTNCARIVPNSAVKFFSYEQAASGILLLYRQQTGNEDAQLTPILRLGAGACAGIIAMSATYPMDMVRGRITVQTEKSPYQYRGMFHALTTVYRQEGFRALYKGWLPSVIGVIPYVGLNFAVYESLKDWLIKCNPYGLVEDNELSVTTRLACGAAAGTVGQTVAYPLDVIRRRMQMVGWKDAASIVTGQGRSKVPLEYSGMIDAFKKTIRDEGFGALYKGLVPNSVKVVPSIAIAFVTYEVVKDVLGVEVRISD

SEQ ID NO: 8570 - protein, 354 aa, Populus trichocarpa
MASEDVKTSESAVSTIVNFAEEAKLAREGVKAPGPALLSICKSLVAGGVAGGVSRTAVAPLERLKILLQVQNPHSIKYNGTIQGLKYIWRTEGLRGMFKGNGTNCARIVPNSAVKFFSYEEASKRILWFYRQQTGNDDAQLTPLLRLGAGACAGIIAMSATYPMDMVRGRLTVQTDKSPRQYRGIAHALSTVLKEEGPRALYKGWLPSVIGVIPYVGLNFSVYESLKDWLLKTNPFGLVEDNELGVTTRLACGAAAGTVGQTVAYPLDVIRRRMQMVGWKDAASVVTGDGRSKAPREYSGMVDAFRKTVRHEGFGALYKGLVPNSVKVVPSIAIAFVTYEMVKDVLGVEMRISD

SEQ ID NO: 8571 - protein, 221 aa, Allium cepa
MASEDVAGKSTGESAVNTIVSLAEDAKMVREGVKAPGHALLSICKSLVAGGVAGGVSRTAVAPLERLKILLQVQNPHNIQYNGTIQGLKYIWRTEGLRGLFKGNGTNCARIVPNSAVKFFSYEQASSAILWLYRQQSGNEDAQLSPVLRLGAGACAGIIAMSATYPMDMVRGRITVQTANSPYQYTGMFNALGTVYRQEGFRALYKGWLPSVIWSCTICWP

SEQ ID NO: 8572 - protein, 357 aa, Catharanthus roseus
MASEDVVGKRGESAVTTIVNLAEEAKIASEGVKAPSKLAVLSICKSLAAGGIAGGVSRTAVAPLERLKILLQVQNPHNIKYNGTVQGLKYIWRTEGFRGLFKGNGTNCARIVPNSAVKFFSYEEASKGILWLYRRQTGNVDAELTPLLRLGAGACAGIIAMSATYPMDMVRGRLTVQTDKSPTQYRGIFHALRTVLAEEGPRALYRGWLPSVIGVVPYVGLNFAVYESLKDWLVKSRPFGLDKDSELSVTTKLACGAAAGTVGQTVAYPLDVIRRRMQMVGWKDAASVVTGDGKSKAPLEYTGMVDAFRKTVRHEGFGALYKGLVPNSVKVVPSIAIAFVTYEVVKDILGVEMRISD

SEQ ID NO: 8573 - protein, 355 aa, Trifolium pratense
  misc_feature (39)..(39): Xaa can be any naturally occurring amino acid
MASEDVKTGESAVTKIVNLAEEAKLAREGVVKAPNYAIXSICKSLVAGGVAGGVSRTAVAPLERMKILLQVQNPHNIKYNGTIQGLKYIWRTEGFRGLFKGNGTNCARIVPNSAVKFFSYEQASKGILHLYQQQTGNEDAQLTPVLRLGAGACAGIIAMSATYPMDMVRGRITVQTEKSPYQYRGMFHALTTVLKEEGPRALYKGWLPSVIGVVPYVGLNFAVYESLKDWLIKSRPFGLVQDSELSVTTRLACGAAAGTIGQTVAYPLDVIRRRMQMTGWSHAASVITGDGRGKVPLEYTGMIDAFRKTVRHEGFGALYKGLVPNSVKVVPSIALAFVSYEMVKDILGVEIRISD

SEQ ID NO: 8574 - protein, 357 aa, Solanum lycopersicum
MASEDVVGKRSESAVTTIVNLAEEAKMASEGVKAPSHAAIFSVCKSLAAGGIAGGVSRTAVAPLERLKILLQVQNSHSIKYNGTVQGLKYIWRTEGLRGMFKGNGTNCARIVPNSAVKFFSYEEASKGILWFYRQQTGNEDAELTPLLRLGAGACAGIIAMSATYPMDLVRGRITVQTDKSPSQYRGIFHALRTVFVEEGPRALYKGWLPSVIGVIPYVGLNFAVYESLKDWLVKTRPFGLAQDTELSVMTKLGCGAVAGTIGQTVAYPLDVIRRRMQMGGWKNAASVVIGDGKTNAPVEYSGMVDAFRKTVRHEGVGALYKGLVPNSVKVVPSIAIAFVSYEVVKDILGVEMRISD

SEQ ID NO: 8575 - protein, 92 aa, Phaseolus coccineus
MASENVKTGESAVTTIVNLAEEAKLAREGVVKAPSYAFATICKSLVAGGVAGGVSRTAVAPLERLKILLQVQNPHNIKYNGTNTRPKIYMEN

SEQ ID NO: 8576 - protein, 354 aa, Gossypium raimondii
MASEDVKTSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASKGILYLYRQQTGDDDAQLTPLLRLGAGACAGIIAMSATYPMDMVRGRLTVQTDSSPFQYRGMFHALSTVLREEGPRALYKGWLPSVIGVIPYVGLNFAVYESLKDWLIKSKAFGLVEDSELSVTTRLACGAAAGTVGQTVAYPLDVIRRRMQMVGWKEAASVVTGDGRNKASLEYTGMIDAFRKTVRHEGFGALYKGLVPNSVKVVPSIALAFVTYEVVKDILGVEIRISD

SEQ ID NO: 8577 - protein, 354 aa, Unknown
  Sequence found in Organisms: Gossypium hirsutum, Gossypium raimondii
MASEDVKTSESAVSTIVNLAEEAKLAREGVKAPSYAILSICKSLAAGGVAGGVSRTAVAPLERLKILLQVQNPHSIKYNGTIQGLKYIWRTEGFRGLFKGNGTNCARIVPNSAVKFFSYEQASKGILYLYQQQTGNEDAQLTPLLRLGAGACAGIIAMSATYPMDMVRGRITVQTESSPYQYRGMFHALSTVLREEGPRALYKGWLPSVIGVIPYVGLNFSVYESLKDWLIKSRPFGLVEDSELSVTTRLACGAAAGTVGQTVAYPLDVIRRRMQMVGWKDAASVVSGDGRNKASLEYTGMIDAFRKTVRHEGFGALYKGLVPNSVKVVPSIAIAFVSYEVVKDILGVEIRISD

SEQ ID NO: 8578 - protein, 354 aa, Theobroma cacao
MASEDVKTSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASKGILYLYQQQTGNEDAQLTPLLRLGAGACAGIIAMSATYPMDMVRGRLTVQTERSPYQYRGMIHALSTVLREEGPRALYKGWLPSVIGVIPYVGLNFAVYESLKDWLIKSKPFGLVEDSELSVTTRLACGAAAGTVGQTVAYPLDVIRRRMQMVGWKDAASVVTGDGRNKGPLEYTGMIDAFRKTVRHEGFGALYKGLVPNFVKVVPSIAIAFVTYEVVKDILGVEIRISD

SEQ ID NO: 8579 - protein, 354 aa, Manihot esculenta
MASEDVKTTESAVTTIVNLAEEAKLARGGVKAPSYAVLSICKSLVAGGVAGGVSRTAVAPLERLKILLQVQNPHNIKYNGTIQGLKYIWRTEGFRGLFKGNGTNCARIVPNSAVKFFSYEEASKGILWLYRQQPGNEDARLTPLLRLGAGACAGIIAMSATYPMDMVRGRLTVQTEKSPYQYRGMFHALSTVLREEGPRALYKGWLPSVIGVIPYVGLNFAVYESLKDWLIKAKPFGLVQDSDLSVTTRLACGAAAGTVGQTVAYPLDVIRRRMQMVGWKDAASIVTGDGRSKASLEYNGMVDAFRKTVRYEGFGALYKGLVPNSVKVVPSIAIAFVTYEVVKDILGVEIRISD

SEQ ID NO: 8580 - protein, 355 aa, Ricinus communis
MASEDVKTRSEAAVSKIVNLAEEAKLAREEIKAPSHALFSICKSLIAGGVAGGVSRTAVAPLERLKILLQVQNPHSIKYNGTIQGLKYIWRTEGFRGLFKGNGTNCARIVPNSAVKFFSYEEASKGILWMYRQQTGNDDAQLTPLLRLGAGACAGIIAMSATYPMDMVRGRLTVQTEASPRQYKGIFHALSTVLKEEGPRALYRGWLPSVIGVVPYVGLNFAVYESLKDWLLKSKPFGLVQDNELGVATRLACGAAAGTVGQTVAYPLDVIRRRMQMVGWKDAASVITGDGKTKAPLEYTGMVDAFRKTVRHEGFGALYKGLVPNSVKVVPSIAIAFVTYELVKDVLGVEVRISD

SEQ ID NO: 8581 - protein, 355 aa, Cleome gynandra
MASEDVKTSESAAVSTIVNLAEEAKLAREGVKAPGYAFLSVCKSLVAGGVAGGVSRTAVAPLERLKILLQVQNPHSIKYNGTIQGLKYIWRTEGFRGLFKGNGTNCARIVPNSAVKFFSYEQASKGILYMYRKQTGDENAQLTPVLRLGAGATAGIIAMSSVYPMDMVRGRLTVQTANSPYQYRGMFHALSTVLREEGPRALYRGWLPSVIGVVPYVGLNFAVYESLKDWLVKANPYGLVQDSELSVTTRLACGAVAGTVGQTIAYPLDVIRRRMQMVGWKDASSIVTGDGRSKASLEYNGMIDAFRKTVRHEGFGALYKGLVPNSVKVVPSIALAFVTYEVVKDLLGVEFRISD

SEQ ID NO: 8582 - protein, 354 aa, Gossypium hirsutum
MASEDVKTSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASKGILYLYRQQTGDNDAQLTPLLRLGAGACAGIIAMSATYPMDMVRGRLTVQTDNSPFQYRGMFHALSTVLREEGPRALYKGWLPSVIGVIPYVGLNFAVYESLKDWLIKSKAFGLVEDSELSVTTRLACGAAAGTVGQTVAYPLDVIRRRMQMVGWKEAASVVTGDGRNKASLEYTGMIDAFRKTVRHEGFGALYKGLVPNSVKVVPSIALAFVTYEVVKDILGVEIRISD

SEQ ID NO: 8583 - protein, 354 aa, Cucumis sativus
MASEDVKRSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASRGILYFYREQTGDQDAQLTPLLRLGAGACAGIIAMSATYPMDMVRGRLTVQTDKSPYQYRGIFHALSTVLREEGPRALYKGWLPSVIGVVPYVGLNFAVYESLKDWLIKNKPFGLVDDSELSVTTRLACGAAAGTVGQTVAYPLDVIRRRMQMVGWNNAASVVTGDGRSKASLEYTGMVDAFRKTVRYEGFRALYKGLVPNSVKVVPSIAIAFVTYEMVKDVLGVEIRISD

SEQ ID NO: 8584 - protein, 354 aa, Eucalyptus grandis
MASEDVKASEKAVSTIVNLAEEAKLAREGVKAPSYAVLSICKSLVAGGVAGGVSRTAVAPLERLKILLQVQNPHSIKYNGTVQGLKYIWRTEGFRGLFKGNGTNCARIVPNSAVKFFSYEQASKGILLLYQQQTGNEDAQLTPPLRLGAGACAGIIAMSATYPMDLVRGRLTVQTENSPYQYRGMFHALSSVLREEGPRALYKGWLPSVIGVIPYVGLNFAVYESLKEWLIKNRPFGLMEDSELSVTTRLACGAVAGTVGQTVAYPLDVIRRRMQMVGWNNASSIVTGDGRAKAALEYNGMVDAFRKTVKYEGFGALYKGLVPNSVKVVPSIAIAFVTYEMVKDILGVEIRISD

SEQ ID NO: 8585 - protein, 354 aa, Euphorbia peplus
MASEDVKATESAVTKIVNLAEEAKLAREGVKAPSYAFLTICKSLFAGGVAGGVSRTAVAPLERLKILLQVQNPHNIKYNGTIQGLKYIWRTEGFRGLFKGNGTNCARIVPNSAVKFFSYEQASKGILLLYQQQTGNDDAQLTPLLRLGAGACAGIIAMSATYPMDMVRGRLTVQTDKSPYQYRGMFHALSTVLRQEGPRALYKGWLPSVIGVVPYVGLNFAVYESLKDWLIKSRPFGLVQDSELSVTTRLACGAAAGTLGQTVAYPLDVIRRRMQMVGWKDAASVVTGDGRSKTPLQYTGMIDAFRKTVQYEGFGALYKGLVPNSVKVVPSIAIAFVTYEMVKDVLGVQIRISD

SEQ ID NO: 8586 - protein, 354 aa, Cucumis melo
MASEDVKRSESAVSTIVNLAEEAKLAREGVKAPSYAVLSICKSLVAGGVAGGVSRTAVAPLERLKILLQVQNPHSIKYNGTIQGLKYIWRTEGFRGLFKGNGTNCARIVPNSAVKFFSYEQASRGILYFYREQTGDHDAQLTPLLRLGAGACAGIIAMSATYPMDMVRGRLTVQTDKSPYQYRGIFHALSTVLREEGPRALYKGWLPSVIGVVPYVGLNFAVYESLKDWLIKNKPFGLVEDSELSVTTRLACGAAAGTVGQTVAYPLDVIRRRMQMVGWNNAASVVTGDGRSKAPLEYTGMVDAFRKTVRYEGFSALYKGLVPNSVKVVPSIAIAFVTYEMVKDVLGVEIRISD

SEQ ID NO: 8587 - protein, 354 aa, Populus trichocarpa
MASEDVKASESAVSTIVNLAEEAKLAREGVKAPGTALLNICKSLFAGGVAGGVSRTAVAPLERLKILLQVQNPHSIKYNGTIQGLKYIWRTEGLRGMFKGNGTNCARIVPNSAVKFFSYEEASKGILWFYRRQTGNDDAQLTPLLRLGAGACAGIIAMSATYPMDMVRGRLTVQTDKSPRQYRGIAHALSTVLKEEGPRALYKGWLPSVIGVIPYVGLNFAVYESLKDWLLKTKPFGLVEDNELGVATRLACGAAAGTFGQTVAYPLDVIRRRMQMVGWKDAASVVTGDGRGKTALEYTGMVDAFRKTVRHEGFGALYKGLVPNSVKVIPSIAIAFVTYEMVKDVLRVETRISD

SEQ ID NO: 8588 - protein, 354 aa, Gossypium hirsutum
MASEDVKTSESAVSTIVNLAEEAKLAREGVKAPSYAILSICKSLAAGGVAGGVSRTAVAPLERLKILLQVQNPHSIKYNGTIQGLKYIWRTEGFRGLFKGNGTNCARIVPNSAVKFFSYEQASKGILYLYQRQTGNEDAQLTPLLRLGAGACAGIIAMSATYPMDMVRGRITVQTESSPYQYRGMFHALSTVLREEGPRALYKGWLPSVIGVIPYVGLNFSVYESLKDWLIKSRPFGLVEDSELSVTTRLACGAAAGTVGQTVAYPLDVIRRRMQMVGWKDAASVVSGDGRNKASLEYTGMIDAFRKTVRHEGFGALYKGLVPNSVKVVPSIAIAFVSYEVVKDILGVEIRISD

SEQ ID NO: 8589 - protein, 352 aa, Eschscholzia californica
MASEDVKTTSETAVSTIVNLAEEASEGVKAPSHAILSICKSLVAGGVAGGVSRTAVAPLERMKILLQVQNPHNIKYNGTIQGLKYIWKTEGFRGLFKGNGTNCARIVPNSAVKFFSYEQASQGILWLYRQQTGNEDAPLTPLLRLGAGACAGIIAMSATYPMDMVRGRITVQTEKSPSQYRGMFHALSTVLREEGPRALYKGWLPSVIGVVPYVGLNFAVYESLKDWLIKTRPFGLVEDTELSVTTRLACGAAAGTVGQTVAYPLDVIRRRMQMVGWHNASSIVAGDGRTKSALEYTGMVDAFRKTVRNEGLRALYKGLIPNSVKVVPSIAIAFVTYEQVKDVLGVEMRISD

SEQ ID NO: 8590 - protein, 354 aa, Ricinus communis
MASEDVKTTESAVTTIVNLAEEAKLAREGVKAPSYAVLSICKSLVAGGVAGGVSRTAVAPLERLKILLQVQNPHNIKYNGTIQGLRYIWKTEGFRGLFKGNGTNCARIVPNSAVKFFSYEEASKGILYLYRQQTGNEDAQLTPLLRLGAGACAGIIAMSATYPMDMVRGRLTVQTDKSPYQYRGMFHALSTVLREEGPRALYKGWLPSVIGVIPYVGLNFAVYESLKEWLIKAKPFGLVQDSDLSVTTRLACGAAAGTVGQTVAYPLDVIRRRMQMVGWKDASSIVIGDGRSKSSLEYTGMIDAFRKTVRYEGFGALYKGLVPNSVKVVPSIAIAFVTYEVVKDILGVEIRISD

SEQ ID NO: 8591 - protein, 354 aa, Catharanthus roseus
MASEDVKTSESAVSKIVNLAEEAKLAREEIKPTSHAVISICKSLVAGGVAGGVSRTAVAPLERLKILLQVQNPHNIKYNGTVQGLKYIWRTEGFRGLFKGNGTNCARIVPNSAVKFFSYEQASKGILWLHRQQTGNEDAELTPLLRLGAGACAGIIAMSATYPMDMVRGRLTVQTEKSPYQYRGMFHALSTVLREEGPRALYKGWLPSVIGVIPYVGLNFAVYESLKDWLVKTNSFGLAEDSELGVTTRLACGAVAGTVGQTVAYPLDVIRRRMQMVGWKDADAIVTGDGRSRAPLEYNGMVDAFRKTVRHEGFRALYKGLVPNSVKVVPSIAIAFVTYEQVKDLLGVEIRISD

SEQ ID NO: 8592 - protein, 355 aa, Vigna unguiculata
MGSENVKTGESAVTTIVNLAEEAKLAREGVVKAPNYALASICKSLVAGGVAGGVSRTAVAPLERLKILLQVQNPHNIKYNGTIQGLKYIWRTEGLRGLFKGNGTNCARIVPNSAVKFFSYEQASKGILYMYQQQTGNEDAQLTPVLRLGAGACAGIIAMSATYPMDMVRGRITVQTEASPYQYRGMFHALSTVLREEGPRALYKGWLPSVIGVIPYVGLNFAVYESLKDWLVKSNAFGLADNSELSVTTRLACGAAAGTVGQTVAYPLDVIRRRMQMVGWNHAASVLTGDGRGKVPLEYTGMVDAFRKTVQHEGFGALYKGLVPNSVKVVPSIAIAFVTYEMVKDILGVEIRISD

SEQ ID NO: 8593 - protein, 356 aa, Lotus japonicus
MASEDVKTTGESAVTKIVSLAEEAKLAREGVVKAPNYALASICKSLVAGGVAGGVSRTAVAPLERLKILLQVQNPHNIKYNGTIQGLKYIWRTEGFRGLFKGNGTNCARIVPNSAVKFFSYEQASKGILYMYQQQTGNEDAQLTPVLRLGAGACAGIIAMSATYPMDMVRGRITVQTEKSPYQYRGMFHALSTVLREEGPRALYKGWLPSVIGVIPYVGLNFAVYESLKEWLIESKPFGLVQDSELSVTTRLACGAAAGTVGQTVAYPLDVIRRRMQMVGWNHAASVLTGDGRGKVPLEYTGMVDAFRKTVRHEGFGALYKGLVPNSVKVVPSIALAFVTYEVVKDILGVEIRISD

SEQ ID NO: 8594 - protein, 355 aa, Quercus alba
MASEDVKTSESAVSTIVNLAEEAKLAREGVVKARSQAVLSICKSLVAGGVAGGLSRTAVAPLERLKILLQVQNPHNIKYNGTIQGLKYIWRTEGFRGLFKGNGTNCARIVPNSAVKFFSYEQASKGILYMYQQQTGNEDAQLTPLLRLGAGACAGIIAMSATYPMDMVRGRLTVQTENSPYRYRGMFHALSTVLREEGPRALYKGWLPSVIGVIPYVGLNFAVYESLKDWLVKAKPFGLIEDSELSVTTRLACGAAAGTVGQTVAYPLDVIRRRMQMVGWNNAASVITGDGRSAAPLEYTGMIDAFRKTVRHEGFGALYKGLVPNSVKVVPSIAIAFVTYEVVKDILGVEIRISD

SEQ ID NO: 8595 - protein, 353 aa, Brassica napus
MASEDVKSTESAAVSTIVNLAEEAKLAREGVKAPSHAVLSICKSLFAGGVAGGVSRTAVAPLERMKILLQVQNPHNIKYSGTVQGLKYIWRTEGVRGLFKGNGTNCARIVPNSAVKFFSYEQASKGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYNGMVDAFRKTVRHEGFGALYKGLVPNSVKVVPSIAIAFVTYEMVKDVLGVEFRISD

SEQ ID NO: 8596 - protein, 351 aa, Flaveria ramosissima
MASEDVVGKTSATIANLAEEAKIASEGVKAPSRHALLTICKSLVAGGVAGGVSRTAVAPLERLKILLQVQNPHAIKYNGTIQGLKYIWRTEGFRGLFKGNGTNCARIVPNSAVKFFSYEEASKGILWLYRQQPGNEDAELTPVLRLGAGACAGIIAMSATYPMDLVRGRLTVQTDKSPSQYRGIAHALGTVLREEGPRALYKGWLPSVIGVIPYVGLNFAVYESLKDWLIKSKPFGLAEDAELSVTTKLACGAAAGTVGQTVAYPLDVIRRRMQMVGWKHAASVVTADGKSALEYNGMVDAFRKTVRYEGFGALYKGLVPNSVKVVPSIAIAFVSYEVVKDLLGVEMRISD

SEQ ID NO: 8597 - protein, 356 aa, Medicago truncatula
MASEDVKSGESAVTKIVNLAEEAKLAREGVVKAKPNYAFGSICKSLVAGGVAGGVSRTAVAPLERMKILLQVQNPHNIKYSGTIQGLKYIWRTEGFRGLFKGNGTNCARIVPNSAVKFFSYEQASKGILHLYRQQTGNEDAQLTPVLRLGAGACAGIIAMSATYPMDMVRGRITVQTEKSPYQYRGMFHALSTVLREEGPRALYKGWLPSVIGVIPYVGLNFAVYESLKDYLIKTKPFGLAQDSELSVTTRLACGAAAGTIGQTVAYPLDVIRRRMQMTGWHNAASVITGDGVGKVPLEYTGMVDAFRKTVRHEGFGALYKGLVPNSVKVVPSIALAFVSYEMVKDILGVEIRISD

SEQ ID NO: 8598 - protein, 354 aa, Gossypium hirsutum
MASEDVKTSESAVSTIVNLAEEAKLAREGVKAPSYAILSICKSLAAGGVAGGVSRTAVAPLERLKILLQVQNPHSIKYNGTIQGLKYIWRTEGFRGLFKGNGTNCARIVPNSAVKFFSYEQASKGILYLHQRQTGNEDAQLTPLLRLGAGACAGIIAMSATYPMDMVRGRITVQTESSPYQYRGMFHALSTVLREEGPRALYKGWLPSVIGVIPYVGLNFSVYESLKDWLIKSRPFGLVEDSELSVTTRLACGAAAGTVGQTVAYPLDVIRRRMQMVGWKDAASVVSGDGRNKASLEYTGMIDAFRKTVRHEGFGALYKGLVPNSVKVVPSIAIAFVSYEVVKDILGVEIRISD

SEQ ID NO: 8599 - protein, 354 aa, Cucurbita pepo
MASEDVKRSESAVSTIVNLAEEAKLAREGVKAPSYALLSICKSLVAGGVAGGVSRTAVAPLERLKILLQVQNPHSIKYNGTIQGLKYIWRTEGFRGLFKGNGTNCARIVPNSAVKFFSYEQASRGILAFYREKTGDQDAQLTPLLRLGAGACAGIIAMSATYPMDMVRGRLTVQTDKSPYQYRGIFHALSTVLREEGPRALYKGWLPSVIGVIPYVGLNFAVYESLKDWLIKKRPFGLVEDSELSVTTRLACGAAAGTVGQTIAYPLDVIRRRMQMVGWNNAASVVTGDGRSKAALEYTGMIDAFRKTVRYEGFRALYKGLVPNSVKVVPSIAIAFVSYEMVKDVLGVEIRISD

SEQ ID NO: 8600 - protein, 354 aa, Mimulus guttatus
MASEDVKTSESAVSKIVNFAEEAKLAKEEIKPTKHQVYSICKSLVAGGVAGGVSRTAVAPLERLKILLQVQNPHNIKYNGTVQGLKYIYRTEGLRGLFKGNGTNCARIVPNSAVKFFSYEQASKGILYMYRQQTGNEDAQLTPLLRLGAGACAGIIAMSATYPMDMVRGRLTVQTDKSPYQYRGMFHALSTVLREEGFRALYKGWLPSVIGVVPYVGLNFAVYESLKDYLIKSKPYGIVEDNELGVVTRLGCGAAAGTVGQTIAYPLDVIRRRMQMVGWNNASSIITGDGRSKAPLEYTGMVDAFRKTVRHEGFRALYKGIVPNSVKVVPSIAIAFVTYEQVKELLGVEIRISD

SEQ ID NO: 8601 - protein, 357 aa, Quercus alba
MASEDAMSKTTGESAVSTIVNLAEEAKLASEGVKAPSHALLSICKSLIAGGVAGGVSRSAVAPLERLKILLQVQNPHSIKYNGTIQGLKYIWRTEGIRGMFKGNGTNCARIVPNSAVKFFSYEQASNGILWLHRRQSGNEEAQLTPLLRLGAGACAGIIAMSATYPMDMVRGRLTVQTENSPRQYRGIFHALSTVFREEGPRALYRGWLPSVIGVIPYVGLNFAVYESLKDWLIQTKPFGLAENSELSVTTRLACGAAAGTVGQTVAYPLDVIRRRMQMVGWKDASSVLTADGKSKASLEYTGMVDAFRKTVRHEGFGALYKGLVPNSVKVVPSIAIAFVTYEVVKDVLGVEMRISD

SEQ ID NO: 8602 - protein, 354 aa, Nicotiana tabacum
  misc_feature (245)..(245): Xaa can be any naturally occurring amino acid
MASEDVKAARDSAVEKIVNLAEEAKLAREEIKPTSHAVLSICKSLVAGGVAGGVSRTAVAPLERLKILLQVQNPHSIKYNGTIQGLKYIWRTEGFKGLFKGNGTNCARIVPNSAVKFFSYEQASKGILYLYRQQTGNEDAELTPLLRLGAGACAGIIAMSATYPMDMVRGRITVQTEKSPYQYRGMFHALSTVLREEGPRALYKGWTPSVIGVVPYVGLNFAVYESLKDWLIKTKPFGLVDDELXVVTRLACGAAAGTVGQTVAYPLDVIRRRMQMVGWNHAASIVAGDGRSKVPLEYTGMIDAFRKTVKYEGVRALYKGLVPNSVKVVPSISIAFVAYEQVKDLLGVEIRISD

SEQ ID NO: 8603 - protein, 353 aa, Brassica napus
MASEDVKSTESAAVSTIVNLAEEAKLAREGVKAPSHAVLSICKSLFAGGVAGGVSRTAVAPLERMKILLQVQNPHNIKYSGTVQGLKYIWRTEGVRGLFKGNGTNCARIVPNSAVKFFSYEQASKGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYTGMVDAFRKTVRHEGFGALYKGLVPNSVKVVPSIAIAFVTYEMVKDVLGVEFRISD

SEQ ID NO: 8604 - protein, 351 aa, Cirsium arvense
MASEDVVGKTSATIANIAEEAKIASEGVKAPSRQTLLGICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALRTVLREEGPRALYKGWLPSVIGVVPYVGLNFAVYESLKDWLVKSRPFGLVEDTELSVTTKLACGAVAGTIGQTVAYPLDVIRRRMQMVGWKDAASVVTGGGKSAVEYTGMIDAFRKTVRYEGVGALYKGLVPNSVKVVPSIAIAFVTYEVVKDVLKVEMRISD

SEQ ID NO: 8605 - protein, 289 aa, Raphanus sativus
MKILLQVQNPHNIKYSGTVQGLKYIWRTEGLRGLFKGNGTNCARIVPNSAVKFFSYEQASKGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYNGMVDAFRKTVRHEGFGALYKGLVPNSVKVVPSIAIAFVTYEMVKDVLGVEFRISD

SEQ ID NO: 8606 - protein, 354 aa, Tropaeolum majus
MASEDVKPSEAAVTTIVNLAEEAKLAREGVEAPSRAFLTICKSLVAGGVAGGVSRSAVAPLERLKILLQVQNPHSIKYNGTIQGLKYIWRTEGLRGMFKGNGTNCARIVPNSAVKFFSYEEASKGILWLYRQQTGNEDAQLTPVLRLGAGACAGIIAMSATYPMDLVRGRLTVQTANSPRQYSGIFNALSTVLREEGFRALYKGWLPSVIGVVPYVGLNFAVYESLKDWLVKSKPFGITEDNELSVTTRLGCGAVAGTFGQTVAYPLDVIRRRMQMVGWKGAASVVTGDGRSTSSLQYTGMVDAFKKTVRHEGFGALYKGLVPNSVKVVPSIAIAFVTYEMVKDVLGVELKISD

SEQ ID NO: 8607 - protein, 354 aa, Amsonia hubrichtii
MASEDVKTSESAVSKIVNLAEEAKLAREEIKPASHAVLSICKSLVAGGVAGGVSRTAVAPLERLKILLQVQNPHNIKYNGTVQGLKYIWRTEGFRGLFKGNGTNCARIVPNSAVKFFSYEQASKGILSLYQQQTGNEDAELTPLLRLGAGACAGIIAMSATYPMDMVRGRLTVQTEKSPYQYRGMFHALSTVLREEGPRALYKGWLPSVIGVIPYVGLNFAVYESLKDWLVKSRPFGLVEDTELGVTTRLACGAVAGTVGQTVAYPLDVIRRRMQMVGWKDASSIVTGDGRSKAPLEYNGMVDTFRKTVRHEGFRALYKGLVPNSVKVVPSIAIAFVTYEQVKDLLGVEIRISD

SEQ ID NO: 8608 - protein, 355 aa, Chelidonium majus
MASEDVVGKSTGETAVSTIVNLAEEAKLASEGVKAPAGHALLSVCKSLVAGGVAGGVSRTAVAPLERLKILLQVQNPHSIKYNGTIEGLKYIWRTEGFRGLFKGNGTNCARIVPNSAVKFFSYEEASRGILWIYRRQSGNEDATLTPLLRLGAGACAGIIAMSATYPMDMVRGRITVQTESSPYQYRGMYHAFSTILREEGPRALYRGWLPSVIGVVPYVGLNFAVYESLKDWLIKSKSEDSSELGITTRLMCGAAAGTVGQTVAYPLDVIRRRMQMVGWNNASSIVTGGGSSKAPLEYTGMVDAFRKTVRNEGFGALYKGLVPNSVKVVPSIAIAFVTYEMVKDVLGVEMRISD

SEQ ID NO: 8609 - protein, 354 aa, Cleome gynandra
MASEDVKTSESAVSTIVNLAEEAKLAREGVKAPSYAVLSICKSLVAGGVAGGVSRTAVAPLERLKILLQVQNPHNIKYNGTIQGLKYIWRTEGFRGLFKGNGTNCARIVPNSAVKFFSYEQASKGILYLYQQQTGNDEAELTPLLRLGAGACAGIVAMSATYPMDMVRGRLTVQTDKSPYQYRGMVHALSTVLREEGPRALYRGWLPSVIGVIPYVGLNFAVYESLKDWLVKTRPFGIVDDSGLTVTTRLACGAIAGTIGQTIAYPLDVVRRRMQMVGWKEASSVITGDGRAKAPLEYSGMIDAFRKTVRHEGVGALYKGLVPNSVKVVPSIAIAFVTYEKVKDLLGVEFRISD

SEQ ID NO: 8610 - protein, 354 aa, Euphorbia peplus
MASEDVKTGESAVSTIVNLAEEAKLAREGVKAPSHAIFSICKSLIAGGVAGGVSRTAVAPLERLKILLQVQNPHNIKYNGTIQGLKYIWRTEGFRGLFKGNGTNCARIVPNSAVKFFSYEEASKGILWFYRQKTGNDDAQLTPVLRLGAGACAGIIAMSATYPMDMVRGRLTVQTENSPRQYRGIAHALSTVFKEEGPRALYKGWLPSVIGVVPYVGLNFAVYESLKDYLLKHNTFGLVQDNELSVTTRLACGAAAGTVGQTVAYPLDVIRRRMQMVGWKDAASVVTGEGKSKAPLQYNGMVDTFKKTVRHEGFGALYKGLVPNSVKVVPSIAIAFVTYEMVKDVLGVEVRISD

SEQ ID NO: 8611 - protein, 354 aa, Vinca minor
MASEDVKASESAVSKIVNLAEEAKLAREEIKPTSQTVLSICKSLVAGGVAGGVSRTAVAPLERLKILLQVQNPHNIKYNGTVQGLKYIWRTEGFRGLFKGNGTNCARIVPNSAVKFFSYEQASKCILWLYQQQTGNEDAELTPLLRLGAGACAGIIAMSATYPLDMVRGRLTVQTEKSPYQYRGMFHALSTVLREEGTRALYKGWLPSVIGVIPYVGLNFAVYESLKDWLVKARPFGLAEDQELGVTTRLACGAVAGTMGQTVAYPLDVIRRRMQMVGWKDADAIVTGDGRIKAPLQYNGMVDAFRTTVRHEGFRALYKGLVPNSVKVVPSIAIAFVTYEQVKDLLGVEIRISD

SEQ ID NO: 8612 - protein, 353 aa, Brassica rapa
MASEDVKSTESAAVSTIVNLAEEAKLAREGVKAPSHAVLSICKSLFAGGVAGGVSRTAVAPLERMKILLQVQNPHNIKYSGTVQGLKYIWRTEGVRGLFKGNGTNCARIVPNSAVKFFSYEQASRGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYTGMVDAFRKTVRHEGFGALYKGLVPNSVKVVPSIAIAFVTYEMVKDVLGVEFRISD

SEQ ID NO: 8613 - protein, 351 aa, Centaurea maculosa
MASEDVVGKTSATIANIAEEAKIASEGVKAPSRQTLLGICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELSPLLRLGAGACAGIIAMSATYPMDLVRGRLTVQTDKSPSQYRGIAHALRTVLREEGPRALYKGWLPSVIGVVPYVGLNFAVYESLKDWLVKTRPFGLVKDTELSVTTKLACGAAAGTVGQTVAYPLDVIRRRMQMVGWKDAASVVTGDGKSALEYTGMIDAFRKTVRYEGFGALYKGLVPNSVKVVPSIAIAFVTYEVVKDVLKVEMRISD

SEQ ID NO: 8614 - protein, 353 aa, Brassica rapa
  misc_feature (73)..(73): Xaa can be any naturally occurring amino acid
MASEDVKSTESAAVSTIVNLAEEAKLAREGVKAPSHAVLSICKSLFAGGVAGGVSRTAVAPLERMKILLQVQXPHNIKYSGTVQGLKYIWRTEGVRGLFKGNGTNCARIVPNSAVKFFSYEQASKGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYTGMVDAFRKTVRHEGFGALYKGLVPNSVKVVPSIAIAFVTYEMVKDVLGVEFRISD

SEQ ID NO: 8615 - protein, 351 aa, Flaveria ramosissima
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILWLYRQQPGNEDAELTPVLRLGAGACAGIIAMSATYPMDLVRGRLTVQTDKSPSQYRGIAHALRTVLREEGPRALYKGWLPSVIGVIPYVGLNFAVYESLKDWLIKSKPFGLAEDAELSVTTKLACGAAAGTVGQTVAYPLDVIRRRMQMVGWKHAASVVTADGKSALEYNGMVDAFRKTVRYEGFGALYKGLVPNSVKVVPSIAIAFVSYEVVKDLLGVEMRISD

SEQ ID NO: 8616 - protein, 356 aa, Trigonella foenum-graecum
MASEDVKSGESAVTKIVNLAEEAKHAREGVVKAKPNYAIGSICKSLVAGGVAGGVSRTAVAPLERMKILLQVQNPHNIKYSGTIQGLKYIWRTEGLRGLFKGNGTNCARIVPNSAVKFFSYEQASKGILHLYKQQTGNEDAQLTPVLRLGAGACAGIIAMSATYPMDMVRGRITVQTENSPYQYRGMFHALSTVLREEGPRALYKGWLPSVIGVIPYVGLNFAVYESLKDYLIKSKPFGLAQDSELSVTTRLACGAAAGTIGQTVAYPLDVIRRRMQMTGWHNAASVITGDGVGKVPLEYTGMVDAFRKTVRHEGFGALYKGLVPNSVKVVPSIALAFVSYEMVKDILGVEIRISD

SEQ ID NO: 8617 - protein, 358 aa, Vinca minor
MASEDVVGKRRGDSAVTTIVNLAEEAKIASEGVKAPSKLAVLSICKSLAAGGIAGGVSRTAVAPLERLKILLQVQNPHSIKYNGTVQGLNYIWRTEGLRGLFKGNGTNCARIVPNSAVKFFSYEEASKGILWLHRRQAGNEDAELTPLLRLGAGACAGIIAMSATYPMDMVRGRLTVQTENSPTQYRGIFHALRTVFVEEGPRALYKGWVPSVIGVVPYVGLNFAVYESLKDYLVKNRPFGLEKNTELSVTTKLACGAAAGTVGQTVAYPLDVIRRRMQMVGWKDAASVVTGDGKGKAPLEYTGMVDAFRKTVRHEGFGALYKGLVPNSVKVVPSIAIAFVTYEVVKDILGVEMRISD

SEQ ID NO: 8618 - protein, 145 aa, Vaccinium corymbosum
MASEDVKTSESAVSTIVNLAEEAKLAREGVKPSYAVLSICKSLIAGGVAGGLSRTAVAPLERLKILLQVQNAHNIKYNGTVQGLKYIWRTEGLKGYSKAMVQIVLVLYRTQRSSSSAMSKLLRLSYCFTSSKLAMKMLSSLLYYA

SEQ ID NO: 8619 - protein, 355 aa, Beta vulgaris
MASEDVKQRGEAAAVSTIVNLAEEAKAATEGVKSPSHALISISKSLAAGGIAGGVSRTAVAPLERLKILLQVQNPHSIKYNGTVQGLKYIWQTEGLRGLFKGNGTNCARIVPNSAVKFFSYEQASKGILWLYRQQTGNEDAELTPVLRLGAGACAGIIAMSATYPMDLVRGRLTVQTDKSPQQYRGIYHALTTVFREEGARALYKGWLPSVIGVIPYVGLNFAVYESLKDYLVKENPFGLVQDKELSVTTRLACGAVAGTIGQTVAYPLDVVRRRMQMVGWKDASTVITGDGKKVALEYTGMVDAFRKTVRYEGFRALYKGLVPNSVKVVPSISIAFVTYEVVKDLLGVEMRISD

SEQ ID NO: 8620 - protein, 354 aa, Tropaeolum majus
MASEDVKTSESAVSTIVNLAEEAKLAREGVKAPSYAVLSICKSLVAGGVAGGVSRTAVAPLERLKILLQVQNPHSIKYNGTVQGLKYIWRTEGFRGLFKGNGANCARIVPNSAVKFFSYEQASKGILWLYQQQTGNKDAQLTPVLRLGAGACAGIIAMSATYPLDLVRGRLTVQTENSPYQYRGMYHALTSVLRQEGPRALYKGWLPSVIGVVPYVGLNFAVYESLKDWLIKAKPFGLLQDSELSVTTRLACGAAAGTVGQTVAYPLDVIRRRMQMVGWKDASSIVTGGGGSAAAHEYTGMIDAFRKTVRHEGFGALYKGLVPNSVKVVPSIAIAFVSYEVVKDILGVEIRISD

SEQ ID NO: 8621 - protein, 354 aa, Sesamum indicum
MASEDVKTSESAVSKIVNFAEEAKLAKEEIKPTKYQVYSICKSLVAGGVAGGVSRTAVAPLERLKILLQVQNPHNIKYNGTVQGLKYIWRTEGFRGLFKGNGTNCARIVPNSAVKFFSYEQASKGILYMYQQQTGNEDAQLTPVLRLAAGACAGIIAMSATYPMDMVRGRLTVQTEKSPYQYRGMFHALSTVLREEGFRALYKGWLPSVIGVVPYVGLNFAVYESLKDWLLKSNPYGLVEDNELGVVTRLACGAAAGTVGQTVAYPLDVIRRRMQMVGWSNASSIVAGDGRTKGPLEYTGMIDAFRKTVRHEGFRALYKGLVPNSVKVVPSIAIAFVTYEQVKELLGVEIRISD

SEQ ID NO: 8622 - protein, 354 aa, Eutrema parvulum
MASEDVKRTESAAVSTIVNLAEEAKLAREGVKAPSYAVLSICKSLFAGGVAGGVSRTAVAPLERMKILLQVQNPHNIKYSGTVQGLKYIWRTEGLRGLFKGNGTNCARIVPNSAVKFFSYEQASKGILYMYRQQTGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGDRSKGSLEYTGMVDAFRKTVRHEGFGALYKGLVPNSVKVVPSIAIAFVTYEMVKDVLGVEFRISD

SEQ ID NO: 8623 - protein, 351 aa, Ambrosia trifida
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILWLYRQQPGNEDAELTPVLRLGAGACAGIIAMSATYPMDLVRGRITVQTDKSSTQYRGITHALRTVLREEGPRALYKGWLPSVIGVIPYVGLNFAVYESLKDWLIKSRPYGLAEDAELSVVTKLACGAAAGTVGQTVAYPLDVIRRRMQMVGWKHAASVVTADGKSALEYTGMVDAFRKTVRYEGFGALYKGLVPNSVKVVPSIAIAFVSYEVVKDLLGVEMRISD

SEQ ID NO: 8624 - protein, 354 aa, Populus trichocarpa
MASEDVKASESAVTTIVNLAEEAKLAREGVKAPSLAILSICKSLVAGGVAGGVSRTAVAPLERMKILLQVQNPHNIKYNGTIQGLKYIWRTEGFHGLFKGNGTNCARIVPNSAVKFFSYEQASKGILYLYQQQTGNEDAQLTPLLRLGAGACAGIIAMSATYPLDMVRGRLTVQTEKSPHQYRGMFHALSTVLRQEGPRALYKGWLPSVIGVIPYVGLNFSVYESLKDWLVKARPSGLVEDSELNVTTRLACGAAAGTVGQTVAYPLDVIRRRMQMVGWKGAASIVTGDGRSKAPLEYTGMIDAFRKTVRHEGFGALYKGLVPNSVKVVPSIAIAFVTYEMVKDILGVQIRISD

SEQ ID NO: 8625 - protein, 351 aa, Helianthus annuus
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILWFYRQQPGNEDAELTPVLRLGAGACAGIIAMSATYPMDLVRGRLTVQTDKSPSQYRGIAHALATVLREEGPRALYKGWLPSVIGVVPYVGLNFAVYESLKDWLIKTKPYGIAEDAELSVTTKLACGAAAGTVGQTVAYPLDVIRRRMQMVGWKHAASVVTADGKSALEYTGMVDAFRKTVRYEGFGALYKGLVPNSVKVVPSIAIAFVSYEVVKDLLGVEMRISD

SEQ ID NO: 8626 - protein, 357 aa, Amsonia hubrichtii
MASEDVVGKRGESAVTTIVNLAEEAKIASEGVKAPSKIAVVSICKSLAAGGIAGGVSRTAVAPLERLKILLQVQNPHNIKYNGTVQGLKYIWRTEGFRGLFKGNGTNCARIVPNSAVKFFSYEEASKGILWLYRNQTGNDNAELTPVLRLGAGACAGIIAMSATYPMDMVRGRLTVQTDKSPTQYRGIFHALRTVFAEEGPRALYRGWLPSVIGVVPYVGLNFAVYESLKDWLVKSRPFGLEKDTELSVTTKLACGAAAGTVGQTVAYPLDVIRRRMQMVGWKDAASVVTGDGKIKAPLEYTGMVDAFRKTVRHEGFAALYKGLIPNSVKVVPSIAIAFVTYEVVKDILGVEVRISD

SEQ ID NO: 8627 - protein, 355 aa, Prunus persica
MASEDVKPSESAVSTIVNLAEEAKMAREGVVKAPSLAVLSVCKSLVAGGVAGGVSRTAVAPLERLKILLQVQNPHNIKYNGTIQGLKYIWRSEGFRGLFKGNGTNCARIVPNSAVKFFSYEQASKGILLLYRDQTGNEDAQLTPLLRLGAGACAGIIAMSATYPMDMVRGRLTVQTENSPFQYRGMFHALSTVLREEGPRALYKGWLPSVIGVVPYVGLNFAVYESLKDWLIKSRPFGLVEDTDLSVTTRLACGAAAGTVGQTVAYPLDVIRRRMQMGGWSNAASVITGDGRSKAPLEYTGMIDAFRKTVRHEGFGALYKGLVPNSVKVVPSIAIAFVTYEMVKDVLGVEIRISD

SEQ ID NO: 8628 - protein, 355 aa, Fragaria vesca
MASEDVKRSERAVSTIVNLAEEAKLAREGVVKAPSLAVLSVCKSLVAGGVAGGVSRTAVAPLERMKILLQVQNPHNIKYSGTVQGLKYIWRTEGFRGLFIGNGTNCARIVPNSAVKFFSYEQASKGILWMYREKTGNEDAQLTPLLRLGAGACAGIIAMSATYPMDMVRGRITVQTEASPYQYRGMFHALSTVLREEGPRALYKGWLPSVIGVVPYVGLNFAVYESLKDWLIKSRPFGLVQDTDLSVTTRLACGAAAGTVGQTVAYPLDVIRRRMQMVGWSHAASVVAGEGRSKAPLEYTGMIDAFRKTVRHEGFGALYKGLVPNSVKVVPSIALAFVSYEMVKDILGVEIRISD

SEQ ID NO: 8629 - protein, 333 aa, Arachis hypogaea
MASETKIVNLAEEAKLAREGVKAAPSYAFTSICKSLVAGGVAGGVSRTAVAPLERLKILLQVQNPHNIKYNGTVQGLKYIWRTEGFRGLFKGNGTNCARIVPNSAVKFFSYEQASKAILQLYQQKTGNEDAQLTPVLRLGAGACAGIIAMSATYPMDMVRGRITVQTEKSPYQYRGMFHALTTVLREEGPRALYKGWLPSVIGVVPYVGLNFAVYESLKDWLVKSNPFGLVQDSELSVTTRLACGAAAGTVGQTVAYPLDVIRRRMQMVGWNHAASVVAGDGRVKAPLEYTGMVDAFRKTVRYEGVGALYKGLVPNSVKVVPSIAIAFVHMRW

SEQ ID NO: 8630 - protein, 351 aa, Helianthus annuus
MTSEDVVGKTSVTIANIAEEAKIASEGVKAPSRQTLLGICKSLVAGGVAGGVSRTAVAPLERLKILLQVQNPHAIKYNGTIQGLKYIWRTEGFKGMFKGNGTNCARIVPNSAVKFFSYEEASKGILWLYRQQTGNDDAELTPLLRLGAGACAGIIAMSATYPMDLVRGRITVQTDKSSTQYRGIAHALTTVLREEGPRALYKGWLPSVIGVIPYVGLNFAVYESLKDYLVKSRPFGLVEDKELGVTTKLACGAVAGTFGQTVAYPLDVIRRRMQMVGWKHAASVVTGKGNSTLEYTGMIDAFRKTVRYEGFGALYKGLVPNSVKVVPSIAIAFVTYEVVKDVLKVEMRISD

SEQ ID NO: 8631 - protein, 354 aa, Manihot esculenta
MASEDVKTGDSAVSTIVNLAEEAKLAREGVKAPSYALQSICKSLIAGGVAGGVSRTAVAPLERLKILLQVQNPHSIKYNGTIQGLKYIWKTEGFRGMFKGNGTNCARIIPNSAVKFFSYEEASKRILIFYRKQTGNDDAQLTPLLRLGAGACAGIIAMSATYPMDMVRGRLTVQTEKSPRQYRGIFHALSTVLKEEGPRALYKGWLPSVIGVIPYVGLNFAVYESLKDFLLKSKPFGLVQDNELGVTTRLACGAAAGTVGQTVAYPLDVIRRRMQMVGWKDAASVVTGDGKSKAPLEYTGMIDAFRKTVRHEGFGALYKGLVPNSVKVVPSIAIAFVTYELVKDVLGVEVRISD

SEQ ID NO: 8632 - protein, 354 aa, Cleome spinosa
MASEDVNTSESAVSTIVNLAEEAKLTKEGVKAPSHAVLSICKSLVAGGVAGGVSRTAVAPLERLKILLQVQNPHSIKYNGTIQGLKYIWRTEGFRGLFKGNGTNCARIVPNSAVKFFSYEQASKGILYLYQQQTGNDEAELTPLLRLGAGACAGIIAMSATYPMDMVRGRLTVQTEKSPYQYRGMVHALSTVLREEGPRALYRGWLPSVIGVIPYVGLNFAVYESLKDWLVKARPFGIADNSELTVTTRLACGAVAGTIGQTVAYPLDVVRRRMQMVGWKDASTVITGDGRGKAPLEYSGMIDAFRKTVRHEGVGALYKGLVPNFVKVVPSIAIAFVAYEKVKDLLGVEFRISD

SEQ ID NO: 8633 - protein, 354 aa, Gossypium hirsutum
MASEDVKTSESAVSTIVNLAEEAKLAREGVKAPSYAVLSICKSLVAGGVAGGVSRTAVAPLERLKILLQVQNPHSVKYNGTIQGLKYIWRTEGFRGLFKGNGTNCARIVPNSAVKFFSYEQASKGILYLYQQQTGDDDAQLTPLLRLGAGACAGIIAMSTTYPMDMVRGRLTVQTDSSPYQYRGMFHALSTVLREEGPRALYKGWLPSVIGVIPYVGLNFAVYESLKDRLIKSKAFGLVEDSELSVTTRLACGAAAGTVGQTVAYPLDVIRRRMQMVGWKEAASVVTGDGRNKAPLVYTGMIDAFGKTVRHEGFGALYKGLAPNSVKVVPSIALAFVTYEVVKDILGVEIRISD

SEQ ID NO: 8634 - protein, 352 aa, Euonymus alatus
MASEDVKASESAVSTIVNLAEEAKLAREGVKAPSYAVLSICKSLVAGGVAGGVSRTAVAPLERLKILLQVQNPHSIKYNGTVQGLKYIWQTEGFRGLFKGNGTNCARIVPNSAVKFFSYEQASKAILLLYQQQTGNEDAQLTPVLRLGAGACAGIIAMSATYPMDMVRGRLTVQTEKSPFQYRGMFHALSTVLREEGPRALYKGWLPSVIGVIPYVGLNFAVYGSLKDWLVKANGLSEDSELSVVTRLACGAAAGTVGQTVAYPLDVIRRRMQMVGWKDAASIVTGEGRSKAQLEYNGMIDTFRKTVRLEGFGALYKGLVPNSVKVVPSIAIAFVSYEMIKDILGVEIKISD

SEQ ID NO: 8635 - protein, 351 aa, Flaveria ramosissima
MASEDVVGKTSATIANIAEEAKIASVGVKAPSRQTLMSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDYLVKSRPFGLVEDAELSVTTKLACGAVAGTIGQTVAYPLDVIRRRMQMVGWKHAASVVTGEGKSSLEYTGMIDAFRKTVHHEGFGALYKGLVPNSVKVVPSIAIAFVTYEVVKDVLKVEMRISE

SEQ ID NO: 8636 - protein, 351 aa, Flaveria ramosissima
MASEDVVGKTSATIANIAEEAKIASVGVKAPSRQTLMSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDYLVKSRPFGLVEDAELSVTTKLACGAVAGTVGQTVAYPLDVIRRRMQMVGWKHAASVVTGEGKSSLEYTGMIDAFRKTVRHEGFGALYKGLVPNSVKVVPSIAIAFVTYEVVKDVLKVEMRISE

SEQ ID NO: 8637 - protein, 351 aa, Flaveria ramosissima
MASEDVVGKTSATIANIAEEAKIASVGVKAPSRQTLMSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDYLVKSRPFGLVEDAELSVTTKLACGAIAGTVGQTVAYPLDVIRRRMQMVGWKHAASVVTGEGKSALEYTGMIDAFRKTVRHEGFGALYKGLVPNSVKVVPSIAIAFVTYEVVKDVLKVEMRISE

SEQ ID NO: 8638 - protein, 346 aa, Tripterygium wilfordii
KARESAVSTIVNLAEEAKLAREGVKAPSYAVLSICKSLVAGGVAGGVSRTAVAPLERLKILLQVQNSHSIKYNGTVQGLKYIWKTEGFRGLFKGNGTNCARIVPNSAVKFFSYEQASKAILLLYQQQTGNEDAQLTPVLRLGAGACAGIIAMSATYPMDMVRGRLTVQTEKSPFQYRGMFHALSTVLREEGPRALYKGWLPSVIGVIPYVGLNFAVYESLKDWLVKANGLAGDSELSVVTRLACGAAAGTVGQTIAYPLDVIRRRMQMVGWKDAASIVTGEGRSKAQLEYNGMIDAFRKTVRHEGFGALYKGLVPNSVKVVPSIAIAFVTYEMVKDILGVEIRISD

SEQ ID NO: 8639 - protein, 350 aa, Brassica juncea
MASEDVKRSESAAVSTIVNLAEEAREGVKAPGYAVLSICKSLFAGGVAGGVSRTAVAPLERMKILLQVQNPHNIKYSGTVQGLKYIWRTEGLRGLFKGNGTNCARIVPNSAVKFFSYEQASKGILYLYRQQPGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYNGMVDAFRKTVRHEGFGALYKGLVPNSVKVVPSIAIAFVTYEMVKDVLGVEFRISD

SEQ ID NO: 8640 - protein, 305 aa, Vaccinium corymbosum
MASEDVVGKTSETAVSTIVNLAEEAKIASEGVKAPSHAALLSICKSLVAGGVAGGVSRTAVAPLERLKILLQVQNPHSIKYSGTVQGLKYIWRTEGFRGLFKGNGTNCARIVPNSAVKFFSYEEASKGILWFYRQQTGNEDAELTPLLRLGAGACAGIIAMSATYPMDMVRGRLTVQTATSPRQYRGIAHALSTVFREEGPRALYKGWLPSVIGVIPYVGLNFAVYESLKDWLIKSRPFGMAENADLSVATKLACGAAAGTVGQTVAYPLDVIRRRMQMVGWKDAASVLTGEGGEQSTTRIYWHG

SEQ ID NO: 8641 - protein, 354 aa, Cicer arietinum
MASVDVKTGESAVTKIVNLEEAKLAREGVVKSPNYAIGSICKSLVAGGVAGGVSRTAVAPLERMKILLQVQNHQSVKYNGTIQGLKYIWRTEGFRGLFKGNGTNCARIVPNSAVKFFSYEQASKGILHLYQQQTGNENAQLTPVLRLGAGACAGIIAMSATYPMDMVRGRITVQTEKSPYQYRGMFHALSTVLREEGPRALYKGWLPSVIGVVPYVGLNFAVYESLKDWLIKSRPFGLVQDSELSVTTRLACGAAAGTIGQTVAYPLDVIRRRMQMTGWNNAASVITGDGRGKAPLEYTGMVDAFRKTVRHEGFGALYKGLVPNSVKVVPSIALAFVSYEMVKDILGVEIRISD

SEQ ID NO: 8642 - protein, 354 aa, Unknown
  Sequence found in Organisms: Gossypium hirsutum, Gossypium raimondii
MASEDVKRSESAVSTIVNLAEEAKIASEGVKAPSHALLSICKSLVAGGVAGGVSRSAVAPLERLKILLQVQNPHSIKYNGTIQGLKYIWRTEGFRGMFKGNGTNCARIIPNSAVKFFSYEEASKGILYLYRQQSGNEDAQLTPLLRLGAGACAGIIAMSATYPMDMVRGRLTVQTEKSPHQYRGIFHALSTVLREEGPRALYKGWLPSVIGVVPYVGLNFAVYESLKDWLIKRKPLGLVEDSELGVTTRLACGAAAGTIGQTVAYPLDVIRRRMQMVGWKDAASVVTGDGKNKAPIEYNGMVDTFRKTVRYEGFGALYKGLVPNSVKVVPSIAIAFVTYELVKDVLGVELRISD

SEQ ID NO: 8643 - protein, 355 aa, Eutrema halophilum
MASEDVKRTESAAVSTIVNLAEEAKLAREGVKAPSYAILSVCKSLFAGGVAGGVSRTAVAPLERMKILLQVQNPHNIKYSGTVQGLKYIWRTEGLRGLFKGNGTNCARIVPNSAVKFFSYEQASEGLLYLYRRRTKNENAQLTPLLRLGAGATAGIIAMSATYPMDMVRGRLTVQTANSPYQYRGIAHALSTVLREEGFRALYRGWLPSVIGVVPYVGLNFAVYESLKDWLVKDNPFGLVENNDLTIITRLSCGAIAGTVGQTIAYPLDVIRRRMQMVGWKDASSVVTGDGRNKAALEYSGMIDAFRKTVRHEGFGALYKGLVPNSVKVVPSIAIAFVTYEMVKDVLGVEFRISD

SEQ ID NO: 8644 - protein, 354 aa, Vitis vinifera
MASEDVKTSEAAVSRIVNLAEEAKLAREGVKAPSHALLSVCKSLVAGGVAGGVSRTAVAPLERLKILLQVQNPHTIKYNGTIQGLKYIWKSEGFRGLFKGNGTNCARIVPNSAVKFYSYEQASKGILWLYRQQPGNENAELTPLLRLGAGACAGIIAMSATYPMDMVRGRLTVQTEKSPRQYRGIFHALSTVLREEGARALYKGWLPSVIGVIPYVGLNFAVYESLKDWLMKAKPFGLVEDSELGVTTRLACGAAAGTVGQTVAYPLDVIRRRMQMVGWKDAASVVTGDGRGKAPLEYTGMVDAFRKTVRHEGFGALYKGLVPNSVKVVPSIAIAFVTYEMVKDILGVEMRISD

SEQ ID NO: 8645 - protein, 354 aa, Vitis vinifera
MASEDVKPSESAVTTIVNLAEEAKLAREGVKAPSYAILSVAKSLTAGGVAGGVSRTAVAPLERLKILLQVQNPHNIKYNGTIQGLKYIWKTEGFRGLFKGNGTNCARIIPNSAVKFFSYEQASKGILYLYQQQTGNEDAQLTPLLRLGAGACAGIIAMSATYPMDMVRGRLTVQTENSPYQYRGMFHALSTVLRQEGPRALYKGWLPSVIGVVPYVGLNFAVYESLKDWLIKSKAFGLVHDNELGVTTRLACGAAAGTIGQTVAYPLDVIRRRMQMIGWKDAASIVTGEGRSKAPIEYTGMVDAFRKTVRHEGIGALYKGLVPNSVKVVPSIALAFVTYEMVKDILGVEIRISD

SEQ ID NO: 8646 - protein, 354 aa, Mimulus guttatus
MASEDVKASDSAVSKIVNLAEEAKLAKEEIKPTRFQVYSVCKSLFAGGVAGGVSRTAVAPLERLKILLQVQNPHNIKYSGTVQGLKYIYRTEGFKGLFKGNGTNCARIVPNSAVKFFSYEQASKGILYLYRQQTGDEDAQLTPLLRLGAGACAGIIAMSATYPMDMVRGRLTVQTDKSPYQYRGMFHALSTVLREEGFRALYKGWLPSVIGVVPYVGLNFAVYESLKDWLIKSKQFGLVEDNELGVITRLACGAAAGTVGQTIAYPLDVIRRRMQMVGWSHASSILTGDGRSNAPLQYTGMVDAFRKTVRHEGFRALYKGLVPNSVKVVPSIAIAFVTYEQVKELLGVEIRISD

SEQ ID NO: 8647 - protein, 344 aa, Carica papaya
SAVSTIVNLAEEAKLAREGVKAPSYAILSICKSLVAGGVAGGVSRTAVAPLERLKILLQVQNPHNIKYNGTIQGLKYIWRTEGFRGLFKGNGTNCARIVPNSAVKFFSYEQASKGILYLYQQQTGNEDAQLTPVLRLGAGACAGIIAMSATYPMDMVRGRLTVQTEKSLYQYRGMFHALSTVLREEGPRALYKGWLPSVIGVIPYVGLNFAVYESLKDWLIKSKPFGLVQDSELSVTTRLACGAAAGTVGQTVAYPLDVIRRRMQMVGWKDASSIVTGDGRSKASLEYTGMIDAFRKTVRYEGFGALYKGLVPNSVKVVPSIAIAFVTYEVVKDILGVEIRISD

SEQ ID NO: 8648 - protein, 355 aa, Capsicum annuum
MASEDVKAARDAAVEKIVNLAEEAKLAREEIKPTSHAVFSICKSLVAGGVAGGVSRTAVAPLERLKILLQVQNPHNIKYNGTIQGLKYIWRTEGFKGLFKGNGTNCARIVPNSAVKFFSYEQASKGILYLYRQQTGNEDAQLTPLLRLGAGACAGIIAMSATYPMDMVRGRLTVQTEKSPYQYRGMFHALSTVLREEGPRALYKGWTPSVIGVIPYVGLNFAVYESLKDWLIKAKPFGLVDDSELGVVTRLACGAAAGTVGQTVAYPLDVIRRRMQMVGWSHAASIVTGDGRGKAPLEYTGMIDAFRKTVKYEGVRALYKGLVPNSVKVVPSISIAFVAYEQVKDLLGVEIRISD

SEQ ID NO: 8649 - protein, 355 aa, Unknown
  Sequence found in Organisms: Solanum tuberosum, Solanum phureja
MASEDVKAARDSAVEKIVNLAEEAKLAREEIKPTSHAVLSICKSLVAGGVAGGVSRTAVAPLERLKILLQVQNPHNIKYNGTIQGLKYIWRTEGFKGLFKGNGTNCARIVPNSAVKFFSYEQASKGILYLYRQQTGIEDAQLTPLLRLGAGACAGIIAMSATYPMDMVRGRLTVQTENSPYQYRGMFHALSTVLREEGPRALYKGWTPSVIGVIPYVGLNFAVYESLKDWLVKTKPFGLVDNSELGVVTRLACGAAAGTVGQTVAYPLDVIRRRMQMVGWSHAASIVTGDGRSKAPLEYTGMIDAFRKTVKYEGVRALYKGLVPNSVKVVPSISIAFVAYEQVKDLLGVEIRISD

SEQ ID NO: 8650 - protein, 355 aa, Solanum lycopersicum
MASEDVKAARDSAVEKIVNLAEEAKLAREEIKPTSHAVLSICKSLVAGGVAGGVSRTAVAPLERLKILLQVQNPHNIKYNGTIQGLKYIWRTEGFKGLFKGNGTNCARIVPNSAVKFFSYEQASKGILYLYRQQTGNEDAQLTPLLRLGAGACAGIIAMSATYPMDMVRGRLTVQTENSPYQYRGMFHALSTVLREEGPRALYKGWTPSVIGVIPYVGLNFAVYESLKDWLVKTKPFGLVDNSELGVVTRLACGAAAGTVGQTVAYPLDVIRRRMQMVGWSHAASIVTGDGRSKAPLEYTGMIDAFRKTVKYEGVRALYKGLVPNSVKVVPSISIAFVAYEQVKDLLGVEIRISD

SEQ ID NO: 8651 - protein, 354 aa, Triphysaria pusilla
MASEDVKASESAVSKIVNFAEEAKLAKEEIKPTKYQVYSICKSLVAGGVAGGVSRTAVAPLERLKILLQVQNPHNIKYNGTVQGLKYIWRTEGLRGLFKGNGTNCARIVPNSAVKFFSYEQASKGILYMYRQQTGNEDAQLTPVLRLAAGACAGIIAMSATYPMDMVRGRITVQTEKSPFQYRGMFHALSTVLREEGFRALYKGWLPSVIGVVPYVGLNFAVYESLKDHIIKNNSFGLVEDKELGVVTRLACGAAAGTVGQTIAYPLDVVRRRMQMVGWNHASSIVAGDGRAKAALEYTGMVDAFRKTVRHEGFRALYKGLVPNSVKVVPSIAIAFVTYEQVKELLGVEIRISD

SEQ ID NO: 8652 - protein, 132 aa, Tripterygium wilfordii
MASEDVKTGESAVSTIVNLAEEAKHASEGVKAPSHAFYSICKSLVAGGVAGGVSRTAVAPLERLKILLQVQNPHSIRYNGTIQGLKYIWKTEGLRGMFKGNGTNCARIVPNSAVKFFSYEQASKGILWLHQQ

SEQ ID NO: 8653 - protein, 350 aa, Brassica rapa
MASEDVKRSESAAVSTIVNLAEEAREGVKAPGYAVLSICKSLFAGGVAGGVSRTAVAPLERMKILLQVQNPHNIKYSGTVQGLKYIWRTEGLRGLFKGNGTNCARIVPNSAVKFFSYEQASKGILYLYRQQPGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGLVENNELTIITRLSCGAIAGTVGQTIAYPLDVIRRRMQMVGWKDASSVVTGEGRSKLEYNGMVDAFRKTVRHEGFGALYKGLVPNSVKVVPSIAIAFVTYEMVKDVLGVEFKISD

SEQ ID NO: 8654 - protein, 361 aa, Cannabis sativa
MASEDVKQSESAVSTIVNLAEEAKLSRARESVVNAPKHNLALLSICKSLVAGGVAGGVSRTAVAPLERLKILLQVQNPHSIKYNGTIQGLKYIWRTEGFRGLFKGNGTNCARIVPNSAVKFFSYEQASKAILLMYQQQTGNEDAQLTPLLRLGAGACAGIIAMSATYPMDMVRGRITVQTDKSPYQYRGMFHALSTVLREEGARALYKGWLPSVIGVVPYVGLNFAVYESLKDWLITSKPFGLIDKSDTELSVTTRLACGAAAGTVGQTVAYPLDVIRRRMQMVGWNNAASVVAGDGRSKGSLEYKGMVDAFRKTVRHEGFGALYKGLVPNSVKVVPSIAIAFVSYEMVKEILGVEIRISD

SEQ ID NO: 8655 - protein, 354 aa, Gossypium hirsutum
MASEDVKRSESAVSTIVNLAEEAKIASEGVKAPSHALLSICKSLVAGGVAGGVSRSAVAPLERLKILLQVQNPHSIKYNGTIQGLKYIWRTEGFRGMFKGNGTNCARIIPNSAVKFFSYEEASKGILYLYRQQSGNEDAQFTPLLRLGAGACAGIIAMSATYPMDMVRGRLTVQTEKSPRQYRGIFHALLTVLREEGPRALYKGWLPSVIGVVPYVGLNFAVYESLKDWLIKRKPLGLVEDSELGVTTRLACGAAAGTIGQTVAYPLDVIRRRMQMVGWKDAASVVTGDGKNKAPIEYNGMVDTFRKTVRYEGFGALYKGLVPNSVKVVPSIAIAFVTYELVKDVLGVELRISD

SEQ ID NO: 8656 - protein, 353 aa, Ambrosia trifida
MTSEDVACKTSVTITNIAEEAKIATEGVKAPNRQTLLGICKSLVAGGVAGGVSRTAVAPLERLKILLQVQNPHAIKYNGTIQGLKYIWRTEGFRGMFKGNGTNCARIVPNSAVKFFSYEEASKGILWLYRQQPGNEDAELTPLLRLGAGACAGIIAMSATYPMDLVRGRITVQTDKSSTQYRGMTHALTTVLREEGPRALYKGWLPSVIGVIPYVGLNFAVYESLKDYLVKSRPFGLVEDKELGVTTKLACGAIAGTFGQTVAYPLDVIRRRMQMVGWKHAASVVTGEGKSKSTLEYTGMIDAFRKTVRHEGFGALYKGLVPNSVKVVPSIAIAFVTYEVVKDVLKVEMRISD

SEQ ID NO: 8657 - protein, 352 aa, Aquilegia formosa
MASEDVKTTSESAVSTIVNLAEEASERVKAPGYSILSICKSLIAGGVAGGVSRTAVAPLERMKILLQVQNPHSIKYSGTVQGLKYIWRTEGLRGLFKGNGTNCARIVPNSAVKFFSYEQASRGILTLYRRQTGNEDAQLTPLLRLGAGACAGIIAMSATYPMDMVRGRLTVQTEKSPFQYRGICHALATVFRQEGPRALYKGWLPSVIGVVPYVGLNFAVYESLKDWLIKTRPFGLVEDSELSVPTRLACGAAAGTVGQTVAYPLDVIRRRMQMVGWSNASSIVAGEGMNKAALEYTGMVDAFRKTVRTEGFRALYKGLVPNSVKVVPSIAIAFVTYEQVKDILGVEIRISD

SEQ ID NO: 8658 - protein, 353 aa, Arnica chamissonis
MASEDVVGKTSATIVNIAEEAKIASAGVKAPSRQTILSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDYLVKSRPLGLAEDTELSVTTKLACGAVAGTVGQTIAYPLDVIRRRMQMVGWKHAASVVTGEGKSKSTLEYTGMIDAFRKTVRYEGFGALYKGLVPNSVKVVPSIAIAFVTYEVVKDVLKVDMRISE

SEQ ID NO: 8659 - protein, 354 aa, Unknown
  Sequence found in Organisms: Citrus sinensis, Citrus clementina, Citrus sinensis
MASEDVKTSESAVSKIVNLAEEAKLAGEGVKAPSYAVLSICKSLVAGGVAGAVSRTAVAPLERLKILLQVQNPHSIKYNGTIQGLKYIWRTEGFRGLFKGNGTNCARIVPNSAVKFFSYEQASKGILYLYQHHTGNEDAELTPLLRLGAGACAGIIAMSATYPMDMVRGRLTVQTEKSPYRYRGIFHALSTVLREEGPRALYRGWFPSVIGVVPYVGLNFAVYESLKVWLIKTKPLGLAEDSELSVTTRLACGAAAGTVGQTVAYPLDVIRRRMQMVGWKEASSVVIGDGRNRAPLEYNGMIDAFRKTVRHEGFGALYKGLVPNSVKVVPSISLAFVTYEVVKDILGVEIRISD

SEQ ID NO: 8660 - protein, 353 aa, Flaveria ramosissima
MASEDVVGKTSATIANIAEEAKIASVGVKAPSRQTLLSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIVAMSATYPMDLVRGRLTVQTDKSPSQYRGIAHALTTVLREEGPRALYKGWLPSVIGVVPYVGLNFAVYESLKDYLVKSRPFGLVEDTELSVTTKLACGAVAGTVGQTVAYPLDVIRRRMQMVGWKDAASVVTGEGKSKSALEYTGMIDAFRKTVRHEGFGALYKGLVPNSVKVVPSIAIAFVTYEVVKDVLKVEMRISE

SEQ ID NO: 8661 - protein, 358 aa, Fragaria vesca
MSSEDVAGKRTSETAVSTIVNLAEEAKLASEGVKAPTQAALLSIAKSLVAGGVAGGVSRTAVAPLERLKILLQVQNPHSIKYNGTVQGLKYIWRSEGFRGLFKGNGTNCARIVPNSAVKFFSYEEASRGILWFYRQQTGDENAQLTPLLRLGAGACAGIIAMSATYPLDLVRGRLTVQTENSPRQYRGIFHALSTVFREEGPRALYKGWLPSVIGVIPYVGLNFAVYESLKDWLIKTRPFGLVQDSDLSITTRLACGAAAGTVGQTVAYPLDVVRRRMQMVGWKDAASVVTGDGKSKAAIEYAGMVDTFRKTVRHEGFGALYKGLVPNSVKVVPSIAIAFVTYEVVKDVLGVEMRISD

SEQ ID NO: 8662 - protein, 353 aa, Valeriana officinalis
MASGKTSETAVSTIVNLAEEAKIASEGVKAPSRLALLSICKSLVAGGVAGGVSRTAVAPLERLKILLQVQNPHNIKYNGTVQGLKYIWRTEGFRGLFKGNGTNCARIVPNSAVKFFSYEEASKGILWLYRQQPGNEDAELSPLLRLGAGACAGIIAMSATYPMDMVRGRITVQTDKSPLKYRGIAHALTTVLREEGPRALYKGWLPSVIGVVPYVGLNFAVYESLKDWLVKSRPFGLVEDTELSVTTKLACGAAAGTVGQTVAYPLDVIRRRMQMVGWKDAGGVVSGDGKAHVRHEYTGMIDAFRKTVRHEGFGALYKGLVPNSVKVVPSIAIAFVTYEVVKDVLGVEVRISD

SEQ ID NO: 8663 - protein, 173 aa, Carthamus tinctorius
MASEDVVGKTSATIANIAEEAKIASEGVKAPSRQTLLGICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELSPLLRLGAGACAGILPCRLLIHGLGSRAAYCSD

SEQ ID NO: 8664 - protein, 351 aa, Unknown
  Sequence found in Organisms: Centaurea maculosa, Cirsium arvense
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILWLHRQQPGNEDAELTPLLRLGAGACAGIIAMSATYPMDLVRGRLTVQTDKSPSQYRGIAHALRTVLREEGPRALYKGWLPSVIGVVPYVGLNFAVYESLKDWLIKSRPFGLVEDTELSVTTKLACGAAAGTVGQTVAYPLDVIRRRMQMVGWKDAASVVTADGKSGLEYTGMVDAFRKTVRYEGFGALYKGLVPNSVKVVPSIAIAFVSYEMVKDLLGVEMRISD

SEQ ID NO: 8665 - protein, 351 aa, Ambrosia trifida
MASEDVVGKTSATIANIAEEAKIASVGVKAPSRQTLLGICKSLVAGGVAGGVSRTAVAPLERMKILLQVQNPNAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVIPYVGLNFAVYESLKDHLVKSRPLGLVQDTELSVTTKLACGAVAGTVGQTVAYPLDVIRRRMQMGGWKNAASIVTGEGKSTLEYTGMIDAFRKTVRHEGFGALYKGLVPNSVKVVPSIAIAFVTYEVVKDVLKVEMRISD

SEQ ID NO: 8666 - protein, 350 aa, Brassica napus
MASEDVKRSESAAVSTIVNLAEEAREGVKAPGYAVLSICKSLFAGGVAGGVSRTAVAPLERMKILLQVQNPHNIKYSGTVQGLKYIWRTEGLRGLFKGNGTNCARIVPNSAVKFFSYEQASKGILYLYRQQPGNENAQLTPVLRLGAGATAGIIAMSATYPMDMVRGRLTVQTANSPYQYRGIAHALSTVLREEGPRALYRGWLPSVIGVVPYVGLNFAVYESLKDWLVKDNPFGRVENNELTIITRLSCGAIAGTVGQTIAYPLDVIRRRMQMVGWKDASSVVTGEGRSKLEYNGMVDAFRKTVRHEGFGALYKGLVPNSVKVVPSIAIAFVTYEMVKDVLGVEFKISD

SEQ ID NO: 8667 - protein, 351 aa, Lactuca sativa
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILYLYRQQPGNEDAELTPLLRLGAGACAGIIAMSATYPMDLVRGRLTVQTDTSPSQYRGIAHALRTVLREEGPRALYKGWLPSVIGVVPYVGLNFAVYESLKDWLVKSRPFGLVEGTELSVTTKLACGAAAGTVGQTVAYPLDVIRRRMQMVGWKDAASVVTADGKSALEYTGMVDAFRKTVRYEGFGALYKGLVPNSVKVVPSIAIAFVSYEVVKDLLGVEMRISD

SEQ ID NO: 8668 - protein, 351 aa, Helianthus annuus
MASEDVVGKTSATIANIAEEAKIASVGVKAPSRQTLLGICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVQYVGLNFAVYESLKDHLVKTRPFGLVEDTELSVTTKLACGAVAGTIGQTVAYPLDVIRRRMQMGGWKNAASVVTGEGKSPLEYTGMIDAFRKTVRYEGFRALYKGLVPNSVKVVPSIAIAFVTYEVVKDVLKVEMRISE

SEQ ID NO: 8669 - protein, 351 aa, Helianthus annuus
MASEDVVGKTSATIANIAEEAKIASVGVKAPSRQTLLGICKSLIAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDHLVKTRPFGLVEDTELSVTTKLACGAVAGTIGQTVAYPLDVIRRRMQMGGWKNAASVVTGEGKSPLEYTGMIDAFRKTVRYEGFRALYKGLVPNSVKVVPSIAIAFVTYEVVKDVLKVEMRISE

SEQ ID NO: 8670 - protein, 353 aa, Gossypium hirsutum
ASEDVKRSESAVSTIVNLAEEAKIASEGVKAPSHALLSICKSLVAGGVAGGVSRSAVAPLERLKILLQVQNPHSIKYNGTIQGLKYIWRTEGFRGMFKGNGTNCARIIPNSAVKFFSYEEASKGILYLYRQQSGNEDAQLTPLLRLGAGACAGIIAMSATYPMDMVRGRLTVQTEKSPHQYRGIFHALSTVLREEGPRALYKGWLPSVIGVVPYVGLNFAVYESLKDVLIKRKPLGLVEDSELGVTTRLACGAAAGTIGQTVAYPLDVIRRRMQMVGWKDAASVVTGDGKNKAPIEYNGMVDTFRKTVRYEGFGALYKGLVPNSVKVVPSIAIAFVTYELVKDVLGVELRISD

SEQ ID NO: 8671 - protein, 345 aa, Castanea mollissima
ESAVSTIVNLAEEAKLASEGVKAPSHALLSICKSLIAGGVAGGVSRSAVAPLERLKILLQVQNPHSIKYNGTIQGLKYIWRTEGIRGMFKGNGTNCARIVPNSAVKFFSYEQASSGILWLYRQQSGNEEANLTPLLRLGAGACAGIIAMSATYPMDMVRGRLTVQTENSPRQYRGIFHALSTVFREEGPRALYRGWLPSVIGVIPYVGLNFAVYESLKDWLIQTKPFGLAENSELSVTTRLACGAAAGTVGQTVAYPLDVIRRRMQMVGWKDASSVLTADGKSKTPLEYTGMVDAFRKTVRHEGFGALYKGLVPNSVKVVPSIAIAFVTYEVVKDVLGVEMRISD

SEQ ID NO: 8672 - protein, 354 aa, Coffea canephora
MASEDVKSSESAVSKIVNFAEEAKLAREEIKPTSHAVLSICKSLVAGGVAGGVSRTAVAPLERLKILLQVQNPHNIKYSGTVQGLKYIWRTEGFRGLFKGNGTNCARIVPNSAVKFFSYEQASKGILWLYREKTGNEDAELTPVLRLGAGACAGIIAMSATYPMDMVRGRLTVQTEKSPYQYRGMFHALATVLREEGPRALYKGWLPSVIGVIPYVGLNFAVYESLKDWLVKAKPFGLVEDSELGVITRLACGAAAGTVGQTVAYPFDVMRRRMQMVGWKDAASVVTGDGRSKAPLEYTGMIDAFRKTVRHEGFKALYKGLVPNSVKVVPSIAIAFVTYEQVKDLLGVEIRISD

SEQ ID NO: 8673 - protein, 345 aa, Glycine max
MASETKVVNLAEEAKLAREGVTTPSYAFTTICKSLVAGGVAGGVSRTAVAPLERLKILLQVQNPHSIKYNGTIQGLKYIWRTEGFRGLFKGNGTNCARIVPNSAVKFFSYEQASKGILHLYRKQTGNEDAQLTPLLRLGAGACAGIIAMSATYPMDMVRGRITVQTEKSPYQYRGMFHALSTVLREEGPRALYKGWLPSVIGVIPYVGLNFAVYESLKDWLIKSNPLGLVQDSELSVTTRLACGAAAGTIGQTVAYPLDVIRRRMQMVGWNHAASVVAGDGRGKVPLEYTGMVDAFRKTVRYEGFGALYKGLVPNSVKVVPSIAIAFVTYEVVKDILGVEIRISD

SEQ ID NO: 8674 - protein, 354 aa, Tabernaemontana elegans
MASEDVKTSESAVSKIVNLAEEAKLAREEIKPTSYAVISICKSLVAGGVAGGVSRTAVAPLERLKILLQVQNPHNIKYNGTVQGLKYIWRTEGFRGLFKGNGTNCARIVPNSAVKFFSYEQASKGILWQYQQQTGNEDAELTPLLRLGAGACAGIVAMSATYPMDMVRGRLTVQTEKSPYQYRGMFHALSTVLREEGPRALYKGWLPSVIGVIPYVGLNFAVYESLKDWLVKGNPFGLVEGSELGVTTKLACGAAAGTVGQTVAYPLDVIRRRMQMVGWKDAASIVTGDGRSKAPLEYNGMVDAFRKTVRHEGFRALYKGLVPNSVKVVPSIAIAFVTYEQVRDLLGVQIRISD

SEQ ID NO: 8675 - protein, 351 aa, Carthamus tinctorius
  misc_feature (257)..(257): Xaa can be any naturally occurring amino acid
MASEDVVGKTSATIANLAEEAKIASEGVKAPSRHALLSICKSLVAGGVAGGVSRTAVAPLERLKILLQVQNPHAIKYNGTIQGLKYIWRTEGFRGLFKGNGTNCARIVPNSAVKFFSYEEASKGILWLHRQQPGNEDAELTPLLRLGAGACAGIIAMSATYPMDLVRGRLTVQTDKSPSQYRGIAHALRTVLREEGPRALYKGWLPSVIGVVPYVGLNFAVYESLKDWLIKSRPFGLVEDTELSVTTKLACGAAAGXVGQTVAYPLDVIRRRMQMVGWKDAASVVTADGKSGLEYTGMIDAFRKTVRYEGFGALYKGLVPNSVKVVPSIAIAFVSYEMVKELLGVEMRISD

SEQ ID NO: 8676 - protein, 354 aa, Silene vulgaris
MASEDVKQRGDGAVSTIVNLAEEAKAATEGVKSPKYALLTISKSLAAGGIAGAVSRTAVAPLERLKILLQVQNPHNIKYNGTIQGLKYIWQTEGVRGLFKGNGTNCARIVPNSAVKFFSYEQASKGILWLYQQQPGNENAELNPLLRLGAGACAGIIAMSATYPMDMVRGRLTVQTDKSPQQYRGIYHALTTVLREEGARALYKGWLPSVIGVVPYVGLNFAVYESLKDYLLKENPLGLVQDNELSVTTRLACGAAAGTVGQTIAYPLDVIRRRMQMVGWKDASKVITGDGRKGPLEYTGMIDAFRKTVKYEGVGALYKGLVPNSVKVVPSIAIAFVSYEVVKDLLGVEMRISD

SEQ ID NO: 8677 - protein, 351 aa, Tragopogon dubius
MASEDVVGKTSVTFANIAEEAKIASEGVKAPSRHALIGIGKSLVAGGIAGGVSRTAVAPLERLKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALSTVLREEGPRALYKGWLPSVIGVVPYVGLNFAVYESLKDWLVKSRPFGLAENTELSVTTKLACGAAAGTVGQTIAYPLDVIRRRMQMVGWKDAASVVTADGKSALEYTGMIDAFRKTVRYEGFRALYKGLVPNSVKVVPSIAIAFVTYEVVKDVLKVEMRISD

SEQ ID NO: 8678 - protein, 354 aa, Artemisia annua
MASEDVVGKTSATIANLAEEANKIATEGVAVKAPSRHALLSIAKSLVAGGVAGGVSRTAVAPLERLKILLQVQNPHAIKYNGTIQGLKYIYRTEGFRGLFKGNGTNCARIVPNSAVKFFSYEEASKGILWLYRQQPGNEDAELTPLLRLGAGACAGIIAMSATYPMDLVRGRLTVQTDKSPSQYRGIAHALRTVLREEGPRALYKGWLPSVIGVVPYVGLNFAVYESLKDWLVKSRPFGLVEDTELSVTTKLACGAAAGTVGQTVAYPLDVIRRRMQMVGWKDAASVVTADGKSSLEYTGMVDAFRKTVRHEGFGALYKGLVPNSVKVVPSIAIAFVSYEVVKDLLGVEMRISD

SEQ ID NO: 8679 - protein, 355 aa, Citrus sinensis
MASTEDVKSESAVTTIVNLAEEAKLAREGVKAPSHALLSVTKSLVAGGVAGGVSRTAVAPLERLKILLQVQNPHSIKYNGTIQGLKYIWKSEGFRGLFKGNGTNCARIIPNSAVKFFSYEEASKGILWLYRRQTRNEEAELTPVLRLGAGACAGIIAMSATYPMDMVRGRLTVQTEKSPRQYRGIFHALTTVLREEGPRSLYKGWLPSVIGVIPYVGLNFAVYESLKDWLIKSKALGLVDDNNELGVATRLACGAAAGTVGQTVAYPLDVIRRRMQMAGWKDAASVVTGDGKTKAALEYNGMVDAFRKTVRHEGFGALYKGLVPNSVKVVPSIAIAFVTYEMVKDILGVEMRISD

SEQ ID NO: 8680 - protein, 359 aa, Zostera marina
MSSEDVVGKSTGETTVNTIVNNLAEEAKLATQGVKAPGHAILSVCKSLVAGGVAGGVSRTAVAPLERLKILLQVQNPHNIKYNGTIQGLKYIWNTEGFRGLFKGNGTNCARIVPNSAVKFYSYEQAASGILWLYQRQTGNEDAELTPVLRLGAGACAGIIAMSATYPMDMVRGRITVQTSKSPHQYTGMFHALSTIYRHEGFRALYKGWLPSVIGVVPYVGLNFAVYESLKDWMVKTNPYRIVENNELSVTMRLACGAAAGTVGQTVAYPLDVIRRRMQMTGWKGASASIVTGDGKNKGLVEYNGMIDAFRKTVRNEGFGALYKGLVPNSVKVVPSIALAFVSYEIVKDILGVEMKISA

SEQ ID NO: 8681 - protein, 354 aa, Theobroma cacao
MASEDVKRSESAVTTIVNIAEEAKLASEGVKAPSRAFLSICKSLVAGGVAGGVSRTAVAPLERLKILLQVQNPHSIKYNGTILGLKYIWKTEGFRGMFKGNGTNCARIIPNSAVKFFSYEEASKQILYLYRQHSGNEDAQLTPVLRLGAGACAGIIAMSATYPMDMVRGRLTVQTEKSPRQYRGIFHALSTVLREEGPRALYKGWLPSVIGVVPYVGLNFAVYESLKDWLIKSKPFGLVEDSELGVMTRLACGAAAGTVGQTVAYPLDVIRRRMQMVGWKDAASVVTGDGKSKAPLEYTGMVDAFRKTVRYEGIGALYKGLVPNSVKVVPSIAIAFVTYELVKDVLGVELRISD

SEQ ID NO: 8682 - protein, 345 aa, Cajanus cajan
MASETKIVNLAEEAKLAREGVKAPTYAFSTICKSLVAGGVAGGLSRTAVAPLERMKILLQVQNPHNIKYNGTIQGLKYIWRSEGFRGLFKGNGTNCARIVPNSAVKFFSYEQASKGILHLYQKQTGNEDAQLTPLLRLGAGACAGIIAMSATYPMDMVRGRITVQTEKSPYQYRGMFHALSTVLREEGPRALYKGWLPSVIGVIPYVGLNFAVYESLKDWLIKSNPLGLVQDSELSVTTRLACGAAAGTIGQTVAYPLDVIRRRMQMVGWNHAASVVAGDGRGKVPLEYTGMIDAFRKTVRYEGFGALYKGLVPNSVKVVPSIAIAFVTYEVVKDILGVEIRISD

SEQ ID NO: 8683 - protein, 83 aa, Ambrosia trifida
MASEDVVGKTSATIANIAEEAKIASVGVKAPSRQTLLGICKSLVAGGVAGGVSRTAVAPLERMKFCSRYKIHMQSNTMELFRD

SEQ ID NO: 8684 - protein, 355 aa, Unknown
  Sequence found in Organisms: Citrus clementina, Citrus sinensis
MASTEDVKSESAVTTIVNLAEEAKLAREGVKAPSHALLSVTKSLVAGGVAGGVSRTAVAPLERLKILLQVQNPHSIKYNGTIQGLKYIWKSEGFRGLFKGNGTNCARIIPNSAVKFFSYEEASKGILWLYRRQTRNEEAELTPVLRLGAGACAGIIAMSATYPMDMVRGRLTVQTEKSPRQYRGIFHALTTVLREEGPRSLYKGWLPSVIGVIPYVGLNFAVYESLKDWLIKSKALGLVDDNNELGVATRLACGAAAGTVGQTVAYPLDVIRRRMQMAGWKDAASVVTGDGKTKATLEYNGMVDAFRKTVRHEGFGALYKGLVPNSVKVVPSIAIAFVTYEMVKDILGVEMRISD

SEQ ID NO: 8685 - protein, 356 aa, Linum usitatissimum
MASEDVKTSGEAAVSTIVNLATEEAKLAREGVKTQGPAFLSICKSLVAGGVAGGVSRTAVAPLERLKILLQVQNPHSIKYNGTIQGLKYIWRTEGFRGLFKGNGTNCARIVPNSAVKFYSYEEASKGILWLYRRQTGKDDAQLTPVLRLGAGACAGIIAMSATYPMDMVRGRLTVQTDKSPCRYRGIAHALRTVLKEEGGRALYKGWLPSVIGVVPYVGLNFAVYESLKDWLLKSNAFDLVENNELSIMTRLACGAAAGTVGQTVAYPLDVIRRRMQMVGWKDAASVVTGDGRGRAPLEYTGMVDAFRKTVRYEGFGALYKGLVPNSVKVVPSIAIAFVSYEMVKGVLGVELRISD

SEQ ID NO: 8686 - protein, 355 aa, Capsicum annuum
MASEDVKASESAVEKIVNLAEEAKLARQEIKPTSHAVISICKSLVAGGVAGGVSRTAVAPLERLKILLQVQNPHNIKYNGTISGLKYIWRTEGFKGLFKGNGTNCARIVPNSAVKFFSYEQASKGILYLYQQQTGNEDAQLTPLLRLGAGACAGIIAMSATYPMDMVRGRITVQTEKSPYQYRGMFHALSTILREEGPRALYKGWLPSVIGVIPYVGLNFAVYESLKDWLVKTKPLGLVDDSTELGVVTRLACGAVAGTVGQTVAYPLDVVRRRMQMVGWKDAASIVTGDGKSKASVEYSGMIDTFRKTVRYEGFRALYKGLVPNSVKVVPSIAIAFVTYEQVKDLLGVEIRISD

SEQ ID NO: 8687 - protein, 209 aa, Euonymus alatus
MPSEDVKTGESTVSTIVTLAQEAKHASEGVKAPTHAFYSICKSLVAGGVAGGVSRTAVAPLERLKILLQVQNPHSIRYNGTIQGLKYIWKTEGLRGMFKGNGTNCARIVPNSAVKFFSYEQASKGILWLHRQQTGNEEAELTPLLRLGAGACAGIIAMSATYPMDMVRGRLTVQTEKSPRHYRGIIHALSTVLREEALGHCTEAGCLLS

SEQ ID NO: 8688 - protein, 352 aa, Arabidopsis lyrata
MASEDVKRTESAAVSTIVNLAEEAREGVKAPSYAFKSICKSLFAGGVAGGVSRTAVAPLERMKILLQVQNPHSIKYSGTVQGLKYIWRTEGLRGLFKGNGTNCARIVPNSAVKFFSYEQASKGILYMYRQRTGNENAQLTPLLRLGAGATAGIIAMSATYPMDMVRGRLTVQTANSPYQYRGIAHALSTVLREEGPRALYRGWLPSVIGVVPYVGLNFAVYETLKDWLLKDNPFGLVQNNDLTIVTRLTCGAIAGTVGQSIAYPLDVIRRRMQMVGWKDASAVVTGEGRSKALLEYTGMMDAFRKTVRHEGFGALYKGLVPNSVKVVPSIAIAFVTYEMVKEVLGVEFRISD

SEQ ID NO: 8689 - protein, 345 aa, Vigna unguiculata
MASETKIVNLAEEAKLATEGVKTPSYALTTICKSLVAGGVAGGVSRTAVAPLERLKILLQVQNPHNIKYNGTIQGLKYIWRTEGFRGLFKGNGTNCARIVPNSAVKFFSYEQASKGILQLYQKQTGNEDAQLTPVLRLGAGACAGIIAMSATYPMDMVRGRITVQTDKSPYQYRGMFHALSTVLREEGPRALYKGWLPSVIGVIPYVGLNFAVYESLKDWLVKSNPFGIVQDSELSVTTRLACGAAAGTMGQTVAYPLDVIRRRMQMVGWNHAASVVAGDGRGKVPLEYSGMVDAFRKTVRYEGFGALYKGLVPNSVKVVPSIAIAFVTYEVVKDILGVEIRISD

SEQ ID NO: 8690 - protein, 345 aa, Glycine max
MASETKVVNLAEEAKLAREGVTAPSYAFTTICKSLVAGGVAGGVSRTAVAPLERLKILLQVQNPHSIKYNGTIQGLKYIWRTEGFRGLFKGNGTNCARIVPNSAVKFFSYEQASKGILHLYQKQTGNEDAQLTPLFRLGAGACAGIIAMSATYPMDMVRGRITVQTEKSPYQYRGMFHALSTVLREEGPRALYKGWLPSVIGVIPYVGLNFAVYESLKDWLVKSNPLGLVQDSELSVTTRLACGAAAGTIGQTVAYPLDVIRRRMQMVGWNHAASVVAGDGRGKVPLAYTGMVDAFRKTVRYEGFGALYRGLVPNSVKVVPSIAIAFVTYEVVKDILGVEIRISD

SEQ ID NO: 8691 - protein, 354 aa, Valeriana officinalis
MASEDVKASESAVSTIVNLAEEAKLAREGVKAPNVQILSICKSLVAGGVAGGLSRTAVAPLERLKILLQVQNAHNIKYNGTLQGLKYIYRTEGFRGLFKGNGTNCARIVPNSAVKFFSYEEASKGILWFYRRQSGNEDAQLTPLLRLGAGATAGIIAMSATYPMDLVRGRLTVQTEKSPYQYRGIFHALSTVLRHEGPRALYKGWLPSVIGVVPYVGLNFAVYESLKDWLIKSRPFGLVEDTELSVITRLACGAAAGTVGQTVAYPLDVIRRRMQMVGWKGGSSVIAGGADKAASMEYTGMVDAFRKTVRHEGFRALYKGLVPNSVKVVPSIAIAFVTYEQVKEILGVEIRISD

SEQ ID NO: 8692 - protein, 354 aa, Vinca minor
MASEDVKTSESAVSKIVNLAEEAKLAREEIKPTSQTVLSVCKSLVAGGVAGGLSRTAVAPLERLKILLQVQNPHSIKYNGTVQGLKYIWRTEGFRGLFKGNGTNCARIVPNSAVKFFSYEQASKGILWLYQQQTGNEDAELTPLLRLGAGACAGIIAMSATYPMDLARGRLTVQTAKSPYQYRGMFHALSTVLREEGPRALYKGWLPSVIGVIPYVGLNFAVYESLKDWLVKARPFGFVEDQELGVTTRLACGAFAGTVGQTIAYPLDVIRRRMQMVGWKNADAIVTGDGRIKAPLEYTGMVDAFRKTVRHEGFIALYKGLVPNSVKVVPSIAIAFVTYEQVKDLLGVQIRISD

SEQ ID NO: 8693 - protein, 265 aa, Cynara scolymus
MASEDVVGKTSATIANIAEEAKIASEGVKAPSRQTLLGICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALRTVLRERSPRALYKGWLPSVIGVVPYVGLNFAVYESLKDWLVKSRPFGLVEDTELSVTTKLACGAAAGTLANGCLSA

SEQ ID NO: 8694 - protein, 352 aa, Arabidopsis thaliana
MASEDVKRTESAAVSTIVNLAEEAREGVKAPSYAFKSICKSLFAGGVAGGVSRTAVAPLERMKILLQVQNPHNIKYSGTVQGLKHIWRTEGLRGLFKGNGTNCARIVPNSAVKFFSYEQASNGILYMYRQRTGNENAQLTPLLRLGAGATAGIIAMSATYPMDMVRGRLTVQTANSPYQYRGIAHALATVLREEGPRALYRGWLPSVIGVVPYVGLNFSVYESLKDWLVKENPYGLVENNELTVVTRLTCGAIAGTVGQTIAYPLDVIRRRMQMVGWKDASAIVTGEGRSTASLEYTGMVDAFRKTVRHEGFGALYKGLVPNSVKVVPSIAIAFVTYEMVKDVLGVEFRISD

SEQ ID NO: 8695 - protein, 355 aa, Solanum lycopersicum
MASEDVKASESAVEKIVNLAEEAKLARQEIRPTSHAVISICKSLVAGGVAGGVSRTAVAPLERLKILLQVQNSHSIKYNGTISGLKYIWRTEGFKGLFKGNGTNCARIVPNSAVKFFSYEQASKGILYLYQQQTGNEDAQLTPLLRLGAGACAGIIAMSATYPMDMVRGRITVQTEKSPYQYRGMVHALSTILREEGPRALYKGWLPSVIGVIPYVGLNFAVYESLKEWLVKTKPLGLVDDSTELGVVTRLACGAVAGTMGQTVAYPLDVVRRRMQMVGWKDAASIITGDGRSKASLEYSGMIDTFRKTVRYEGFSALYKGLVPNSVKVVPSIAIAFVTYEQVKDLLGVEIRISD

SEQ ID NO: 8696 - protein, 354 aa, Valeriana officinalis
MASEDVKASESAVSTIVNLAEEAKLAREGVKAPNVQILSICKSLVAGGVAGGLSRTAVAPLERLKILLQVQNAHNIKYNGTLQGLKYIYRTEGFRGLFKGNGTNCARIVPNSAVKFFSYEEASKGILWFYRRQSGNEDAQLTPLLRLGAGATAGIIAMSATYPMDLVRGRLTVQTEKSPYQYRGIFHALSTVLRHEGPRALYKGWLPSVIGVIPYVGLNFAVYESLKDWLIKSRPFGLVEDTELSVITRLACGAAAGTVGQTVAYPLDVIRRRMQMVGWKGGSSVIAGGADKAASMEYTGMVDAFRKTVRHEGFRALYKGLVPNSVKVVPSIAIAFVTYEQVKEILGVEIRISD

SEQ ID NO: 8697 - protein, 350 aa, Flaveria ramosissima
MASEDVVGKTSATIANIAEEAKIASVGVKAPSRQTLLSICKSLVAGGVAGGVSRTAVAPLERMKILLQVQNPHAIKYNGTIQGLKYIWRTEGLRGMFKGNGTNCARIVPNSAVKFFSYEEASKGILWLYRQQPGNEDAELTPLLRLGAGACAGIIAMSATYPMDLVRGRLTVQTDKSPSQYRGIAHALTTVLREEGPRALYKGWLPSVIGVVPYVGLNFAVYESLKDYLVKSRPFGLVEDTELSVTTKLACGAIAGTVGQTVAYPLDVIRRRMQMVGWNMLLQLLPVKESQHLNTGMIDAFRKTVRHEGFGALYKGLVPNSVKVVPSIAIAFVTYEVVKDVLKVEMRISE

SEQ ID NO: 8698 - protein, 352 aa, Triphysaria pusilla
MASEDVKMSESAVSKMVNLAEEAKLAKEEIKPSKYQVFSVCKSLVAGGVAGGLSRTAVAPLERLKILLQVQNPHNIKYSGTVQGLKYIWRTEGFRGLFKGNGTNCARIVPNSAVKFFSYEQASKGILYLYQQQTGNEDAQLTPLLRLGAGATAGIIAMSATYPLDMVRGRLTVQTDKSPYQYRGMFHALSTVLRQEGFRALYKGWLPSVIGVVPYVGLNFAVYESLKDWLIKSKTFNLVEDNELGVVTRLACGAAAGTVGQTVAYPLDVIRRRMQMVGWNNASSVVVGGSKGPLEYTGMVDAFRKTVRHEGFRALYKGLVPNSVKVVPSIAIAFVTYEQVKEFLGVEFRISD

SEQ ID NO: 8699 - protein, 198 aa, Lippia dulcis
MSATYPMDMVRGRLTVQTDKSPYQYRGMFHALSTVLREEGFRALYKGWLPSVIGVVPYVGLNFAVYESLKDWLIKSRSFGLVEDNNELGVVTRLACGAAAGTVGQTVAYPLDVIRRRMQMVGWNNASSIVTGDGRVKAPLEYTGMVDAFRKTVKYEGFRALYKGLVPNSVKVVPSIAIAFVTYEQVKELLGVEIRISD

SEQ ID NO: 8700 - protein, 354 aa, Gossypium raimondii
MASEDVKRSESAVTTIVNLAEEAKFAKEGVQAPSHAFLSICKSLFAGGVAGGVSRSAVAPLERLKILLQVQNPHGIKYNGTIQGLKYIWKTEGFRGMFKGNGTNCARIIPNSAVKFFSYEEASKGILYLYRQQSGNEDAQLTPLLRLGAGACAGIIAMSATYPMDMVRGRLTVQTEMSPRHYRGIFHALTTVLREEGPRALYKGWLPSVIGVVPYVGLNFAVYESLKDWLIKRRPFGLVEDSELGVTTKLACGAAAGTVGQTVAYPLDVIRRRMQMAGWKDAASVVTGDGNSKAPLEYTGMVDAFRKTVRYEGFGALYKGLVPNSVKVVPSIAIAFVTYELVKDVLGVELRISD

SEQ ID NO: 8701 - protein, 352 aa, Lactuca sativa
MASEDVVGKTSATIANIAEEAKIASEGVKAPSRLALLGICKSLAAGGIAGGVSRTAVAPLERLKILLQVQNPHAIKYNGTIQGLKYIWRTEGLRGMFKGNGTNCARIVPNSAVKFFSYEEASKGILWLYKQQPGNEDAELTPLLRLGAGACAGIIAMSATYPMDLVRGRLTVQTDKSPSQYRGIAHALKTVLREEGPRALYKGWLPSVIGVVPYVGLNFAVYESLKDWLVKTRPFGLTEGTDLSVTTKLACGAAAGTVGQTVAYPLDVIRRRMQMVGWKDAASVVTAGGKSGGLEYTGMVDAFRKTVRYEGFRALYKGLVPNSVKVVPSIAIAFVTYEVVKDVLHVEMRISD

SEQ ID NO: 8702 - protein, 345 aa, Phaseolus coccineus
MASETKIVNLTEEPNLAREGVKPPSYAFTTICKSLVAGGVAGGVSRTAVAPLERLKILLQVQNPHNIKYNGTIQGLKYIWRTEGFRGLFKGNGTNCARIVPNSAVKFFSYEQASKGILQLYQKQTGNEDAQLTPVLRLGAGACAGIIAMSATYPMDMVRGRITVQTEKSPYQYRGMFHALSTVLKEEGPRALYKGWLPSVIGVIPYVGLNFAVYESLKDWLVKSNPFGIVQDSELSVTTRLACGAAAGTMGQTVAYPLDVIRRRMQMVGWNHAASVIAGDGRGKVPLEYSGMIDAFSKTVRYEGFGALYKGLVPNSVKVVPSIAIAFVTYEVVKDILGVEIRISD

SEQ ID NO: 8703 - protein, 258 aa, Gossypium hirsutum
MFKGNGTNCARIIPNSAVKFFSYEEASKGILYLYRQQSGNEDAQLTPLLCLGAGACAGIIAMSATYPMDMVRGRLTVQTEMSPRHYRGIFHALTTVLREEGPRALYKGWLPSVIGVVPYVGLNFAVYESLKDWLIKRRPFGLVEDSELGVTTKLACGAAAGTVGQTVAYPLDVIRRRMQMAGWKDAASVVTGDGNSKAPLEYTGMVDAFRKTVRYEGFGALYKGLVPNSVKVVPSIAIAFVTYELVKDVLGVELRISD

SEQ ID NO: 8704 - protein, 236 aa, Artemisia annua
MASEDVVGKTSATIANIAEEAKIAASENVKAPSRQTLLGISKSLVAGGVAGGVSRTAVAPLERLKILLQVQNPHAIKYSGTIQGLKYIWRTEGFRGMFKGNGTNCARIVPNSAVKFFSYEEASKGILWLYRQQPGNEDAELTPLLRLGAGACAGIIAMSATYPMDLVRGRITVQTEKSGTQYRGIAHALRTVLREEGPRALYKGWLPSVIGVVPYVGLNFAVYESLKDQIKTIWTG

SEQ ID NO: 8705 - protein, 336 aa, Fagopyrum esculentum
MASEDVKTSESAVSTIVNLAEEAKTATESVKPPSIALLSVCKSLAAGGIAGGVSRTAVAPLERLKILLQVQNPHSIKYNGTIQGLKYIWRTEGLRGLFKGNGTNCARIVPNSAVKFFSYEQASHGILWLYRQQTGNENAELTPVLRLGAGACAGIIAMSATYPMDMVRGRLTVQTENSPRQYTGIANALRTVFREEGARALYRGWLPSVIGVVPYVGLNFAVYESLKDWLVKDKPFGLVTGNELSVTTRLACGAAAGTIGQTIAYPLDVVRRRMQMVGWKDASAVIIGDGRTKVPLEYTGMVDAFRKQFVMRDLVLCTRVWSLIQSRSFHLSLLHS

SEQ ID NO: 8706 - protein, 188 aa, Cichorium intybus
MSATYPMDLVRGRLTVQTDKSPSQYRGIAHALRTVLREEGARALYKGWLPSVIGVVPYVGLNFAVYESLKDWLVKSRPFGLVEDTELSVTTKLACGAAAGTVGQTVAYPLDVIRRRMQMVGWKDAASVVTADGKSSLEYTGMVDAFRKTVRYEGFGALNKGLVPNSVKVVPSIAIAFVSYEVVKDLLE

SEQ ID NO: 8707 - protein, 195 aa, Flaveria ramosissima
MSATYPMDLVRGRITVQTEKSSTQYRGMAHALTTVLREEGPRALYKGWLPSVIGVIPYVGLNFAVYESLKDYLVKSRPFGMVEDKELSVTTKLACGAVAGTAGQTVAYPLDVIRRRMQMVGWKHAASVVTGEGKSTLEYTGMIDAFRKTVRYEGFGALYKGLVPNSVKVVPSIAIAFVTYEVVKDVLKVEMRISE

SEQ ID NO: 8708 - protein, 347 aa, Lotus japonicus
MASDSKMVNLAEEAKAKLASEGVKAPSYALMSICKSLVAGGVAGGVSRTAVAPLERMKILLQVQNPHNIKYNGTIQGLKYIWRTEGFRGLFKGNGTNCARIVPNSAVKFFSYEQASKGILHLYRQKTGKEDAELTPLLRLGAGACAGIIAMSATYPMDMVRGRITVQTEKSPYQYRGMFHALSTVLREEGPRALYKGWLPSVIGVVPYVGLNFAVYESLKDWLIKSKPFGLAQDSELGVTTRLACGAAAGTIGQTVAYPLDVIRRRMQMVGWNHAASVVAGDGRGKTPLEYTGMVDAFRKTVRYEGFGALYKGLVPNSVKVVPSIALAFVTYEMVKDILGVEIRISD

SEQ ID NO: 8709 - protein, 355 aa, Solanum tuberosum
MASEDVKASESAVEKIVSLAEEAKLARQEIRPTSHAVISICKSLVAGGVAGGVSRTAVAPLERLKILLQVQNSHSIKYNGTISGLKYIWRTEGFKGLFKGNGTNCARIVPNSAVKFFSYEQASKGILYLYQQQTGNEDAQLTPLLRLGAGACAGIIAMSATYPMDMVRGRITVQTEKSPYQYRGMVHALSTILREEGPRALYKGWLPSVIGVIPYVGLNFAVYESLKEWLVKTKPLGLVDDSTEPGVVTRLACGAVAGTLGQTVAYPLDVVRRRMQMVGWKDAASIVTGDGRSKASLEYSGMIDTFRKTVRYEGFSALYKGLVPNSVKVVPSIAIAFVTYEQVKDLLGVEIRISD

SEQ ID NO: 8710 - protein, 346 aa, Arachis hypogaea
MASEDVKSGESAVTKIVTLAEEAKLASREGVVTAAAAPSYAFTTICKSLIAGGVAGGVSRTAVAPLERLKILLQVQNPHNIKYNGTVQGLKYIWRTEGFRGLFKGNGTNCARIVPNSAVKFFSYEQASKGILYMYRQQTGNEDAQLTPVLRLGAGACAGIIAMSATYPMDMVRGRITVQTEKSPYQYRGMFHALSTVLREEGPRALYKGWLPSVIGVIPYVGLNFAVYESLKDWLIKSKPFGLAQDSELSVTTRLACGAVAGTFGQTVAYPLDVIRRRMQMVGWNHAASVVAGDGRGKVPLEYTGMIDAFRKTVRYEGFGALYKGLVPNSVKVVPSIAIAFVRTRW

SEQ ID NO: 8711 - protein, 350 aa, Sequoia sempervirens
MAESKEAAVATFVNLAEEAKLASEGVKAPSHAILTVCKSLVAGGVAGGVSRSAVAPLERLKILLQVQNPLNRKYNGTVQGIRYIWNTEGIRGLFKGNGTNCARIVPNSAVKFYSYEQASSAILWLYRQQTGNEEAQLTPILRLGAGACAGIIAMSATYPMDMVRGRLTVQTEKSPYQYRGMFHALSTVFREEGPRALYKGWLPSVIGVIPYVGLNFAVYESLKEWLLKSRPFGSDQGSELSVVTKLACGAAAGTIGQTVAYPLDVIRRRMQMVGWKDAASIVTGDGRSKAPLQYSGMIDAFRQTVRNEGFGALYRGLVPNSVKVVPSIAIAFVSYEVVKDLLGVEMRISD

SEQ ID NO: 8712 - protein, 507 aa, Cajanus cajan
MDYERIQKPQGGGGFSPGKLRSMLLGVEKKRKEEEELDSTFTTRSQNSDMDESGGSSSDHCKDVDVVSVLPEYSTSAIVRTSSIEAVAGDRVVKANAAVSSRTRILEDPSSDYDSGHDTTSMSSSVFEFQKAERAPQRVPVGPFSKPAPSKWDDAQKWIASPTSNRPKTAQTQGQGGHVGPRKVGSLGYGSRQPSMKVVVEVPDQREIALDEPDTKQIDTNQTKMESGGQKFVSWEADPYAIESSCVSLSQHNSSLAIQNATTFVPPPSTARSVSMRDMGTEMTPIASQEPSRTGTPVRATTPMRSPNSSRPSTPPRASPASTLTDSLSDNLNLTKNELSEKELQMKTRREIMVLGTQLGKMNIAAWASKEEEDKDASTSLKTKAEPPKSVIEARAVAWEEAEKAKYMARFRREEMKIQAWENHQKAKTEAKMRKIEVEVERIRSKAHDKLMNKLAAARHKAEEKRAAAEANRNHQAAKTEEQAEYIRRTGHVPSSYLSFSCCNWCS

SEQ ID NO: 8713 - protein, 508 aa, Vigna unguiculata
MVYERIQKPQGGGGFSPGKLRNMLLGVEKKRKEEEELDSTFTTRSQNSEMDESGGSSSDHCKDVDVVSVLPEYSTSALVRTSSIEAVGGDDRFVKANAAVSSRNRILEDPSSDYDSGHENMSISSSVFEFQKAERSTQRVPVRPFSKPAPSKWDDAQKWIASPTSNRPKTVQAQGQGGHVGPRKVGSLGYGSRQPSMKVVVEVPDQREIALDEPDTKQIDTNQTKMESGGQKFVSWEADPYAIASSCVSLSQHNSSLAIQNATTFVPPPSTARSVSMRDMGTEMTPIASQEPSRTGTPVRATTPMRSPNSSRPSTPPRSSPVSTLTDLHSDNLNLSKNELSEKELQMKTRREIMVLGTQLGKMNIAAWASKEEEDKDASTSLKTKAEQPKSVVEARAAAWEEAEKAKYMARFRREEMKIQAWENHQKAKTEAKMKKIEVEVERIRSKAHDKLMNKLAAARHKAEEKRAAAEANRNHQAAKTEEQADYIRRTGHVPSSYLSFSCCNWCS

SEQ ID NO: 8714 - protein, 508 aa, Vigna unguiculata
  misc_feature (83)..(83): Xaa can be any naturally occurring amino acid
MVYERIQKPQGGGGFSPGKLRNMLLGVEKKRKEEEELDSTFTTRSQNSEMDESGGSSSDHCKDVDVVSVLPEYSTSALVRTSXIEAVGGDDRFVKANAAVSSRNRILEDPSSDYDSGHENMSISSSVFEFQKAERSTQRVPVRPFSKPAPSKWDDAQKWIASPTSNRPKTVQAQGQGGHVGPRKVGSLGYGSRQPSMKVVVEVPDQREIALDEPDTKQIDTNQTKMESGGQKFVSWEADPYAIASSCVSLSQHNSSLAIQNATTFVPPPSTARSVSMRDMGTEMTPIASQEPSRTGTPVRATTPMRSPNSSRPSTPPRSSPVSTLTDLHSDNLNLSKNELSEKELQMKTRREIMVLGTQLGKMNIAAWASKEEEDKDASTSLKTKAEQPKSVVEARAAAWEEAEKAKYMARFRREEMKIQAWENHQKAKTEAKMKKIEVEVERIRSKAHDKLMNKLAAARHKAEEKRAAAEANRNHQAAKTEEQADYIRRTGHVPSSYLSFSCCNWCS

SEQ ID NO: 8715 - protein, 508 aa, Lotus japonicus
MDYERIQKPQGNGGFSPGKLRSMLLGVEKKRKEEEEVDSTFTPGSQNPDMDESGGSSSDHCKDVDVVSVLPDYSTSTARTWSIETAGGDRIGKVNAGITSKNRILEDPSLDYDSGQDNMSMSSSVFEFQKAERAPPRVPAGPFSKPAPSKWDDAQKWIASPTSNRPKTAQSQGQGGHGGPRKVGSLGYGSRQSSMKVVVEVPDQREIALDEPDTKQMDTDQTKMDSEGHKFASYEVDPYAVANSYVSLSQHNSSVAIQSATTFVPPPSTARSVSMRDMGTEMTPIASQEPSRTGTPVRSTTPMRSPNSSQPSTPTRTSPMSTLTDPHIDNLNLNKSELSEKELQMKTRREIMVLGTQLGKMNIAAWASKEEEDKDASTSLKAKTADQPAKSVIEARAAAWEEAEKAKYMARFRREEMKIQAWENHQKAKTEAKMRKIEVEVERIRSKSHDKLMNKLASARHKAEEKRAAAEANRNHQAAKTEEQAEYIRRTGHVPSSYLTFSWCSWCS

SEQ ID NO: 8716 - protein, 602 aa, Glycine max
MDYERIQKPQGGGGFSPGKLRSMLLGVEKKRKEEEELDSTFTTRSQNSDMDESGGSSSDHCKDVDVVSVLPEYSTSAIVRTSSVEAVGGDRFVKANAGVNSRSRILEDPSSDYDSGHDNMSMSSSMFEFQKAERAPQRVPVGPFSKPAPSKWDDAQKWIASPTSNRPKTVQSQGQGGQSGHVGPRKVGSLGYGSRQSSMKVVVEVPDQKEIALDEPDTKQIDTDQTKMETGGQKFVSWEADPYAIASSCGSLCLFGAGYSTWAYHQLCGSTSVGLFQLKPDVSGSSPGYANALNTWRESFAAYSSPIWLKQPPMEDTCDLDQKNLGLKLRFTCLSQHNSSLAIQNETTFVPPPSTARSVSMRDMGTEMTPIASQEPSRTGTPVRATTPMRSPNSSRPSTPPRASPASTLTDLHSDNLNLNMNELSEKELQMKTRREIMVLGTQLGKMSIAAWASKEEEDKDASTSLKTKTEPPKSVVVARAAAWEEAEKAKYMARFRREEMKIQAWENHQKAKTEAKMKKIEVEVERIRGKAHDKLMNKLAAARHKAEEKRAAAEANRNHQAAKTEEQAEYIRRTGHVPSSYLSFSCCNWYAMPFAAYTQAC

SEQ ID NO: 8717 - protein, 850 aa, Glycine max
MTGKKNVKAATTTTPEEEDQRKQTTTSSSPSSSSRSSSSSSSSDEREYEVQDLRDRLKSSRGSRFDLIENQLGLNSTWSKFSRQALLHGIRGFSVDFVIHPDNRWYRAWTKFILLWAVYSSFFTPMEFGFFRGLPENLFILDIIGQIAFLVDIVLQFFVAYRDSQTYRTVYKRTPIALRYLKSNFIFDLLGCMPWDIIYKACGRKEEVRYLLWIRLYRVRKVTDFFHKLEKDIRVNYIITRIVKLIVVELYCTHTAACIFYYLATTLPESQEGYTWIGSLKLGDFSYSHFREIDLWKRYTTSLYFAIVTMATVGYGDIHAVNMREMVFIMVYVSFDMILGAYLIGNMTALIVKGSKTEKFRDKMTDLMKYMNRNRLGRDIREQIKGHVRLQYESSYTEASVIQDIPISIRAKISQTLYLPYIEKVSLFKGCSSEFIRQIVIRLHEEFFLPGEVIMEQGNVVDQLYFVCHGVLEEVGTAEDGTEETVSLLQPNSSFGEISILCNIPQPYTVRVCELSRLLRLDKQSFTNILDIYFYDGRKVLNNLLEGKESFRDKQLESDITFHIGKQEAELALKVNNAAFNGDLYQLKGLIRAGADPNKTDYDGRSPLHLAASRGYEDITLFLIQERVDVNIKDNFGNTPLLEAVKNGHDRVASLLVREGASMKIENAGSFLCTAVARGDSDYLKRLLSNGMDPNLKDYDYRSPLHIAAAEGLYFMAKLLLEGGASVFTKDRWGNTPLDEARMCGNKNLIKLLEDAKSAQLSEFPSQEYTDKMHPKKCTVFPYHPWDPKDNRRHGIVLWIPHSIQELIKSAAEQIEFSGDACILSEDAGKVTDVDMIKDGQKLYLVHETH

SEQ ID NO: 8718 - protein, 851 aa, Phaseolus coccineus
MTESKNVKAAATEEREEGKQTTSSSTPLSHSRSLSLSSSSSSDEREYEVQDLRDRLKSSRGSRFNLIQNELGLNSRWSKFSREALLHGIRGFSKDFVIHPDNRWYRAWTKFILLWAVYSSFFTPMEFGFFRGLPENLFILDIIGQIAFLVDIFLQFFVAYRDSQTYRMIYKRTPIALRYLKSDFMLDLLGCMPWDVIFKASGRKEEVRYLLWIRLYRVRKVTDFFHKLEKDIRVNYITTRIVKLIVVELYCTHTAACIFYFLATTLPDSQEGYTWIGSLKLGDYSYSHFREIDLWKRYTTSLYFAIVTMATVGYGDIHAVNLREMIFVMVYVSFDMILGAYLIGNMTALIVKGSKTEKFRDKMTDLLKYMNRNKLGRDIREQIKGHVRLQYESSYTEAAVIQDIPISIRAKISQTLYLPYIENVSLFKGCSSEFINQIVIRIHEEFFLPGEVIMDQGNAVDQLYFVCHGVLEEVGIAEDGSEETVSLLQRHSSFGEISILCNIPQPYTVRVSELSRLLRLDKQSFTNILDVYFYDGRKVLNNLLEGKESFRGKQLKSDITFHIGKQEAELALKVNSAAFHGDLHQLKGLIRAGADPNKTDYDGRSPIHLAASRGHEDITLFLIKERVDINIKDNFGNTPLLEAVKNGNDRVASLLLKEGASMKIENAGSFLCTAVARGDSDYLKRLLSNGMDPNLKDYDYRSPLHIAAAEGLHFMAKLLLEAGATVFNKDRWGNTPLDEARMCGNKNLIKLLEEAKSAQLLEFPYSSQECTDKMHAKKCTVFPFHPWDPEDNRRHGIVLWIPHSIEELIKSAAEQINISGDSCILSEDGGKINDVDMIKDGQKLYLVNETH

SEQ ID NO: 8719 - protein, 309 aa, Vigna unguiculata
MHSLTCTPLSSSSSSHHTTLKPNLNPLLGADATSRPCSLPFKRRTCFTTRAILSSTREDVLKHFNERRALKIISGLQNFNKDNVASVVTAADKGGATHVDIACDPELVKLAIGLTSCPVCVSSVDPATFPAAVEAGALMVEIGNYDSFYEQGIIFTPEKILGLTKETRRILPSIVLSVTVPHTLSLPDQVKLAESLELVGVDVIQTEGGKCSNPTKSGVMGLIEKATPTLAAAYSISRAVKIPVMCSSGLSAVTAPMAITAGAAGVGVGSAVNRLNDVVAMIAEVRSIANSLQTSFQTSTTYEVETQRQ

SEQ ID NO: 8720 - protein, 309 aa, Glycine max
MYSLTCTPLSSSSYSHHTTLKPNLNPLLGADATSRPCSLPLKRRTCFTTKAILSSTREDVLKHFNERRALKIISGLQNFNKDNVASVVTAADKGGATLVDIACDPELVKLAIDLTSCPVCVSSVDPATFPAAVEAGALMVEIGNYDSFYEKGIIFTPEKILGLTKETRRILPSVVLSVTVPHTLSLPDQVKLAESLEQEGVDIIQTEGGKCSNPTQSGVMGLIEKATPTLAAAYSISRAVKIPVMCSSGLSTVTVPMAITAGAAGVGVGSAVNRLNDVVAMIAEVRSIANSLQTPFQISTAHEVETQRQ

SEQ ID NO: 8721 - protein, 303 aa, Phaseolus coccineus
MHSLTCTPLSSHHTTLNPLLGADATSRPFSHSLPFKRRTCFTTRAVLSSTREDVLKHFNERRALKIITGLQNFNKDNVASVVTAADKGGATHVDIACDPELVKLAIGLTSCPVCVSSVDPATFPAAVEAGALMVEIGNYDSFYEKGIIFTPEKILGLTKETRRILPSVVLSVTVPHTLSLPDQVKLAESLELEGVDIIQTEGGKCSNPTQSGVMGLIEKATPTLAAAYSISRAVKIPVMCSSGLSAVTAPMAITAGAAGVGVGSAVNRLNDVVAMIAEVRSIANSLQTSFQTSTIHEVETQRQ

SEQ ID NO: 8722 - protein, 303 aa, Phaseolus coccineus
  misc_feature (74)..(74): Xaa can be any naturally occurring amino acid
MHSLTCTPLSSHHTTLNPLLGADATSRPFSHSLPFKRRTCFTTRAVLSSTREDVLKHFNERRALKIITGLQNFXKDNVASVVTAADKGGATHVDIACDPELVKLAIGLTSCPVCVSSVDPATFPAAVEAGALMVEIGNYDSFYEKGIIFTPEKILGLTKETRRILPSVVLSVTVPHTLSLPDQVKLAESLELEGVDIIQTEGGKCSNPTQSGVMGLIEKATPTLAAAYSISRAVKIPVMCSSGLSAVTAPMAITAGAAGVGVGSAVNRLNDVVAMIAEVRSIANSLQTSFQTSTIHEVETQRQ

SEQ ID NO: 8723 - protein, 302 aa, Cajanus cajan
MHSLTCTPLSSSLKPNHNPLLAAVATSRPYSLPFKTTTCFTTRATLSSTRESVLNHFHQRTALKIISGLQNFNKDNVASVVTAADKGGATHVDIACDPELVKLAIGLTSCPVCVSSVDPATFPAAVEAGALMVEIGNYDSFYEKGMIFTPEKILGLTKETRRILPSVVLSVTVPHTLSLPDQVKLAESLEQEGVDIIQTEGGKCSNPTQSGVMGLIEKATPTLAAAYSISRAVKIPVMCSSGLSAVTAPMAITAGAAGVGVGSAVNRLNDVVAMIAEVRSIANSLQTPFQISTTHEVETQRQ

SEQ ID NO: 8724 - protein, 305 aa, Lotus japonicus
MHSLTCTPVSSPSHTLLKPNNNNPLLGSTWRPCPPLKRRACFTTRALLSSTKETVLKDFQERRALKIISGLHNFDKDNVASVVTAADKGGATHVDIACDPELVKLAISLTSCPVCVSSVDPATFPAAVEAGALMVEIGNYDSFYEKGVVFTPEQILILTKETRRLLPSIALSVTVPHTLSLPDQVKLAELLEQEGVDIIQTEGGKCSNPTKSGILGLIEKATPTLAAAYSISRAVKIPVMCSSGLSAVTAPMAITAGAAGVGVGSAVNRLNDVVAMIAEVRSIANSLKTPFQICPATHEVEINRQ

SEQ ID NO: 8725 - protein, 306 aa, Cicer arietinum
MHSLTCISLSSPSSTSFLNPNHNNPLLAATSRPCLLPLKRKTCFTTKALLSSTKESVLKDFREQMALKIISGLQNFDRENVASVVIAADKGGATHVDIACDPELVKLAISLTSCPVCVSSVDPATFPAAVEAGALMVEIGNYDSFYEKGMVFTPEQILSLTKETRRILPSIVLSVTVPHTLSLPDQVKLAESLELEGVDIIQTEGGKCSNPTKSGVLGLIEKATPTLAAAYSISRAVKIPVMCSSGLSAVTAPMAITAGAAGVGVGSAVNRLNDVVAMIAEVRSIADSLKTSFQIHSAHEVETHRQ

SEQ ID NO: 8726 - protein, 307 aa, Medicago truncatula
MHSLTCLTLSSPSSISSLKPNHNYNPLLGAASKPCLLTLKRKTSFTTRALLSSTKESVLKDFRERTALKIITGLQNFDKDNVASVVTAAEKGGATHVDIACDPELVKLAISLTSCPVCVSSVDPATFPAAVEAGALMVEIGNYDSFYEKGVIFTPEQILSLTKETRRILPSVVLSVTVPHTLSLPDQVKLAESLELEGVDIIQTEGGKCSNPTKSGVLGLIEKATPTLAAAYSISRAVKIPVMCSSGLSAVTAPMAITAGASGVGVGSAVNKLNDVVAMIAEVRSIADSLKTSLPIHTTHEVKTHFQ

SEQ ID NO: 8727 - protein, 305 aa, Arachis hypogaea
MHSLTCITISSSSSYTFLKPYHNPLLAPTSRPNLLTLKKKPCFSTKALLSSTKESVLKDFHERRALKIISGLHNFDKDNVASVVTAAEKGGATHVDIACDPELVKLAISLTSCPVCVSSVDPASFPAAVEAGALMVEIGNYDSFYEKGVVFTPQQILGLTKETRRILPSVTLSVTVPHTLSLPDQVKLAELLEQEGVDIIQTEGGKCSNPTKSGVLGLIEKATPTLAAAYSISRAVKIPVMCSSGLSAVTAPMAITAGAAGVGIGSAVNRLNDVVAMIAEVKSIATSLQTSSPMHATRKVETRRQ

SEQ ID NO: 8728 - protein, 870 aa, Triticum aestivum
ARRGVTRAVFERFTERAVKAVVHSQKEARGLGEGAVAPRHLLLGLVAEDRSAGGFLSSGITVERAREECRGLIGGAAQKAGGLDTDVPFDGGCRRVFEVAVELSRNMGCSFISPEHLAIALFTLDDPTTNNLLRSLGADPSQLASVAVTRLHEELAKDGRDLAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYETYHKCKFTLEAINAAVYLSARYIPDRQLPDKAIDLIDEAGSRARIESYQKKKEGQSSVLLKEPDEYWQEIKAVQAMHDVVSSNKMKYSPNKNNQQNASLNTEAPHQDKAEPTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYVGYGETGTLTEAVRRKPFTVVLLDEIEKAHPDIFNILLQIFEDGHLADSQGRRVSFKNTLIVMTSNVGSTSISNGRRSMGFSTEDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDSKGKPCLSRLNQPPIVQVSDSTRTF

SEQ ID NO: 8729 - protein, 881 aa, Hordeum vulgare
RPAAARRPARRGVTRAVFERFTERAVKAVVHSQKEARGLGEGAVAPRHLLLGLVAEDRSAGGFLSSGITVERAREECRGLIGAAAAAAHKAGGLDTDVPFDGGCRRVFEVAVELSRNMGCSFISPEHLAIALFTLDDPTTNNLLRSLGADPSQLASVAVTRLHEELAKDGRDTAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYETYHKCKFTLEAINAAVYLSARYIPDRQLPDKAIDLIDEAGSRARIESYQKKKEGQSSVLLKEPDEYWQEIKAVQAMHDVVLSNKMKYSPNENNQQNASLNAEGPRQDKAESTTEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISNGRRSMGFSTDDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDNKGKPCLSRLNQPPIVQVSDSTRTF

SEQ ID NO: 8730 - protein, 944 aa, Brachypodium distachyon
MEVCCCSTSSSVLAGDRVGRRFAPPAARYWGAVGGGGGRAVVLAHPLRPAAARPAQAQPHARRVRRGGAVIRSVFERFTERAVKAVVLSQREAKGLGAGAVAPRHMLLGLVAEDRSAGGFLSSGISIERAREECRSIGAQDAGAPPPPPAGSGLETDVPFSGTCKRVFEVAVEFSKNMGCSFISPEHLALALFTLDDPTTNTLLRSLGADPSQLASVALARLQGELAKDGRDPAGASSFKVPEKSPAGAGRSAFTKSLSKKKEKGALDQFCLDLTTQASGGFIDPIIGREEEIERVVQIICRRTKNNPILLGEAGVGKTAIAEGLALRIANGDVPIYLVAKRIMSLDVGLLIAGAKERGELESRVTNLIREVREAGDVILFIDEVHNLIGSGTVGKSKGAGLDISNLLKPPLARGELQCIAATTLDEHRMHFEKDKALARRFQPVLVEEPSQEDAVKILLGLRENYETYHKCKFTLEAINAAVYLSARYIPDRQLPDKAIDLLDEAGSRARIESFQRKKEGQSSVLLKAPDEYWQEIKAVKAMHEVVLSNKTKYSPNENAQENDSSNTEKQCQEKAGSTSTSSPSVEEPVVVGTEEIARVASLWSGIPVQQLTADDKKILVGLDDELRKRVIGQDDAVVAISRAVKRSRVGLSDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISSGRRSIGFSTDDTESSTYIAMKSLVMEELKGFFRPELLNRIDEMVVFRPLEKTQMLAILDIILQELKGRLLALGIGLEVSDAMKGLICQEGYDKSYGARPLRRAVTHLMEDVISEAILFGEYKPGDTILVDTDDEGKPCLSHLNKQIVQLSDPTRTF

SEQ ID NO: 8731 - protein, 938 aa, Oryza sativa
MEVCCCSTSSAVPGRRFAAAGAAAAAVAARWGAVGVGRAVVLAHPLRPAPRGGHAHAQQAGARRARRAVVRAVFERFTERAVKAVVLSQREAKGLGEGAVAPRHLLLGLIAEDRSAGGFLSSGINIERAREECRGIGARDLTPGAPSPSGSGLEMDIPFSGSCKRVFEVAVEFSRNMGCSFISPEHLALALFTLDDPTTNSLLRSLGADPSQLASVALTRLQAELAKDCREPAGASSFKVPKKSPAGAGRSAFSKSLNSKKEKGALDQFCLDLTTQASGGFIDPIIGREEEIERVVQIICRRTKNNPILLGEAGVGKTAIAEGLALRIANGDVPIYLVAKRIMSLDVGLLIAGAKERGELESRVTSLIREVREAGDVILFIDEVHNLIGSGTVGKGKGAGLDIGNLLKPPLARGELQCIAATTLDEHRMHFEKDKALARRFQPVLVEEPSQDDAVKILLGLREKYETYHKCKFTLEAINAAVYLSARYIPDRQLPDKAIDLIDEAGSRARMESFNRKKEGQSSILLKSPDEYWQEIRAAQNMHEVVSSNQMKYSPRQENGSAAIKAPSEDMNELTSELQVEEPIVVGTEEIARVASLWSGIPVQQLTADDRKLLVGLDGELRKRVIGQDDAVMAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLSDSQGRRVSFKNTLIVMTSNIGSTSISKGRRSMGFMTEDTESSSYVAMKSLVMEELKAFFRPELLNRIDEMVVFRPLEKTQMLAILDIILQEVKGRLLALGIGLEVSDAMKDLICEEGYDKSYGARPLRRAVTHLIEDVISEAILFGEYKPGDTILMDIDAGGKLCMSHLNEKVVQLSDPTRTF

SEQ ID NO: 8732 - protein, 885 aa, Avena sativa
APTRRPRRRAGVIRAVFERFTERAVKAVVLSQREAKGLREGAVAPRHMLLGLIAEDRSAGGFLSSGISIERAREECRSIGAQDAGASPPPPTSGLDTDVPFSGGCKRVFEVALELSRNMGCSFISPEHLAIALFTLDDPTTSNLLRSLGADPSQLASVALIRLQGELAKDGRDPAGASSFKVPEKSPAGAGRSAFTKSLSNKKEKGALDQFCLDLTTQASGGFVDPIIGREEEIERVVQIICRRTKNNPILLGEAGVGKTAIAEGLALRIANGNVPIYLVAKRIMSLDVGLLIAGAKERGELESRVTSLIREVREAGDVILFIDEVHNLIGSGTVGKGKGSGLDISNLLKPPLARGELQCIAATTLDEHRMHFEKDKALARRFQPVFVDEPSQEDAVEILLGLRENYEIYHKCKFTLEAINAAVYLSARYIPDRQLPDKAIDLIDEAGSRARIETFQKRKEGQSSVLLKAPDEYWQEIKAVQAMHEVVLSNKMKYSPNENDQHSDNGNNEAPNQDKAGSASTSPVSIEEPVVVGREEIARVTSLWSGIPVQQLTADDRKILVGLDDELKMRVIGQDDAVVAISRAVKRSRVGLSDPDRPIATFLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISDGRRSIGFSTDETESSTYIAMKSLVMEELKAFFRPELLNRIDEMVVFRPLEKTQMLAILDIILQELKGKLLALGIGLEVSDAMKSLICQEGYDKSYGARPLRRAVTQLMEDVISEAILFGEYKPGDTILVDTDKDGKPCLSRLNQQIVQLSDPTRTL

SEQ ID NO: 8733 - protein, 942 aa, Setaria italica
MEVCCCSTSSSVLAGGRGGAARRLAAPAAARWGAAGFWNRAVVLAHPLPRRASSSRPSPRRARRGLIMAVFERFTERAVKAVVLSQREARGLGEAAVAPRHLFLGLVAEDRSSGGYLSSGIGIERAREECRGIGARDVDAPPPPPPKTGSGLDTDVPFSAASKQVFEVAVVLSKNMGSSFISPEHLAIALFTLDDPTTNNLLRSLGADPSQLSSVAVDRLQAELAKDGRDPAGASSFKIPEKAPAAAGRSAFSQSLTKKKGKGALDQFCLDLTTQASGGFIDPIIGREEEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSSLDIGNLLKPALARGELQCIAATTLDEHRMHFEKDKALARRFQPVLVAEPSQEDAVKILLGLREKYETYHKCRFTLEAINAAVYLSARYIPDRQLPDKAIDLIDEAGSRARMESFNRKKEGQSSILLKSPDEYWQEIRAAQAMHEVVLSNKEKYSPNANDQESGNADVEAPYEDNRGSTSTSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLTDSQGRRVSFKNTLIVMTSNVGSTSISKGRRSIGFLKEDTESSSYVAMKSLVMEELKAFFRPELLNRIDEMVVFRPLEKTQMLAILDIILKEVKGRLLALGIGLEVSDAMKDLICQEGYDKSYGARPLRRAVTHMIEDVISEAILFGEFKPGNTILMDIDAEGKPCMSHLDQQIVQVTDPTRAF

SEQ ID NO: 8734 - protein, 947 aa, Zea mays
MEVCCCSTSSSVLTAGGRGAAARRLAAPAARWGAAGFGRAVVLAHPLPRPASAAAAAPTRRARRGGVGVVRAVFERFTERAVKAVVLSQREARGLGEPAVAPRHLLLGLVAEDRSSGGFLSSGINIERAREECRGIAASARDADSATAASRPGSSGLDTDVPFAAPTKQVFDVAVVLSKNMGSSFVSPEHLAIALFSLDDPTTNNLLRSLGADPSHLASVAVDRLQAELAKDGRDPAEPSSFKVPKKAPAAAGRSAFSQSLTKKKDKGALDQFCLDLTTQASGGFIDPIIGREEEIERVVQIVCRRTKNNPILLGEAGVGKTAIAEGLALRIANGDVPIYLVAKRILSLDVGLLIAGAKERGELESRVTNIIREVREAGDVILFIDEVHNLIGSGTVGKSKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNRKKEGQSSILLKSPDEYWQEIRAAQAMHEVVLSNKEKYSPNENAEESGSANVEALHRDNIESTSTSSLSADEPVVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLTDSQGRRVSFKNTLIVMTSNVGSTSISKGRQSIGFLKEDTESGSYFAMKSLVMEELKAFFRPELLNRIDEMVVFRPLEKTQMLAILDIILKEVKGRLLALGIGLEVSDAMKDLICQEGYDKSYGARPLRRAVTHIIEDVISEAILFGEFKPGDTILMDIDAEGKPCMGHLDQQIVQVSDPTRAI

SEQ ID NO: 8735 - protein, 957 aa, Sorghum bicolor
MEVCCCSTSSSSSVLTVGHGGAARMLAAPAGRWGAAAGFGRAMVLAHQLPLPLPLPLPRPAARARARPAPRRRRGGGVVRAVFERFTERAVKAVVLSQREARGLGEPAVAPRHLFLGLVAEDRSSGGFLSSGINIERAREECRGIAAARDDADSTAAPSSRPGSGGLDTDVPFSATAKQVFDVAVVLSKNMGASFISPEHLAIALFTLDDPTTNNLLRSLGADPSHLASVAVDRLQAELAKDGREPAEPSSFKVPKKAPAGAGRSAFSHSLTKKKDKGALDQFCLDLTTQASGGFIDPIIGREDEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNKKKEGQSSILLKSPDEYWQEIRAAQAMHEVVLSNKAKYSPNENAQESGSATVEAPSRDNIESTSGSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLMDEIEKAHPDIFNILLQIFEDGHLTDSQGRKVSFKNTLIVMTSNVGSTTISKGRQSIGFLKEDTESSSYFAMKSLVMEELKAFFRPELLNRIDEMVVFRPLEKTQMLAILDIILKEVKGRLLALGIGLEVSEAMKHLICQEGYDKSYGARPLRRAVAHIIEDVISEAILFGEFKPGDTILMDIDAEGKPCMNHLDRQIVQVSDPTRTF

SEQ ID NO: 8736 - protein, 496 aa, Secale cereale
MTSTVTTPTPSRPLPAGPQRRRYRPTVLAIAGGSKPPRRRAPAAATSCAALVAPEKQSTASAKIQPSPAQVPVPEGTDYDEVAATLETLYKLSPVIVEEDEKRSKKQAATKTKRKQGRKNSAAATTTTTATPRRTVVVRSQRQRRMDLGKRVEMRDLAAGKEDEHRDGERAFEEALLREHAVSTDMGSLDWRRMKIPPVLSAPQSARLFKIMQPMKAILEVQENLRNELQREPTDAEVAEAMNMPVQRLRRLRDVGRAARNKLIKHNLRLVLYAINKYYPDMTGDERFADLCQAGANGLITAIDRFEPKRGFRISTYALFWIRHSVVRAMTLSSFTRFPFAMESERQEINRAREELSFELGRTPTDEETMKKVGLSPARYRDVVRMTRPTYSLHSRNRVTQKELINEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 8737 - protein, 482 aa, Avena sativa
MTSTVTTPSRPLSAGGQRRRYRPTVLAIAGGAKSPKRRAPAAKALASKQSTAVAKLPPPPAPSEEAGVISTDYNEVAAALETLYKRSPALVEEDEQSKKATKKKRKGRKKAAAGTTTTTPTRTTVVVRSRRRRRMDLGKRVEMREAAAKEEVGEERGFEEALLREHAVSTDMGSLDWRRMKIPPVLSAAQSARLFKIVQPMKAILEVHENLQSELEREPTDVEVAEAMNMPVQRLRRCREVGRAARNKLIKHNLRLVLYAINKYYPDMTGDERFADLCQAGANGLITAIDRFEPKRGFRISTYALFWIRHSVVRAMTLSSFTRFPFAMESERQEINRAREELAFELGRAPTDEETMKKVGLSPARYRDVVRMTRPTYSLHSRNRVTQEELINEVTDGDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 8738 - protein, 773 aa, Triticum aestivum
MGTSGSKGLDGVGGLGAAALAGGSGGGMGGDEGDGAVTGSWHGGAQLYVSLKMENARIIGDLVPHVYGSEPIIGSWEPARALAMERELASMWELSFVVPPDHETLDFKFLLKPKDAETPCIIEEGPTRLLTGGMLEGDVRLANFRLNGDDELLEFRVFNKADIVSPLDLAASWRVYKENFQPSKVRGIPDISINEAPTHATEDGSGSSLELDLEHYVVPTPTAPPTEYAANLAATPASLDQPETPWTNDMLLSDGIQSPRSAAADFKDDSYHNKDTEASIADSSNSKKLQVSGMVESKSVGTLIQLQKKDRPQGLYVDRGVVSPKLGKSFSACSLASGLNFGSTKAMPEAAGAVAAAAVADRLHGSKEDRKLAIVLVGLPARGKTFTAVKLTRYLRWLGHETKHFNVGKYRRLKHGANQSADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 8739 - protein, 773 aa, Secale cereale
MGTSGSKGMDGVGGLGAAALGGGGGGGMGGDEGDGAVTGSWHGGAQLYVSLKMENARIIGDLVPHVYGSEPIIGSWEPARALAMERELASMWELSFVVPPDHETLDFKFLLKPKDAETPCIIEEGPTRLLTGGMLEGDVRLANFRLNGDDELLEFRVFNKADFVSPLDLAASWRVYKENFQPSKVRGIPDISINEAPTHATEDESGSSLELDLEHYVVPTPTAPPTEYAANLAATPASLDQPEAPWTNDVLLSDGIQSPRSAAADFKDDSYHNKDTEASIADSSNSKKLQVSGMVESKSVGTLIQLQKKDKPQGLYVDRGVVSPKLGKSFSACSLADGLNFGSTKAMPEAAGAVAAAAVADRLHGSKEDRKLAIVLVGLPARGKTFTAVKLTRYLRWLGHETKHFNVGKYRRLKHGANQSADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 8740 - protein, 765 aa, Hordeum vulgare
MDGVGGLGSAALAGGGGDGMGGDEGGGAVTGSWHGGAQLYVSLKMENARIIGDLVPHVYGSEPIIGSWEPARALAMERELASMWELSFVVPPDHETLDFKFLLKPKDSETPCIIEEGPTRLLTGGMLEGDVRLANFRLNGDDELLEFRVFNKADIVSPLDLAASWRVYKENFQPSKVRGIPDISINEAPTHATEDGSGSSLELDLEHYVVPAPTAPPTEYAANLAATPASLDQPEAPWTNDMLLSDGIQSPRSAAADFKDDSYHNKDTEASVADSSNSKKLQVSGMVESKSVGTLIQLQKKDKPQGLYVDRGVVSPKLGKSFSACSLASGLNFGSTKAMPEAAGAVAAAAVADRLHGSKEDRKLAIVLVGLPARGKTFTAVKLTRYLRWLGHETKHFNVGKYRRLKHGANQSADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 8741 - protein, 770 aa, Brachypodium distachyon
MGTSGSKGMDGVGGVGAAAAAGGAGIQDEDGVGGAGMESWHGGAQLYVSLKMENARIIGDLVPHVYGSEPIIGSWDPARALAMERELASMWELSFVVPPDHETLYFKFLLKPKDAETPCVIEEGPTRLLTGGMLEGDVRVANFRLNGDDEVLEFRVFNKADIVSPLELAASWRVYKENFQPSQVRGIPDVSINVAPAHATEDGSGSSLELDLEHYVVPTPTAPPTEYAANLAATPASLIQPGALWTNDMLLSDGIQSPSSASADFRDHSYHNKDIEASVADSSKKLQVCGMVESKSVGTLIPLQKQDRQKGLYVDTGVVSPKLGKSFSACALASGLSFASTKAMPEAAGAVAAAAVADRLHGSKEDRKLAIVLVGLPARGKTFTAVKLTRYLRWLGHETKHFNVGKYRRLKHGANQSADFFRADNQQGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVEEGSYIKMIDMVKGQGGQLQVNNISGYLPGRIVFFLVNSHLAPRPILLTRHGESLHNVRGRVGGDTVLSENGELYAKKLANFIEKRLKSEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 8742 - protein, 772 aa, Oryza sativa
MGTSGSKGIDGVGGVGGGAAGLGGGEAGDGGGGVGGAASRSWHGGAQLYVSLKMENARITGDLVPHVYGSEPIIGSWDPARALAMERELASMWALSFVVPPDHETLDFKFLLKPKDADTPCIIEEGPTRHLTGGMLEGDVRIAWFKMNGDHETLEFRVFNKADIVSPLDLAASWRVFKENFQPSKVRGIPDVSINVAPAHGTEDTSTESLELDLEHYVIPTPSAATSEYAANLAANPASLIQTGALWTNDMLLSDGIQSPSSATADFEDHNNCNKDNVALPSDSFKKLQVSGIVESKSVDTLTTLQKQDGQKGLFVDRGVGSTKFGKSSSACSLASGLNFGTGKAMPEAAGAVAAAAVADRLHGSKEDRKLAIVLVGLPARGKTFTAAKLTRYLRWLGHETRHFNVGKYRRLKHGANQSADFFRDDNPEGIEARNEVAALAMEDMIDWMHGGGQVGIFDATNSTRKRRYMLMKMAEGNCKIIFLETICNDPNIIERNVRLKIQQSPDYADQPDYETGVRDFKERLANYEKVYEPVQEGSYIKMIDMVKGQGGQLQVNNISGYLPGRIVFFLVNSHLTPRPILLTRHGESLHNVRGRVGGDTVLSEDGELYSKKLANFIEKRLKSEKTASIWTSTLQRTILTASPIVGFPKIQWRALDEINSGVCDGMTYEEIKKVMPEEFESRKKDKLRYRYPRGESYLDVIQRLEPVIIELERQRAPVVVISHQAVLRALYAYFADRPLREVPDIEMPLHTIIEIQMGVTGVEEKRYKLMD

SEQ ID NO: 8743 - protein, 768 aa, Setaria italica
MGTSGSKGIDGVGGLGSQAAGVGAAGGDGEAGEGGGAAEAWHGGAQLYVSLKMENARISGDLVPHVYGSEPIIGSWDPARALAMERELASMWELSFVVPPDHETVEFKFLLKPKDTATPCIIEEGPTRLLTGGMLEGDVRVALFKLNGDDEVLEFRVFNKADIVSPLELAASWRVYKENFQPSRVRGIPDISINVAPTHATEEGSAATLELDLEHYVVPAPTAPPNEYAANLTATPASLIQTGASWTNDMLLSDGIQSPSTVSADFEGCNNLKKNIEAWATDSSKKLQGSGLIESKSVGTFTPLQKPDGQKGLFIDRGVGSPKLPKSASAYSLASGLSSKTMPEAAGAVAAAAVADRLHGSKEDRKLAIVLVGLPARGKTFTAVKLTRYLRWLGHETRHFNVGKYRRLKHGANQAADFFRDDNPEGIEARNEVAALAMEDMIDWMHGGGQVGIFDATNSTRKRRHMLMKMAEGNCKIIFLETICNDPRIIETNIRLKIQQSPDYADQPDYEAGLQDFKERLTNYEKVYEPVGEGSYIKMIDMVKGQGGQLQVNNISGYLPGRIVFFLVNSHLTPRPILLTRHGESLHNVRGRVGGDSVLSEAGELYANKLANFIEKRLKSEKTATIWTSTLQRTILTASPIIGFPKIQWRALDEINSGVCDGMTYEEIKKIMPEEYESRRKDKLRYRYPRGESYLDVIQRLEPVIIELERQQAPVVVISHQAVLRALYAYFADRPLREVPNIEMPLHTIIEIQMGVTGVEEKRYKLMD

SEQ ID NO: 8744 - protein, 769 aa, Sorghum bicolor
MGTSGSKSIDGVGAVSGVGAAAAGLGGAGGEGGEGGAAEAWHGGAQLYVSLKMENAEISGDLVPHVYGSEPIIGTWDPSRALAMERELASMWELSFVVPPDHETLDFKFLLKPKDAETPCIIEEGPTRLLTGGMLEGDVRVALFKLNGDDEVLEFRVFNKADLVSPLELAASWRVYKENFQPSKVRGIPDISINVAPTNATEEGSAATLELDLEHYVVPSPPTAPPNGYAANLAATPASMIQTGASWTNDILLSDGIQSPSSVSAKLEDRSNNKKNIEAWATDSSKNSGLIESKSVGTFTPLQKLDGQKGLFVDRGVGSPMLPKSASACSLASGFSFGSAKTMPEAAGAVAAAAVADRLHGSKEDRKLAIVLVGLPARGKTFTAVKLTRYLRWLGHETRHFNVGKYRRLKHGANQPADFFRDDNPEGIEARNEVAALAMEDMIDWMNGGGQVGIFDATNSTRKRRYMLMKMAEGNCKIIFLETICNDPNIIERNIRLKIQQSPDYADQPDYEAGLEDFKERLINYEKVYEPVGEGSYIKMIDMVKGQDGQLQVNNISGYLPGRIVFFLVNSHLTPRPILLTRHGESLHNVRGRVGGDTVLSETGELYAKKLANFIEKRLKYEKTATIWTSTLQRTILTASPIVGFPKIQWRALDEINSGVCDGMTYEEIKKNMPEEFESRKKDKLRYRYPRGESYLDVIQRLEPVIIELERQRAPVVVISHQAVLRALYAYFADRPLREVPDIEMPLHTIIEIQMGVLGVEEKRYKLMD

SEQ ID NO: 8745 - protein, 773 aa, Zea mays
MGTSGSKGIDGVGAVSGVGAGAAGLGGVGAGGDGGEGAAAEAWHGGAQLYVSLKMENALISGDLVPHVYGSEPIIGTWDPSRALAMERELASMWVLSFVVPPDHETLDFKFLLKPKDAETPCIIEEGPTRLLTGGMLEGDVRVALFKLNGDDEVLEFGVVNKADLVSPLELAASWRVYKENFQPSKVRGIPDISINVTPTNGAEEGSAATLELDLEHYVVPSPPTAPPNGYAANLAATPASVIQTEALLTNDILLSDGIQSPSSVSAKLEDCTNHKNIEAWATDSSKKIQNSGLIESKSVGTFTPMQKLDGQKGLFVDRGVGSSMLPKSASACSLASGFSFGSAKTMPEAAGAVAAAAVADRLHGSKEDRKLAIVLVGLPARGKTFTAVKLTRYLRWLGHETRHFNVGKYRRLKLGANQSADFFRDDNPEGIEARNEVAALAMEDMIDWMNGGGQVGIFDATNSTRKRRYMLMKMAEGNCKIIFLETICNDPNIIERNIRLKIQQSPDYAEQLDYEAGLEDFKERLINYEKVYEPVGEGSYIKMIDMVKGQDGQLQVNNISGYLPGRIVFFLVNSHLTPRPILLTRHGESLHNVRGRVGGDTVLSETGELYAKKLANFIEKRLKCEKTATIWTSTLQRTILTASPIVGFPKIQWRALDEINSGVCDGMTYEEIKKIMPEEFESRKKDKLRYRYPRGESYLDVIQRLEPVIIELERQRAPVVVISHQAVLRALYAYFADRPLREVPEIEMPLHTIIEIQMGVTGVEEKRYKLMD

SEQ ID NO: 8746 - protein, 327 aa, Pseudoroegneria spicata
MRVVAIASPGGPEALQVREVEDLPAPGEGEVLVAVAAAGVNRADTVQRQGRYPPPPGASPYPGLECSGTILALGANVPPRWAVGDQVCALLTGGGYADKVVVPAGQLLPVPEGVSLTDAAGLPEVACTVWSTVFMTSHLSPGESFLIHGGSSGIGTFAIQIAKHLGVKVFVTAGSEEKLAACKGLGADVCINYKTEDFVARIKEETNGKGVDVILDNIGASYLQRNLNSLAVDGRLFIIGFMGGVTTEVNLQAMLARRLTIQAAGLRNRSLANKAQIVSEVEKNVWPAVVSGKVKPVIYKTFPLSEAAESHKLMETSSHIGKILLIP

SEQ ID NO: 8747 - protein, 327 aa, Hordeum vulgare
MRVVAIASPGGPEALQVREVDDLPPPGEGEVLVAVAAAGVNRADTAQRQGRYPPPPGASPYPGLECSGTILALGANVPPRWAVGDQVCALLTGGGYAEKVVVPAGQLLPVPEGVSLTDAAGLPEVACTVWSTVFMTSHLSPGESFLIHGGSSGIGTFAIQIAKHLGIKVFVTAGNEEKLAACKDLGADVCINYKTEDFVARVKEETNGKGVDVILDNIGGSYLQRNLNSLAVDGRLFIIGFMGGTTTEVNLQAMLARRLTIQGAGLRNRSLANKAQIVSEVEKNVWPAVVSGKVKPVIYKTFPLSEAAESHKLMETSSHIGKILLIP

SEQ ID NO: 8748 - protein, 327 aa, Hordeum vulgare
MRVVAIASPGGPEALQVREVDDLPPPGEGEVLVAVAAAGVNRADTAQRQGRYPPPPGASPYPGLECSGTILALGANVPPRWAVGDQVCALLTGGGYAEKVVVPAGQLLPVPEGVSLTDAAGLPEVACTVWSTVFMTSHLSPGESFLIHGGSSGIGTFAIQIAKHLGIKVFVTAGNEEKLAACKDLGADVCINYKTEDFVARVKEETNGKGVDVILDNIGGSYLQRNLNSLAVDGRLFIIGFMGGTTTEVNLQAMLARRLTIQGAGLRNRSLANKAQIVSEVEKNVWPAFVSGKVKPVIYKTFPLSEAAESHKLMETSSHIGKILLIP

SEQ ID NO: 8749 - protein, 327 aa, Secale cereale
MRVVAIASPGGPEALQVREVDDLPAPGEGEVLVAVAAAGVNRADTAQRQGRYPPPPGASPYPGLECSGTILALGANVPPRWAVGDQVCALLTGGGYADKVVVPAGQLLPVPEGVSLTDAAGLPEVACTVWSTVFMTSHLSPGESFLIHGGSSGIGTFAIQIAKHLGVKVFVTAGSEEKLDACKALGADVCINYKTEDFAARIKQETNGKGVDVILDNIGGSYLQRNLNSLAVDGRLFIIGFMGGTTTEVNLQAMLARRLTIQAAGLRNRSLASKAQIVSEVEKNVWPAVVSGKVKPVIYKTFPLSEAAESHKLMETSSHIGKILLIP

SEQ ID NO: 8750 - protein, 320 aa, Leymus cinereus x Leymus triticoides
SPGGPEALQLREVEDLPAPGEGEVLVAVAAAGVNRADAVQRQGRYPPPPGASPYLGLECSGTILALGANVPPRWAVGDQVCALLTGGGYAEKVVVPAGQLLPVPEGVSLADAAGLPEVACTVWSTVFMTSHLSPGESFLIHGGSSGIGTFAIQIAKHLGVKVFVTAGSEEKLAACKGLGADVCINYKTEDFVARIKEETNGKGVDVILDNIGGSYLQRNLNSLAVDGRLFIIGFMGGTTTEVNLQAMLARRLTIQAAGLRNRSLANKAQIVSEVEKNVWPAVVSGKVKPVVYKTFPLSEAAEAHKLMETSSHIGKILLIP

SEQ ID NO: 8751 - protein, 206 aa, Avena sativa
MKAVVISSPGGPEALEVREVEDLPAPGEGEVLVKVAASGVNRADTVQRQGKYPPPPGASLYPGLECSGTIIALGSNVPSRWAVGDQVCALLTGGGYAEKVVVPAGQLLPVPEGVSLTDAAGLPEVACTVWSTVFMTSHLSPGESFLIHGGSSGIGTFAIQIAKHLGIKVLVTAGSEEKLAACKDLGADVCINYKTEDFVARIKERN

SEQ ID NO: 8752 - protein, 327 aa, Avena sativa
MKAVVISSPGGPEALELREVEDLPAPGEGEVLVQVAAAGVNRADTVQRQGKYPPPPGASLYPGLECSGTIVALGANVPSRWAVGDEVCALLTGGGYAEKVVVPAGQLLPVPEGVSLTDAAGLPEVACTVWSTVFMTSHLAPGESFLIHGGSSGIGTFAIQIAKHLGIKVLVTAGSEEKLAACKDLGADVCINYKTEDFVARIKEETDGKGVDVILDNIGGSYLQRNLNSLAVDGRLFIIGFMGGVVTEVNLAVMLARRLTVQAAGLRNRSIANKAQIVSEVEKNVWPAVVSGKVKPVVYKTFPLSEAAESHKLMETSSHIGKILLIP

SEQ ID NO: 8753 - protein, 327 aa, Brachypodium distachyon
MRAVVIASPGGPEALEVREVEDLLAPGEGEVLVEVAAAGVNRADTVQRQGRYPPPPGASPYPGLECSGTILALGANVPARWAVGDQVCALLTGGGYAEKVVVPAGQLLPVPEGVSLTDAAGLPEVACTVWSTVFMTSHLSSGESFLIHGGSSGIGTFAIQIAKHLGIKVFVTAGSEEKLVACKGLGADVCINYKSEDFEARIKEETNGKGVDVILDNIGGSYLQRNLNILAVDGRLFIIGLMGGAVTEVNLQAIFARRLTVQAAGLRNRSLDNKAQIVSEVEKNVWPAILLGKVKPVVYKTFPLSEAAEAHKLMESSSHIGKILLVP

SEQ ID NO: 8754 - protein, 328 aa, Oryza sativa
MRAVVIARAGGPEVLEERDVGEGLPPPGEGEVLVGVSAAGVNRADTVQRQGRYPAPPGASPYPGLECSGTILALGPNVPSRWAVGDQVCALLSSGGYAEKVVVPAGQLLPVPEGVSLTDAAGLPEVACTVWSTVFVTSHLSPSESFLIHGGSSGIGTFAIQIAKHLGIKVFVTAGSEEKLAACKGLGADVCINYKTEDFVARVKEETNGKGVDVILDNIGGLYLQRNLNSLAVDGRLFIIGFQGGAVTEVNLQPMLARRLTIQAAGLRNRSLDNKALIVSEVEKNVWPAVVQGKVKPVIYKTFPLSEAAEAHKLMEESSHIGKILLIP

SEQ ID NO: 8755 - protein, 327 aa, Pennisetum glaucum
MRAVVIARPGGPEVLEAREVEDPPAPGEGEVLLEVAAAGVNRADTVQRMGRYPPPAGAPPYPGLECSGTILALGTNVPSRWAVGDQVCALLSGGGYAEKVVVPAGQLLPIPEGVSLRDAAGLPEVASTVWSTVFMTSHLSPGESFLIHGGSSGIGTFAIQIAKHLGIKVFVTAGSEEKLAACKGLGADVCINYKTEDFVDRVKQETNGKGVDVILDNIGGSYLQRNLNSLGVDGRLFIIGFQGGVVAEVNLQAVLARRLTVQAAGLRSRSPASKAQIVSEVEKNVWPAVATGKVKPVIYKTFPLSEAAEAHRLMEASTHIGKILLLP

SEQ ID NO: 8756 - protein, 331 aa, Setaria italica
MRAVVIARPGGPEVLEAREVEDPPAPGEGEVLLEVAAAGVNRADTVQRMGRYPPPAGASPYPGLECSGTILALGPNVPSRWAVGDKVCALLSGGGYAEKVLVPAGQLLPIPEGVSLTDAAGLPEVACTVWSTVFMISHLSPGESFLIHGGSSGIGTFAIQIAKHLGIKVFVTAGSEEKLAACKGLGADVCINYKTEDFVDRVKQETNGKGVDVILDNIGGSYLQRNLNSLGVDGRLFIIGFQGGTVAEVNLQAVLARRLTVQAAGLRSRSPANKAQIVSEVEKNVWPAVAAGKVKPVIYKTFPLSEAAEAHRLMEASTHIGKILLLPGLHM

SEQ ID NO: 8757 - protein, 328 aa, Saccharum officinarum
MRAVVITRGGGGPEVLEAQEVEDPAPLGDGEVLLQVAAAGVNRADTLQRHGRHPPPAGAPPYPGLECSGTILALGPNVPPRWAVGDKVCALLSGGGYAEKVVVPAGQLLPVPEGVSLTDAAGLAEVACTVWSTVFMTSHLSPGESFLIHGGSSGIGTFAIQIAKHLGIKVFVTAGSEEKLAACKDLGADVCINYKTEDFVERVKQETDGKGVDVILDNIGGPYLQRNLNSLGVDGRLFIIGFQGGAVTEVNLQAVFARRLTIQAAGLRGRSLANKAQIVSEVEKNVWPAVAAGKVKPVIYKTFPLSEAAEAHRLMETSTHIGKILLLP

SEQ ID NO: 8758 - protein, 329 aa, Setaria italica
MRAVVITRGGGPEVLEAQEVEDPAPLGEGEVLLQVAAAGVNRADTLQRHGRHPPPAGASPYPGLECSGTILALGPNVPSRWSVGDKVCALLSGGGYAEKVVVPAGQLLPVPEGVSLTDAAGLPEVACTVWSTVFMTSHLSPGESFLIHGGSSGIGTFAIQIAKHLGIKVFVTAGSEEKLAACKGLGADVCINYKTEDFVERVKQETNGKGVDVILDNIGGLYLQRNLNSLGVDGRLFIIGFQGGAAAEVNLQPVLARRLTIQAAGLRGRSPANKAQIVSEVEKNVWPAVAAPAGKVKPVIYKTFPLSEAAEAHRLMETSTHIGKILLLP

SEQ ID NO: 8759 - protein, 328 aa, Sorghum bicolor
MRAVVITRGGGGPEVLEAQEVEEPAPLGDGEVLLQVAAAGVNRADTLQRHGRHPPPPGAPPYPGLECSGTILALGPNVPPRWSVGDKVCALLSGGGYAEKVVVPAGQLLPVPEGVSLTDAAGLPEVACTVWSTVFMTSHLSPGESFLIHGGSSGIGTFAIQIAKHLGIKVFITAGSEEKLAACKDLGADVCINYKTEDFVERVKQETDGKGVDVILDNIGGPYLQRNLNSLGVDGRLFIIGFQGGAVTEVNLQAVLARRLTIQAAGLRNRSLANKAEIVGEVEKNVWPAVAAGKVKPVIYKTFPLSEAAEAHRLMEASTHIGKILLLP

SEQ ID NO: 8760 - protein, 326 aa, Secale cereale
MRAVAIARPGGPEVLEEREVEDVPAPGDARWCSGCRRRRQPHRHGPAAGRVPGAARRLAIPGGRVLRLHPRSRGQRPPALGRRRPGVRAAHRRRVRGEGGGAGGAAAAGAGGGVADGRRRLARGGLHRLVHRLHGQPPLPRRILPYPRWIKRNRYICDTDGKAPRSQGFVTAGSQEKLDACAGLGADVCINYKTEDFEARIKEETNGNGVDVILDNIGGSYVQRNLNSLAVDGRLFIIGFMGGTVTEVNLHAMLARRLTIQVAGLRSRSLANKAHIVSEVEKNVWPAIVSGKVKPVVYRALPLSEAAEAHKLMESSTHIGKILLIP

SEQ ID NO: 8761 - protein, 327 aa, Zea mays
MRAVVITCAGGPEVLEAREVEDHPALGEGEVLLEVAAAGVNRADTVQRMGRYPPPAGASPYPGLECSGTILALGPNVPSRWAVGDKVCALLSGGGYADKVVAPAGQLLPIPEGVSLTHAAGLPEVACTVWSTVFMTSHLSPGESFLIHGGSSGIGTFAIQIAKHLGIKVFVTAGSEEKLAACKALGADVCINYRTEDFVERIKQETNGKGVDVILDNIGGSYLQRNLNSLGVDGRLFIIGFQGGIAAEVNLQAVLARRLTIQAAGLRNRSLANKAEIVSEVEKNVWPAVAAGKVKPVIYKTFPLCEAAEAHRLMEASTHIGKILLLP

SEQ ID NO: 8762 - protein, 327 aa, Panicum virgatum
MRAVVITRGGGPEVLEAQDVEDPAPLGEGEVLLQVAAAGVNRADTLQRHGRHPPPAGASPYPGLECSGTILALGPNVPSRWSVGDKVCALLSGGGYAEKVVVPAGQLLPVPEGVSLTDAAGLPEVACTVWSTVFMTSHLSPGESFLIHGGSSGIGTFAIQIAKHLGIKVFVTAGSEEKLAACKDLGADVCINYKTEDFVERVKQETNGKGVDVILDNIGGSYLQRNLNSLGVDGRLFIIGFQGGAVAEVNLQAVFARRLTIQAAGLRGRSPANKAQIVSEVEKNVWPAVTAGKVKPVIYQTFPLSEAAEAHRLMEASTHIGKILLLP

SEQ ID NO: 8763 - protein, 327 aa, Panicum virgatum
MRAVVITRGGGPEVLEAQDVEDPAPLGEGEVLLQVAAAGVNRADTLQRHGRHPPPAGASPYPGLECSGTILALGPNVPSRWSVGDKVCAVLSGGGYAEKVVVPAGQLLPVPEGVSLTDAAGLPEVACTVWSTVFMISHLSPGESFLIHGGSSGIGTFAIQIAKHLGIKVFVTAGSEEKLAACKDLGADVCINYKTEDFVERVKQETNGKGVDVILDNIGGSYLQRNLNSLGVDGRLFIIGFQGGAVAEVNLQAVLARRLTIQAAGLRGRSPANKAQIVSEVEKNVWPAVTAGKVKPVIYKTFPLSEAAEAHRLMEASTHIGKILLLP

SEQ ID NO: 8764 - protein, 327 aa, Secale cereale
MRAVAIARPGGPEVLEEREVEDVPAPGDGEVVLRVAAAGVNRTDTVQRQGGYPAPPGASPYPGVECSGAILALGANVHPRWAVGDQVCALLTGGGYAEKVVVPAGLLLPVPAGVSLTDAAGLPEVACTVWSTVFMASHLSPGESFLIHGGSSGIGTFAIQMAKHLGIKVFATAGSQEKLDACAGLGADVCINYKTEDFAARIKEETNGNGVDVILDNVGGSYLQRNLDSLAVDGRLFIIGFMGGTVTEVNLHAMLARRLTIQVAGLRSRSLANKAHIVSEVEKNVWRAIVSGKVKPVVYRALPLSEAAEAHKLMESSTHIGKILLIP

SEQ ID NO: 8765 - protein, 295 aa, Triticum aestivum
TRPRRGRSRAPAGRRCWRRARWRTSRRRGTARCSSGWPPPASTAPTRSSGRAGTPPPPGASPYPGVECSGSILALGANVHPRWAVGDQVCALLNGGGYAEKVVVPAGQLLPVPEGVSLTDAAGLPEVACTVWSTVFMSSHLSPGESFLIHGGSSGIGTFAIQMAKHLGIKVFVTAGSQEKLDACAGLGADVCINYKTEDFAACIKEETNGNGGDVILDNVGGSYLQRNLDSLAVDGRLFIIGFMGGSVTEVNLQAMLARRLTIQVAGCGAEALPIKLRSSARWREMYGQPLRRAM

SEQ ID NO: 8766 - protein, 321 aa, Triticum aestivum
RAPAGRRCWRRARWRTSRRRGTARCSSGWPPPASTAPTRSSGRAGTPPPPGASPYPGVECSGSILALGANVHPRWAVGDQVCALLNGGGYAEKVVVPAGQLLPVPEGVSLTDAAGLPEVACTVWSTVFMSSHLSPGESFLIHGGSSGIGTFAIQMAKHLGIKVFVTAGSQEKLDACAGLGADVCINYKTEDFAACIKEETNGNGGDVILDNVGGSYLQRNLDSLAVDGRLFIIGFMGGSVTEVNLQAMLARRLTIQVAGLRSRSLANKAQIVSEVERNVWPAVASGNVKPVVYRTLPLSEAAEAHKLMESSSHIGKILLIP

SEQ ID NO: 8767 - protein, 316 aa, Secale cereale
PEVLEEREVEDVPAPGDGEVVLRVAAAGVNRTDTVQRQGGYPAPRGASPYPGVECSGSILALGANVHPRWAVGDQVCALLTGGGYAEKVLVPAGLLLPVPEGVSLTDAAGLPEVACTVWSTVFMTSHLSPGESFLIHGGSSGIGTFAIQMAKHLGIKVFVTAGSQEKLDACAGLGADVCINYKTEDFEARIKEETNGNGVDVILDNIGGSYLQRNLDSLAVDGRLFIIGFMGGTVTEVNLHAMLARRLTIQVAGLRSRSLANKAHIVSEVEKNVWPAIASGKVKPVVYKTLPLSEAAEAHKLMESSSHIGKILLIP

SEQ ID NO: 8768 - protein, 138 aa, Zea mays
MRAVVITRGGGGPEVLEAQEVEDPAPLGDGEVLLQVVAAGVNRADTLQRHGRHPPPAGAPPYPGLECSGTILALGPNAPPRWAVGDKVCALLSGGGYAEKVVVPAGQLLPVPEGVSLADAAGLPEVACTVWSTVFMKS

SEQ ID NO: 8769 - protein, 209 aa, Triticum aestivum
MATAYAPPMASQVMKSGLVCSKPRGLSGASLTRRPRFVVKAVKSDKGTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 8770 - protein, 209 aa, Pseudoroegneria spicata
MATAYAPPMASQVMKSGLVCSKPRGMSGASLTRRPRFVVKAVKSDKGTYQVVQPINGDPFIGSLETPVTSSPLVAWYLSNLPAYRTAVSPLLRGIEVGLAHGYLLVGPFALTGPLRNTPVHGQAGTLGAIGLVSILSVCLTMYGVASFNEGAPSTAPALTLTGRKKEADKLQTAEGWSQFTGGFFFGGVSGAVWAYFLLYVLDLPYFFK

SEQ ID NO: 8771 - protein, 209 aa, Triticum aestivum
MATAYAPPMASQVMKSGLVSSKPRGLSGASLTRRPRFVVKAVKSDKGTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 8772 - protein, 209 aa, Hordeum vulgare
MATAYAPPMASQVMKSGLACSKPRGMSGASLTRRPRFVVKAVKSDKPTYQVVQPINGDPFIGSLETPVTSSPLVAWYLSNLPAYRTAVSPLLRGIEVGLAHGYLLVGPFALTGPLRNTPVHGQAGTLGAIGLVSILSVCLTMYGVASFNEGEPSTAPVLTLTGRKKEADKLQTAEGWSQFTGGFFFGGVSGAVWAYFLLYVLDLPYFFK

SEQ ID NO: 8773 - protein, 209 aa, Secale cereale
MATAYAPPMASQVMKSGLVCSKPRGLSGASLTRRSRFVVKAVKSDKGTYQVVQPINGDPFIGSLETPVTSSPLVAWYLSNLPAYRTAVSPLLRGIEIGLAHGYLLVGPFALTGPLRNTPVHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 8774 - protein, 209 aa, Secale cereale
MATAYAPPMASQVMKSGLVCSKPRGLSGASLTRRPRFVVQAVKSDKGTYQVVQPINGDPFIGSLETPVTSSPLVAWYLSNLPAYRTAVSPLLRGIEIGLAHGYLLVGPFALTGPLRNTPVHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 8775 - protein, 209 aa, Leymus cinereus x Leymus triticoides
MATAYAPPMASQVMKSGLVCSKPRGLSGASLTRRPRFVVKAVKPDKATYQVVQPINGDPFIGSLETPVTSSPLVAWYLSNLPAYRTAVSPLLRGIEVGLAHGYLLVGPFALTGPLRNTPVHGQAGALGAIGLVSILSVCLTMYGVASFNEGAPSTAPALTLTGRKKEADKLQTAEGWSQFTGGFFFGGVSGAVWAYFLLYVLDLPYFFK

SEQ ID NO: 8776 - protein, 209 aa, Secale cereale
MATAYAPPMASQVMKSVLVCSKPRGLSGASLTRRSRFVVKAVKSDKGTYQVVQPINGDPFIGSLETPVTSSPLVAWYLSNLPAYRTAVSPLLRGIEIGLAHGYLLVGPFALTGPLRNTPVHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 8777 - protein, 209 aa, Leymus cinereus x Leymus triticoides
MATAYAPPMVSQVMKSGLVCSKPRGLSGASLTRRPRFVVKAVKPDKATYQVVQPINGDPFIGSLETPVTSSPLVAWYLSNLPAYRTAVSPLLRGIEVGLAHGYLLVGPFALTGPLRNTPVHGQAGALGAIGLVSILSVCLTMYGVASFNEGAPSTAPALTLTGRKKEADKLQTAEGWSQFTGGFFFGGVSGAVWAYFLLYVLDLPYFFK

SEQ ID NO: 8778 - protein, 220 aa, Hordeum vulgare
MATAYAPPMASQVMKSGLACSKPRGMSGASLTRRPRFVVKAVKSDKVSRRTKWSSPSTATRSSAAWRRRSPPAPSSRGTSPTSPPTAPPSARSSAASRSASPMATSSSAPSRSLARSATRPCTDRPAHSAPSDSSPSSASASPCTASPPSTRASRPPRRCSPSPDARRRPTSSRPPKGGRSSPEASSSAVYPAPSGHTSSSTCSTSHTSSSRLIGGMHVR

SEQ ID NO: 8779 - protein, 213 aa, Avena sativa
MATAYAPPMASQLLKSSSSSLVCSKPRGLSGASLTTRRPRFVVKAIKADKPNYQVVQPINGDPFIGSLETPVTSSPLVAWYLSNLPAYRTAVSPLLRGIEVGLAHGYLLVGPFALTGPLRNTPVHGQAGALGAIGLVTILSVVLTMYGVASFEDGAPSTAPSLTLTGRKKEADKLQTAEGWAQFTGGFFFGGVSGAVWAYFLLYVLDLPYFFK

SEQ ID NO: 8780 - protein, 213 aa, Avena sativa
MATAYAPPMASQLLKSSNSSLVCSKPRGLSGASLTTRRPRFVVKAIKADKPNYQVVQPINGDPFIGSLETPVTSSPLVAWYLSNLPAYRTAVSPLLRGIEVGLAHGYLLVGPFALTGPLRNTPVHGQAGALGAIGLVTILSVVLTMYGVASFEDGAPSTAPSLTLTGRKKEADKLQTAEGWAQFTGGFFFGGVSGAVWAYFLLYVLDLPYFFK

SEQ ID NO: 8781 - protein, 209 aa, Brachypodium distachyon
MATAFAPPMASQLMKSSLACSKPRGLSGASLTRRPRFVVKAIKPDKATYQVVQPINGDPFIGSLETPVTSSPLVAWYLSNLPAYRTAVSPLLRGIEVGLAHGYLLVGPFALTGPLRNTPVHGQAGALGAAGLVTILSLCLTMYGVSSFDEGAPSTAPTLTLTGRKKEADKLQTAQGWSQFTGGFFFGGISGVLWAYFLLYVLDLPYFFK

SEQ ID NO: 8782 - protein, 213 aa, Avena sativa
MATAYAPPMASQLLKSNSSSLVSSKPRGLSGASLTTRRPRFVVKAIKADKPNYQVVQPINGDPFIGSLETPVTSSPLVAWYLSNLPAYRTAVSPLLRGIEVGLAHGYLLVGPFALTGPLRNTPVHGQAGALGAIGLVTILSVVLTMYGVASFEDGAPSTAPSLTLTGRKKEADKLQTAEGWAQFTGGFFFGGVSGAVWAYFLLYVLDLPYFFK

SEQ ID NO: 8783 - protein, 208 aa, Oryza sativa
MATAYAPMASQLMKSSLVCSKPRGLSGASLTRRPRFTVKAIQSEKPTYQVVQPINGDPFIGSLETPVTSSPLVAWYLSNLPAYRTAVSPLLRGIEVGLAHGYLLVGPFALTGPLRNTPVHGQAGALGAAGLVAILSVCLTMYGVASFGEGEPSTAPTLTLTGRKKEADKLQTADGWAKFTGGFFFGGISGVLWAYFLLYVLDLPYFFK

SEQ ID NO: 8784 - protein, 208 aa, Eragrostis curvula
MATAYAPMASQVMKGSLVQSRPRGLSGAALTRRPRFTVKAIQPEKPTYQVVQPINGDPFIGSLETPVTSSPLVAWYLSNLPAYRTAVSPLLRGVEVGLAHGYLLVGPFALTGPLRNTPVHGQAGALGAIGLVTILSVCLTMYGVASFNEGAPSTAPTLTLTGRKKEADKLQTADGWAKFTGGFFFGGVSGAIWAYFLLYVLDLPYYFK

SEQ ID NO: 8785 - protein, 213 aa, Avena sativa
MATAYAPPMASQLLKSNSSSLVSSKPRGLSGASLTTRRPCFIVKAIKADKPNYQVVQPINGDPFIGSLETPVTSSPLVAWYLSNLPAYRTAVSPLLRGIEVGLAHGYLLVGPFALTGPLRNTPVHGQAGALGAIGLVTILSVVLTMYGVASFEDGAPSTAPSLTLTGRKKEADKLQTAEGWAQFTGGFFFGGVSGAVWAYFLLYVLDLPYFFK

SEQ ID NO: 8786 - protein, 238 aa, Lolium multiflorum
MATAYAPPMASQLLKSNSSLVSSSKPRGLSGASLTTRRPRFVVKAIKADKPNYQVVQPINGDPFIGSLETPVTSSPLVAWYLSNLPAYRTAVSPLLRGIEVGLAHGYLLVGPFALTGPLRNTPVHGQAGALGAVGLVTILSVVLTMYGVASFDEGAPSTAPSLTLTGRKKEADKLQTAEGWAQFTGGFFFGGVSGASGPTSSSTSSTSILLQVDCTPHHVLMCACMDVDACLSLCTCK

SEQ ID NO: 8787 - protein, 208 aa, Saccharum officinarum
MATAYAPMVSQVMKSSLVHSRPRGLSGAALTRRPRFTVKAIQPEKATYQVVQPINGDPFIGSLETPVTSSPLVAWYLSNLPAYRTAVSPLLRGIEVGLAHGYLLVGPFALTGPLRNTPVHGQAGALGAAGLVAILSVCLTMYGVASFNEGAPSTAPTLTLTGRKKEADKLQTADGWSKFTGGFFFGGISGVLWAYFLLYVLDLPYYFK

SEQ ID NO: 8788 - protein, 208 aa, Panicum virgatum
MATAYAPMASQVMKSGMVHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVLWAYFLLYVLDLPYYFK

SEQ ID NO: 8789 - protein, 208 aa, Panicum virgatum
MATAYAPMASQVMKSSLMHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVLWAYFLLYVLDLPYYFK

SEQ ID NO: 8790 - protein, 208 aa, Setaria italica
MATAYAPMASQVMKSGLVHSRPRGLSGAALTRRPRFTVKAIQPEKTTYQVVQPINGDPFIGSLETPITSSPLIAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVVWAYFLLYVLDLPYYFK

SEQ ID NO: 8791 - protein, 208 aa, Pennisetum glaucum
MATAYAPMASQVMKSGLMQSRPRGLSGAALTRRPRFTVKAIQPEKPTYQVVQPINGDPFIGSLETPITSSPLIAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVVWAYFLLYVLDLPYYFK

SEQ ID NO: 8792 - protein, 211 aa, Sorghum bicolor
MATAYAPMASQVMKSSLQLHSKPRGLSGAALTTTRRPRFTVKAIQPEKATYQVVQPINGDPFIGSLETPVTSSPLVAWYLSNLPAYRTAVSPLLRGIEVGLAHGYLLVGPFALTGPLRNTPVHGQAGALGAAGLVAILSVCLTMYGVASFNEGEPSTAPTLTLTGRKKEADKLQTADGWSKFTGGFFFGGISGVLWAYFLLYVLDLPYYFK

SEQ ID NO: 8793 - protein, 211 aa, Zea mays
MATAYAPMASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASFNEGDPSTAPTLTLTGRKKEADKLQTADGWAKFTGGFFFGGISGVLWAYFLLYVLDLPYFFK

SEQ ID NO: 8794 - protein, 88 aa, Setaria italica
MATAYAPMASQVMKSGLVHSRPRGLSGAALTRRPRFTVKAIQPEKVSGCTRWCSPSTATPSSAAWRRPSPPARSSPGTSPTSRPTAPP

SEQ ID NO: 8795 - protein, 212 aa, Zea mays
MATTAYAPMASQVMKSSPVHSRPRGLSGAALTRPRPRFSVVKAAIQPEKATYQVVQPINGDPFIGSLETPVTSSPLIAWYLSNLPAYRTAVSPLLRGVEVGLAHGYLLVGPFALTGPLRNTPVHGQAGALGAAGLVAILSVCLTMYGVASFNEGDPSTAPTLTLTGRKKEADKLQTADGWAKFTGGFFFGGISGVLWAYFLLYVLDLPYYFK

SEQ ID NO: 8796 - protein, 203 aa, Triticum aestivum
SQVMKSGLVCSKPRGLSGASLTRRPRFVVKAVKSDKGTYQVVQPPRRVVPLQPSRVPHRRQPAPPWHRGRPRPRLPPRRPLRAHRPAPQHANSRPGGNPRRHRPRLHPQRLPHHVRRRLLQRGRALHRARPHAHRPQEGGRQAADRRRLVPVHRRLLLRRRLRRHLGLLPPLRARPPILLQVDYLLLACMYDGCTTADDVIDL

SEQ ID NO: 8797 - protein, 68 aa, Triticum aestivum
MYGVASFNEGAPSTAPALTLTGRKKEADKLQTAEGWSQFTGGFFFGGVSGATWAYFLLYVLDLPYFFK

SEQ ID NO: 8798 - protein, 196 aa, Cynodon dactylon
GRSGLVYSRPRGLSGAALTRRPRFTVKAIQPEKPTYQVVQPINGDPFIGSLETPVTSSPLIAWYLSNLPAYRTAVNPLLRGIEVGLAHGYLLVGPFALTGPLRNTPVHGQAGALGAIGLVTILSVCLTMYGVASFNEGDPSTAPTLTLTGRKKEADKLQTADGWAKFTGGFFFGGVSGAIWAYFLLYVLDLPYYFK

SEQ ID NO: 8799 - protein, 348 aa, Secale cereale
MGSAGALLSHPPPQLGSILLRRHHISLPHLSSCMPEPLHCRRRHLRCSAIEGSSSQDTNSPASQREESPSSSLGATLQDPLPGRVENGSFEGATKEEDQSSLYNFLYPSKELLPDDKEMSIFDHLEELRARIFVSVLAVGASIIGCFAFSKDIIKILEAPVSVQGVRFLQLSPGEFFFTTLKVSGYCGLLIGSPIILYEIIAFVLPGLTKDERKFLGPIVLGSSVLFYLGILFSYTVLAPAALNFFVNYAEGAVESIWSIDQYFEFVLVLLFSTGLSFQVPVIQLLLGQVGLVSSKQMLSIWRYVVVGAVVAAAVLTPSTDPLTQMLLAGPLLGLYLGGAWMVRLTGR

SEQ ID NO: 8800 - protein, 347 aa, Hordeum vulgare
MGSAGALLSRPPPQLGSILLRRHHISLPHLSSCTPEPLHCRRRHLRCSAVEGSSGQDTNLPASQREESPSSSLGATLQDPLAGRVENGSFEDVTQEDQSSLYNFLYPSKELLPDDKEMSIFDHLEELRARIFISVLAVGASIIGCFAFSKDIIKILEAPVSVQGVRFLQLSPGEFFFTTLKVSGYCGLLIGSPVILYEIIAFVLPGLTKDERKFLGPIVLGSSVLFYLGILFSYTILAPAALNFFVNYAEGAVESIWSIDQYFEFVLVLLFSTGLSFQVPVIQLLLGQVGIVSSEQMLSIWRYVVVGAVVAAAVLTPSTDPLTQMLLAGPLLGLYLGGAWMVRLTGR

SEQ ID NO: 8801 - protein, 349 aa, Brachypodium distachyon
MGSAGALLSHPPPQLGGILHRRQSLSLPRLASCTPEPLHCRRRYLRCSAVDGNSRGQETDSPTPQREESPSSGLGAALKDPLPGPVENGSFGGITQEEEQSTLYNFLYPSKELLPDDKEMSIFDHLEELRERIFISVLAVGVSILGCFAFSKDIIKILEAPVSVQGVRFLQLSPGEFFFTTLKVSGYCGLLLGSPIILYEIIAFVLPGLTKDERKFLGPIVLGSSVLFYLGILFSYTVLAPAALNFFVNYAEGAVESIWSIDQYFEFVLVLLFSTGLSFQVPVIQLLLGQVGLVSSDQMLSIWRYVVVGAVVAAAVLTPSTDPLTQMLLAGPLLGLYLGGAWMVKLTGR

SEQ ID NO: 8802 - protein, 261 aa, Avena sativa
MGSAGALLSHPPPQLGGTLLRRHRISLPRLVPCTPEPLHCRRRRRRHLRCSAVEGDTDSPVPQREESPSTSLQLQDPLPGPVENGSFAGLAQEEDPSSLYNFLYPSKELLPDDKEMSIFDHLEELRERIFVSVLAVGASILGCFFFSKDIIKILEAPVSVQGVRFLQLSPGVIFLYNIEGFWLLRSSNRKSYHFIRDHSVCSPRFNQGRAEILRAHCFGFFSSVLPWHFVLLHCPCSSSTELLCELCRRGGGVDMVNRPVL

SEQ ID NO: 8803 - protein, 359 aa, Oryza sativa
MGSAGALLSHSPPGLGGFPPRHHHHHRLSVLRCVPLLPSPAPEPLSCRHGRHLRCAAVDGGAGRETERPSPPAPQREESPSGSLGAALEDPSPQPVQNGSFGGITEDEEQSSLYNFLYPSKELLPDDKEMSIFDHLEELRDRIFVSVLAVGAAILGCFAYSKDLIRILEAPVSVQGVRFLQLSPGEFFFTTLKVSGYCGLLLGSPVILYEIIAFVLPGLTRDERKFLGPIVLGSSVLFYLGIFFSYTVLAPAALNFFVNYADGAVESLWSIDQYFEFVLVLLFSTGLSFQVPVIQLLLGQVGLVSSDQMLSIWRYVVVGAVVAAAVLTPSTDPLTQMLLAGPLLGLYLGGAWMVKLTGR

SEQ ID NO: 8804 - protein, 397 aa, Triticum aestivum
MERSWFGWRKAKQGGGGGAGGGGGEREEEDQAKVVVDGSGIRELVEDREAFGMFAESKFRQLDADGDGRLSVRELQPAVADIGASLGLPAQGSSPNADHIYSEAMSEFAHGHGNQEGVSRAEFQEVLSDILLGMAAGLKKDPIVILRIDGEDLRDFVSSPRYEPAAAAIFSQVGSGDAPLRQCLLAAVQQLGVDHGMPPAADPWVVEDVVEPALQQLSTDELEQPASRDVFLEQLKKLLGSVAEQLQEGHVIVAHTENTFDGTGVRRLLGNKFELDKLLDSVWRDVPAELRKKAPKDKEHLRVALDKMADAASLPPHGSVAQVDAVVDEALKVADAGDGKVVEEAEFKKLLTEVLGAVMLRLSGEPIFFSTSTVVHEPLSSSSALLPSPAVASPPSE

SEQ ID NO: 8805 - protein, 394 aa, Secale cereale
MERSWFGWRKAKQGTGAGGGEKEGEEEDRAKVVVDGSGIRELVEDREAFGMFAETKFRQLDADGDGRLSVRELQPAVADIGASLGLPAQGSSPNADHIYSEAMSEFSHGHGNQEGVSRAEFKEVLSDILLGMAAGLKKDPIVILRIDGEDLRDFVSSPRYETAVAAIFSQVVSRDLSLRQCLLAAVQHLGVDHGMPPASDPWVVENVVEPALQQLSADELQQPASRGVFFEQLKKLLGGVAEQLQERHVIVAHTENTFDGSGVRRLLGNKFELDKLLDSVWRDVPAEHRKKAPKDKEHLRVALDKMADAASLPPHGAVAQVDAVVDEVLKVADSGDGKAVEEAEFKKLLTEVLGAVMLRLSGEPIFFSTSTVVHEPLSSSALLPSPAVASPPSE

SEQ ID NO: 8806 - protein, 402 aa, Hordeum vulgare
TRPPVQSVHIYIYSDGEGLVRVEKAKQGGGKEEEGRAKVVVDGSGIRQLVEDREAFGMFAETKFRQLDADGDGRLSVRELQPAVADIGASLGLPAQGSSPNADHIYSEAMSEFTHGHGNQEGVSRAEFQEVLSDILLGMAAGLKKDPIVILRIDGEDLRDFLSSPRYEPVAAAIFSQVGSEDAPLRQCLLAAVQQLGVDHGMPPAADAWVVENVVEPALQQLPADELERRASRDVFLEQLKKLLAGVAEQLQERHVIVAHTENTFDGSGVRRLLGNKFELDKLLDSVWREVPAEHRKKAPKDKEHLRVALDKMADAASLPPHGAVDRVDAVVDETLKVADAGDGKAVEEAEFKKLLTDVLGAVMLRLSGEPIFFSTSTVVHESMPGSSALLPSPAVASPPSE

SEQ ID NO: 8807 - protein, 391 aa, Avena sativa
MERSWFGWRKARKGGTGGAGGGGGAEKEVVVDGQGIRELVEDREAFGMFADTKFTQLDADGDGRLSVRELEPAVADIGAALGLPAQGSSPNADHIYSEAMSELTHGHGNQEGVSRAEFQEVLSDILLGMAAGLKKDPIVILRIDGEDLRDFVSSPRYEPAAAAIFAQVASEDASLRQCLLAAVEQLRVDHGMPPASDPWIVDNVVDPALQRLSADELEQKASKDDLFLEQLKKLLGDVADRLQEQPVIVAHTENTFDGSGVRRLLANKFELDKLLDSVWRDVPTEDEKKASKEHLRVALDKMADAASLPPHGAVDQVDAVVNEALKKANADDGKEVDEVEFKKLLTEVLGAVMLQLKGKPIFFSTSTVVHEPLSSSSALLSSPAVAAPPSL

SEQ ID NO: 8808 - protein, 387 aa, Brachypodium distachyon
MERSWFGRRKTKKRQGGEKEDRQKVVVDGTEIRELVGDREAFGMFAESKFRELDADGDGRLSVRELQPAVAGIGAALGLPAQGSDPNADHIYSEAMSEVTQGKQEGVSRAEFQEVLSDILLGMAAGLKRDPIVILRIDGEDLRDFVSSPRYEPAAAAIFSQAGSEDASSLRQRLLAAVRQLGVDHGMPPAADPWVLENVIEPALQRLSADQLEQPVASKDIFLEQLKKLLGDVVERLQERPVIVAHTENTFDGSGVRSLLANKFELDKLLDSVCKDVPVEHKKKASKECLRAALDKMADAASLPPHGSVTQVDAIVDEALKMANNAHDGKAVDEAEFKKLLTEVLGAVMLRLSGDPVFVSTSTVVHESLSSSSTLLSSPAVPSPPSE

SEQ ID NO: 8809 - protein, 403 aa, Pseudoroegneria spicata
MELTATGAAALRRSLASAYPVVPRERRRGMPARVSCVGRGGRGVGGGFADEAHLRYYEAPRKAVEAAARDLTKLRAMGLVAGDPAKEKILSEATELLLQELNQMKDAEDELKKKQKEEKAAMKALKKQQKEAKKAAMNCGDGSSESSESECEEEQSMKMSCVATTSIPAIEQGMVTSMSVPEIAASNIATAPAMDFDKAAMKAMKKREKEQKKAAKKAMKMKREEEKRMATLNSCKDEDSSCSSESSNSECEGEVVRMSRCATISAPRTPPASTVFPIIVPQIPDSVALDAQIFSGSANAMQCTATSIAVVEKPVLNRIEVCMGGKCKKAGSLAVLQKFETEVGTGGMVVGCKCLGKCGLGPNVRLRSEGSIQKNSPICIGVGLDDVGTIVAGFIGDDDLGMN

SEQ ID NO: 8810 - protein, 410 aa, Triticum aestivum
MELAATGAAALRRSLASGYPVVPRERRRRMPARVSCVGRGGRGVGGGFADEAHLRYYEAPPRKAVEAAARDLTKLRAMGLVAGDPAKEKILSEATELLLKELNQMKDAEDELKKKDELKKKQKEEKAAMKALKKQQKEAKKAAMNCGDGSSESSESECEEEQSMKMSCVATTSMPAIEQGMAMSMSVPQIAASNIATAPAMDFDKAAMKAMKKREKEQKKAAKKAMKMKKEEEKRMATLNSCKDEDSSCSSESSNSECEGEVVRMSRCATISVPRTPSASTVFPIIVPQISDSVALDAQIISGSANAMQRTTTSIAVVEKPVLNRIEVCMGGKCKKAGSLAVLQEFETVVGTGGLVVGCKCLGKCGLGPNVRLRSEGSVQKNSPICIGVGLDDVGTIVAGFIGDDDLGMN

SEQ ID NO: 8811 - protein, 402 aa, Triticum aestivum
MELAATGAAALRRSLASACPVVPRERRRGMPARVSCVGRVGGCGGFADEAHLRFYDAAPRKAVEAAARDLTKLRAMGLVAGDPAKEKILSEATELLLQELNQMKDAEDELKKKQKEEKAAMKALKKQQKEAKKAAMNCGDASSESSESECEEEQSMKMSCVATTSMPAVDQGMAMPMSVPQIAASNIATAPAMDFDKAAMKAMKKREKEQKKAAKKAMKMKKEEEKRMATLNSCKDEDSSCSSESSNSECEGEVVRMSRCATISAPRTPPASTVFPIIVPQIPDSVALDAQIFSGSANAMQHTATSIAVVEKPVQNRIEVCMGGKCKKAGSLAVLQEFETEVGTGGMVVGCKCLGKCGLGPNVRLHSEGSVQKNSPICIGVGLDDVGTIVAGFIGDGDVGMN

SEQ ID NO: 8812 - protein, 402 aa, Hordeum vulgare
MELTATGAAALRRSLASAYTVVPRERRRGMPSRVSCVGRGGIGGGFADEAHLRYYEAVPRKAVEAAARDLTKLRAMGLVAGDPAKEKILSEATELLLQELNQMKDAEDDLKKKQKEEKAAMKALKKQQKEAKKATMNCGDGSSESSESECEEEQSMKMSCVATTSMPAIEQGMVMSMSVPQITASNIARAPAMDFDKAAMKAMKKKEKEQKKAAKKAMKMKKEEEKRMATLNSCKDEDSSCSSESSNSECEGEVIRMSRCATISAPRTPPASTVFPIIVPQIPDSVALEAQIFSGSANATECTATSIAVVEKPVLNRIEVCMGGKCKKAGSLAVLQEFETELGMGGTVVGCKCLGKCGLGPNVRLRSEGSVQKNSPICIGVGLGDVGTIVAGFLGDGDLGMN

SEQ ID NO: 8813 - protein, 405 aa, Secale cereale
TATGAAALRGSLASACPVVQRERRRGMPARVSCVGRGGRGVGGGFADEAHLRYYEAPRKAVEAAARDLTKLRAMGLVAGDPAKEKILSEATELLLQELNQMKDAEDELKKKQKEEKAAMKALKKQQKEAKKAAMNCGDGSSESSESSESDCEDEQSMKMSCVGTTSTPAIEQGMSMSMSVPQIAASNIATAPAMDFDKDAMKAMKKREKEQKKAAKKAMKMKREEEKRMATLNSCKDEDSSCSSESSNSECEGEVVRMSRCATISAPRTPPATASTVFPIIVPQIPDSVALDAQIFSGSANAMQRTATSIAVVEKPVLNRIEVCMGGKCKKAGSLAVLQEFETEVGTDGMVVGCKCLGKCGLGPNVRLRSEGSVQKNSPICIGVGLDDVGTIVAGFIGDGDMGMN

SEQ ID NO: 8814 - protein, 399 aa, Leymus cinereus x Leymus triticoides
  misc_feature (20)..(20): Xaa can be any naturally occurring amino acid
  misc_feature (47)..(47): Xaa can be any naturally occurring amino acid
  misc_feature (52)..(52): Xaa can be any naturally occurring amino acid
  misc_feature (57)..(57): Xaa can be any naturally occurring amino acid
  misc_feature (199)..(199): Xaa can be any naturally occurring amino acid
MELTATGAAALRRSLASAYXVVPRERRRGMPARVSCVGRGGGGFADXAHLRXYEAPXKAVEAAARDLTKLRAMGLVAGDPAKEKILSEATELLLQELNQMKDAEDELKKKQKEEKAAMKALKKQQKEAKKAAMKCGDGSSESSESECEEEQSMKMSCVATTSTPPVEQGMVTSMSVPQIAASNIATGPAMDFDKAAMKXMKKREKEQKKAAKKAMKMKREEEKRMATLNSCKDEDSSCSSESSNSEGEGEVFRMSSCATIAAPRTPPASTVFPIIVPQIPDSVAPDAQIFFGSANAMQCTATSIAVVEKPVLNRIEVCMGGKCKKAGSLAVLQKFETEVGTGGMVVGCKCLGKCGLGPNVRLRSEGSVQKNSPICIGVGLDDVGTIVAGFIGDGDLSMN

SEQ ID NO: 8815 - protein, 270 aa, Secale cereale
MNCGDGSSESSESSESECEEEQSMKMSCVATTSTPAIEQGMSMSMSVPQIAASNIATAPAMDFDKDAMKAMKKREKEQKKAAKKAMKMKREEEKRMATLNSCKDEDSSCSSESSDSECEGEVVRMSRCATISAPRTPPASADFPIIVPQIPDSVALDAQIFSGSANAMQCTATSIAVVEKPVLNRIEVCMGGKCKKAGSLAVLQEFETEVGTGGMVVGCKCLGKCGLGPNVRLRSEGSVQKNSPICIGVGLNDVGTIVAGFIRDDDLGMN

SEQ ID NO: 8816 - protein, 410 aa, Brachypodium distachyon
MEFTGAAALRRSLPAACPAVFSRERRNRGMPGRVSCVGRGGGVGFADEGHLRYYEAAPRKAVEAAARDLTKLRAMGLVAGDPSKEKILSEATELLLLELNQMKDAEDDLKKREKEEKAAMKALKKQQKEAKKAAAVMTCGDGSSESSESECEEEQSTEMSCVATKSMPGIAQGMVLPMSVPQITASEIGTIPAIEFDKAAMKAMRKMEKEQKKAAKKAMKMKKEEEKRMAKLNSCKGDDSSSCSSESSDSECEGEVVRMSRCATITAPRTPPATTVFPIIVPQIPDSAALGAQISSGPTTAIQCTATSIAVVEKPALNRIEVCMGGKCKKSGSLTVLQEFEKQVGTGGAVVGCKCLGKCGVGPNVRLRSEVPEEGSLQNKSTLCIGVGLEDVGTIVAGFFGDDSDLLGMN

SEQ ID NO: 8817 - protein, 122 aa, Saccharum officinarum
MNALSNWLVNPRRNPLARLHMHAVSSRLRKYGLRYDDLYDPYFDLDIKEALGRLPREVVDARIQRLKRAMDLSMKHQYLPEHLQAQQVPFRGYLSDMLALVKKENAEREALGALPLYQRTLP

SEQ ID NO: 8818 - protein, 123 aa, Zea mays
MMNALANWLANPRRNPLARLHMHAVSSRLRKYGLRYDDLYDPYFDLDIKEALGRLPREVVDARIQRLKRAMDLSMKHQYLPEDLQAQQVPFRGYLGDMLALVKKESAERQSLGALPLYQRTLP

SEQ ID NO: 8819 - protein, 123 aa, Setaria italica
MLSALSNWLVNPRRNPLARLHMHAVSSRLRKYGLRYDDLYDPYFDLDIKEALGRLPREVVDARIQRLKRSMDLSMKHQYLPEDLQAVQTPFRGYLSDMLALVKKENAEREALGALPLYQRTIP

SEQ ID NO: 8820 - protein, 123 aa, Sorghum bicolor
MMNALANWLVNPRRNPLARLHMHAVSSRLRKYGLRYDDLYDPYFDVEIKEALGRLPREVIDARIQRLKRAMDLSMKHQYLPEHVQAQQVPFRGYLSDMLALVKKENAEREALGALPLYQRTLP

SEQ ID NO: 8821 - protein, 123 aa, Panicum virgatum
MMSALSNWLVNPRRNPLARIHMHAVSSRLRKYGLRYDDLYDPYFDLDIKEALGRLPREVVDARIQRLKRAMDLSMKHQYLPEDLQAAQTPFRGYLSDMLALVKKESAEREALGALPLYQRTIP

SEQ ID NO: 8822 - protein, 123 aa, Panicum virgatum
MMSVLSNWLVNPRRNPLARLHMHAVSSRLRKYGLRYDDLYDPYFDLDIKEALGRLPREVVDARIQRLKRAMDLSMKHQYLPEDLQAAQTPFRGYLSDMLALVKKESAEREALGALPLYQRTIP

SEQ ID NO: 8823 - protein, 123 aa, Cenchrus ciliaris
MMSAISNWLVNPRRNPLARLHMHAVSSRLRKYGLRYDDLYDPYFDLDIKEALGRLPREVVDARIQRLKRSMDLSMKHQYLPEDLQAVQTPFRSYLSDMLALVKKENAEREALGALPLYQRTIP

SEQ ID NO: 8824 - protein, 123 aa, Pennisetum glaucum
MMSALSNWLVNPRRNPLARIHMHAVSARLRKYGLRYDDLYDPYFDLDIKEALGRLPREVVDARIQRLKRSMDLSMKHQYLPEDLQAVQTPFRSYLSDMLALVKKENAEREALGALPLYQRTIP

SEQ ID NO: 8825 - protein, 123 aa, Oryza sativa
MLSSLSAWLVNPRRNPLARLHMNAVASRLRKYGLRYDDLYDPYHDLDIKEALARLPREVVDARNQRLKRAMDLSMKHQYLPADAQAKQTPFRGYLSDMLALVKKESAEREALGALPLYQRTIP

SEQ ID NO: 8826 - protein, 123 aa, Panicum virgatum
MLTRFSAWFVNPRRNPLARLHRNAVASRLRKYGLRYDDLYDPYHDLDIKEALARLPREVVDARNQRLKRAMDLSMKHQYLPDDLQAIQTPFRSYLSDMLALVKKENAEREALGALPLYQRTIP

SEQ ID NO: 8827 - protein, 123 aa, Brachypodium distachyon
MLSAFSQWFVNPRRNPLARLHKYTVASRLTKFGLRYDDLYDPYFELDIKEALGRLPREVVDARHQRLKRAMDLSMKHQYLPDDLQALQTPFRSYLTDMLALVKKEAAEREALGALPLYERTLP

SEQ ID NO: 8828 - protein, 123 aa, Eragrostis curvula
MLSAFSQWFVNPRRNPLARIHMQTISSRLRKYGLRYDDLYDPYFDLHIKEALGRLPTEVVDARIQRLKRAMDLSMKHQYLPENVQAIQTPFKSYLSDMLALVQKEAAEREALGALPLYQRTIP

SEQ ID NO: 8829 - protein, 123 aa, Saccharum officinarum
MLSKLSAWFVNPRRNPLARLHRNAVASRLRKYGLRYDDLYDPYHDLDIKEALARLPREVVDARNQRLKRAMDLSMKHKYLPDDLQAIQTPFRSYLSDMLALVKKESAEREALGALPLYQRTIP

SEQ ID NO: 8830 - protein, 107 aa, Triticum aestivum
MLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERL

SEQ ID NO: 8831 - protein, 123 aa, Zea mays
MLSKLSAWFVNPRRNPLARLHRNAVASRLRKYGLRYDDLYDPYHDLDIKEALARLPREVVDARNQRLKRAMDLSMKHQYLPDDVQAIQTPFRSYLFDMLALVKKESAEREALGALPLYQRTIP

SEQ ID NO: 8832 - protein, 123 aa, Panicum virgatum
MLSRFSAWFVNPRRNPLARLHRNAVAARLRKYGLRYDDLYDPYHDLDIKEALARLPREVVDARNQRLKRAMDLSMKHQYLPDDVQAIQVPFRSYLSDMLALVKKEKAEREALGALPLYQRTIP

SEQ ID NO: 8833 - protein, 123 aa, Pennisetum glaucum
MLSKLSAWFVNPRRNPLARAHRNAVAARLRKYGLRYDDLYDPYHDLDIKEALARLPREVVDARNQRLKRAMDLSMKHQYLPDDVQAIQTPFRSYLSDMLALVKKEKAEREALGALPLYQRTIP

SEQ ID NO: 8834 - protein, 123 aa, Avena sativa
MLSAFSQWFVNPRRNPLARIHMLTVSSRLRKVGLRYDDLYDPYFDLDIKEALARLPQEVVDARIQRLKRAMDLSMKHQYLTDELQALQTPFKSYLSDMLALVKKEAAERKALGALPIYERTLP

SEQ ID NO: 8835 - protein, 123 aa, Avena sativa
MLSAFSQWFVNPRRNPLARIHMLTVSSRLRKFGLRYDDLYDPYFDLDIKEALARLPQEVVDARIQRLKRAMDLSMKHQYLTDELQALQTPFKSYLSDMLALVKKEAAERKALGALPIYERTLP

SEQ ID NO: 8836 - protein, 123 aa, Hordeum vulgare
MLSAFSQWFVNPRRNPLARIHMLTISNRLKNYGLRYDDLYDPYFDLDIKEALTRLPREVVDARHQRLKRAMDLSMKHQYLPDDVRALQTPFKSYLSDMLALVKKEAAERKALGALPLYERTLP

SEQ ID NO: 8837 - protein, 123 aa, Triticum aestivum
MLSAFSSWFVNPRRNPLARIHMLTISNRLKNFGLRYDDLYDPYFDLDIKEALGRLPREVVDARHQRLKRAMDLSMKHQYLPDDVRALQTPFKSYLSDMLALVKKEAAERKALGALPLYERTLP

SEQ ID NO: 8838 - protein, 123 aa, Brachypodium distachyon
MLSSLSAWFVNPRRNPLARLHMKTVAYRLSNYGLRYDDLYDPYNDLDIKEALARLPREVVDARNQRLKRAMDLSMKHQYLPDDVKALQTPFRSYLADMLALVKKERAEREALGALPLYERTLP

SEQ ID NO: 8839 - protein, 123 aa, Setaria italica
MLSKLSAWFVNPRRNPLARAHRNAVASRLRKYGLRYDDLYDPYHDLDIKEALSRLPREVVDARNQRLKRAMDLSMKHKYLPDEVQAIQTPFRSYLSDMLALVKKEKAEREALGALPLYQRTIP

SEQ ID NO: 8840 - protein, 123 aa, Lolium multiflorum
MLASFSQWFVNPRRNPLARIHMLTISSRLKNYGLRYDDLYDPYFDLDIKEALARLPQEVVDARIQRLKRAMDLSMKHQYLPDDLQALQTPFKSYLSDMLALVKKEAAERQALGALPIYERTLP

SEQ ID NO: 8841 - protein, 123 aa, Eragrostis curvula
MLSRLSAWFVNPRRNPLARLHRDAVAARLRKYGLRYDDLYDPYHDLDIREALARLPREVVDARNARLKRAMDLSMKHQYLPDDVQALQTPFRSYLSDMLALVKKESAEREALGALPLYQRTIP

SEQ ID NO: 8842 - protein, 123 aa, Oryza sativa
MLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERLEREELGALPLHQRTLP

SEQ ID NO: 8843 - protein, 123 aa, Sorghum bicolor
MLSKLSAWFLNPRRNPLARLHRNAIASRLRKYGLRYDDLYDPYHDLDIKEALARLPREVVDARNQRLKRAMDLSMKHKYLPDDVQAIQTPFRSYLSDMLALVKKESAEREALGALPLYQRTIP

SEQ ID NO: 8844 - protein, 123 aa, Triticum aestivum
MLSAFSSWFVNPRRNPLARIHMLTISNRLKNYGLRYDDLYDPYFDLDIKEALGRLPREVVDARHQRLKRAMDLSMKHQYLPDDVRALQTPFKSYLSDMLALVKKEAAERKALGALPLYERTLP

SEQ ID NO: 8845 - protein, 123 aa, Lippia dulcis
MASAISKWLVDPNRNPLAKLHMKAVSSRLRKYGLRYDDLYDPMNDLDVKEALNRLPREVVDARNQRLKRALDLSMKHEYLPEDLQAMQTPFRSYLQEMLALVKRENAEREALGALPLYQRTIP

SEQ ID NO: 8846 - protein, 123 aa, Pseudoroegneria spicata
MLSSFSQWFVNPRRNPLARIHMLTISNRLKNYGLRYDDLYDPYFDLDIKEALARLPREVVDARNQRLKRAMDLSMKHQYLPDDIRALQTPFKSYLSDMLALVKKEAAERKALGALPLYERTLP

SEQ ID NO: 8847 - protein, 422 aa, Panicum virgatum
MAAAATSTAHSLLLQRPTAPRAPAAAASSLRLPARAAKISCAAVAAPSASSPLTGAGDRGVYNFAAGPATLPLSVLKRAQAELVDYHGSGMSIMEMSHRGKEFDAAIKKAEADLRALLAVPDTHAVLFLQGGATTQFAAVPLNLCAGPSDPADFVVSGSWSDKAFKEAKKFSAASVAWSGKDAKYTALPPFDDIKQNPEARFLHICSNETIHGVEFKDYPEPRNKSGILVADMSSNFCSKPVDVSRFGVIYAGAQKNVGPSGVTIAIVRKDLIGNAQPITPVMLDFKTHADNASLYNTPPCFAIYICGLVFEDLLAQGGLAEVEKKNAYKAGILYDTIDASGGYYICPVENSVRSLMNVPFTLAKGPDFEKQFIAEAAKEGMVQLKGHRSVGGVRASIYNAMPLAGVEKLVAFMKDFQARNL

SEQ ID NO: 8848 - protein, 332 aa, Setaria italica
MSIMEMSHRGKEFDAAIKKAEADLRALLAVPDTHAVLFLQGGATTQFAAVPLNLCAGPTDPADFVVSGSWSDKAFKEAKKFSAASVAWSGKDGKYTALPPFDAIKQNPEARFLHICSNETIHGVEFKDYPVPQNKSGILVADMSSNFCSKPVDVSRFGVIYAGAQKNVGPSGVTIAIVRKDLIGNAQPITPVMLDFKTHADNASLYNTPPCFAIYICGLVFEDLLAQGGLAEVEKKNAHKAGILYDTIDASGGYYICPVEKSVRSLMNVPFTLAKGPDFEKQFIAEAAKEGMVQLKGHRSVGGVRASIYNAMPLAGVEKLVAFMKDFQARNP

SEQ ID NO: 8849 - protein, 419 aa, Triticum aestivum
MAAAAAAATPNSMLLHRPSPKAGPSARVPARAARIRCQAVAAPAAPSPLAAAGERGVYNFAAGPATLPLSVLQKAQAELVDYRGSGMSIMEMSHRGKEFDAAIKKAEADLRALLAVPDTHEVLFLQGGATTQFAAAPLNLCASPADPADFVVSGSWSDKAFKEAKKYSAASVAWSGKAAKYTSLPADFGAMSQNPEARFLHICSNETIHGVEFKDYPEPRNEAGLLVADMSSNFCSKPVDVSRFGLIYAGAQKNVGPSGVTIAIVRKDLVGSAQPITPVMLDYKTHADNASLYNTPPCFAIYICGLVFEDLLAQGGLAEVEKKNQHKAGILYDTIDASGGYFVCPVDKPVRSLMNVPFTLAKGADYEKQFIAEAAKEGMLQLKGHRSVGGVRASIYNAMPLSGVEKLVAFMKDFQARNP

SEQ ID NO: 8850 - protein, 426 aa, Sorghum bicolor
MAAAAATTPHSLLLQRAASPAAPPRATATATSLRLPARAARISCAAVAAPSPAAAAAADEAERGVYNFAAGPATLPLSVLKRAQAELVDYHGSGMSIMEMSHRGKEFDAAIKKAEADLRALLAVPDTHDVLFLQGGATTQFAAVPLNLCAGPSDPADFVVSGSWSDKAFKEAKKFSAASVAWSGKDGKYTALPPFDAIKQNPEARFLHICSNETIHGVEFKDYPEPRNKSGILVADMSSNFCSKPVDVSRFGVIYAGAQKNVGPSGVTIAIVRKDLIGAAQPITPVMLDFKTHADNASLYNTPPCFAIYICGLVFEDLLAQGGLAEVDKKNTHKAGILYDTIDASGGYYICPVDKSVRSHMNVPFTLAKGPDFEKQFIAEAAKEGMVQLKGHRSVGGVRASIYNAMPLAGVEKLVAFMKDFQARNP

SEQ ID NO: 8851 - protein, 417 aa, Triticum aestivum
AAAAAATPNSMLLHRPSPKAGPSARVPARAARIRCQAVAAPAAPSPLAAAGERGVYNFAAGPATLPLSVLQRAQAELVDYRGSGMSIMEMSHRGKEFDAAIKKAEADLRALLAVPDTHEVLFLQGGATTQFAAAPLNLCASPADPADFVVSGSWSDKAFKEAKKYSAASVAWSGKAAKYTSLPADFGAMSQNPEARFLHICSNETIHGVEFKDYPEPRNEAGLLVADMSSNFCSKPVDVSRFGLIYAGAQKNVGPSGVTIAIVRKDLVGSAQPITPVMLDYKTHADNASLYNTPPCFAIYICGLVFEDLLAQGGLAEVEKKNQHKAGILYDTIDASAGYFVCPVDKPVRSLMNVPFTLAKGADSEKQFIAEAAKEGMLQLKGHRSVGGVRASIYNAMPLSGVEKLVAFMKDFQARNP

SEQ ID NO: 8852 - protein, 425 aa, Zea mays
MAAAATTPHSLLLQRAAIPAAPSRASAAASPVRLPVRAARISCAAVAAPSPAAAAAADEVERGVYNFAAGPATLPLSVLKRAQAELVDYHGSGMSIMEMSHRGKEFDAAIKKAESDLRALLAVPDTHAVLFLQGGATTQFAAVPLNLCTGPSDPADFVVSGSWSDKAFKEAKKFSAASVAWSGKDGKYTALPPFDAIAQNPEARFLHICSNETIHGVEFKDYPEPRNRSGILVADMSSNFCSKPVDVSRFGVIYAGAQKNVGPSGVTIAIVRKDLIGAAQPITPVMLDFKTHADNASLYNTPPCFAIYVCGLVFEDLLAQGGLAEVEKKNARKAGALYDTIDASGGYYVCPVDKSVRSHMNVPFTLAKGPDFEKQFIAEAAKEGMVQLKGHRSVGGVRASIYNAMPLAGVEKLVAFMKDFQARNP

SEQ ID NO: 8853 - protein, 396 aa, Hordeum vulgare
PSVRVPPRAAQIRCAAVAAPSAPAPLAAAGDRGVYNFAAGPATLPLSVLQRAQAELVDYRGSGMSIMEMSHRGKEFDAAIKKAEADLRALLAVPDTHEVLFLQGGATTQFAAAPLNLCASPSDPADFVVSGSWSDKAFKEAKKYSAASVAWSGKAGKYTSLPEDLGALPQNPEARFLHICSNETIHGVEFKDYPVPTNKSGVLVADMSSNFCSKPVDVSRFGLIYAGAQKNVGPSGVTIAIVRKDLVGAAQPITPVMLDYKTHADNASLYNTPPCFAIYICGLVFEDLLAQGGLAEVEKKNQHKAGILYDTIDASGGYFICPVDKPVRSLMNVPFTLAKGADFEKQFIAEAAKEGMLQLKGHRSVGGVRASIYNAMPLSGVEKLVAFMKDFQARNP

SEQ ID NO: 8854 - protein, 434 aa, Secale cereale
RAGPPPVPLRRRSVPRVVGRPPKDVRSPTAVAAASLPFVAAAGAGRARRLQLRGGPATLPLSVLQRAQAELVDYRGSGMSIMEMSHRGKEFDAAIKKAEADLRALLAVPDTHEVLFLQGGATTQFAAAPLNLCGSPSDPADFVVSGSWSDKAFKEAKKYSAAAVAWSGKGDKYTSLPEDFGALAQNPEARFLHICSNETIHGVEFKDYPEPRNKSGVLVADMSSNFCSKPVDVSRFGLIYAGAQKNVGPSGVTIAIVRKDLVGSAQPITPVMLDYKTHADNASLYNTPPCFAIYICGLVFEDLLAQGGLAEVEKKNQHKAGILYDTIDASGGYFICPVDKPVRSLMNVPFTLAKGADFEKQFIAEAAKEGMLQLKGHRSGRRRARLHLQCHAALRRGEARRLHEGFPSEEPLIGPSPARSSGIARSSRMACCWS

SEQ ID NO: 8855 - protein, 396 aa, Saccharum officinarum
SSLRLPARAARISCAAVAAPSPAAAAAADEAERGVYNFAAGPATLPLSVLKRAQAELVDYHGSGMSIMEMSHRGKEFDAAIKKAEADLRALLAVPDTHTVLFLQGGATTQFAAVPLNLCAGPTDAADFVVSGSWSDKAFKEAKKYSAASVAWSGKDGKYTALPPFDAIKQNPEARFLHICSNETIHGVEYKDYPEPRNKSGILVADMSSNFCSKPVDVSRFGVIYAGAQKNVGPSGVTIAIVRKDLIGAAQPITPVMLDFKTHADNASLYNTPPCFAIYICGLVFEDLLAQGGLAEVEKKNAHKAGILYDTIDASGGYYICPVDKSVRSHMNVPFTLAKGPDFEKQFIAEATKEGMVQLKGHRSVGGVRASIYNAMPLAGVEKLVAFMKDFQARNP

SEQ ID NO: 8856 - protein, 390 aa, Hordeum vulgare
PRAAQIRCAAVAAPSAPAPLAAAGDRGVYNFAAGPATLPLSVLQRAQAELVDYRGSGMSIMEMSHRGKEFDAAIKKAESDLRALLAVPDTHEVLFLQGGATTQFAAAPLNLCASPSDPADFVVSGSWSDKAFKEAKKYSAASVAWSGKAGKYTSLPEDLGALPQNPEARFLHICSNETIHGVEFKDYPVPTNKSGVLVADMSSNFCSKPVDVSRFGLIYAGAQKNVGPSGVTIAIVRKDLVGAAQPITPVMLDYKTHADNASLYNTPPCFAIYICGLVFEDLLAQGGLAEVEKKNQHKAGILYDTIDASGGYFICPVDKPVRSLMNVPFTLAKGADFEKQFIAEAAKEGMLQLKGHRSVGGVRASIYNAMPLSGVEKLVAFMKDFQARNP

SEQ ID NO: 8857 - protein, 186 aa, Unknown
  Sequence found in Organisms: Secale cereale, Triticum aestivum
MDRPQVVSENYANPITCLFHVLFKASALAFYILFSLFVKSFVIIFVITVLLAALDFWVVKNVSGRILVGLRWWNEIDDDGNSVWKFECLDGESLARMNKKDSWLFWWTLYLNAAAWIILGIFSLIRLEADYLLVVGVCLTLSLANIVGFTKCNKDAKKNIRAFAENAAQNAITSRITSSLQSAFGI

SEQ ID NO: 8858 - protein, 186 aa, Hordeum vulgare
MDRPQVVSENYANPITCLFHVLFKASALAFYILFSLFVKSFVIIFVITVLLAALDFWVVKNVSGRILVGLRWWNEIDDDGNSVWKFECLDGESLARMNKKDSWLFWWTLYLNAAAWIILAIFSLIRLEADYLLVVGVCLTLSLANIVGFTKCNKDAKKNIRAFAENAAQNAITSRITSSLQSAFGI

SEQ ID NO: 8859 - protein, 186 aa, Pseudoroegneria spicata
MDRPQVVSENYANPITCLFHVLFKASALAFYILFSLFVKSFVIIFVITVLLAALDFWVVKNVSGRILVGLRWWNEIDDDGNSVWKFECLDGESLARMNKKDSWLFWWTLYLNAAAWIILGIFSLIRLEADYLLVVGVCLTLSLANIVGFTKCNKDAKKNIRAFAENAAQNAITSRFTSSLQSAFGI

SEQ ID NO: 8860 - protein, 186 aa, Avena sativa
MDRPQVVSENYANPITCLFHVLFKASALAFYILFSLFVKSFVIIFVITVLLAALDFWVVKNVSGRILVGLRWWNEIDDEGNSVWKFECLDGESLARMNKKDSWLFWWTIYLNAAAWIILGVFSLIRLEADYLLVVGVCMTLSIANIVGFTKCNKDAKKNIRAFVENSAQNAITSRITTSLQSAFGI

SEQ ID NO: 8861 - protein, 186 aa, Avena sativa
MDRTQVVSENYANPITCLFHVLFKASALAFYILFSLFVKSFVIIFVITVLLAALDFWVVKNVSGRILVGLRWWNEIDDDGNSVWKFECLDGESLARMNKKDSWLFWWTIYLNAAAWIILGVFSLIRLEADYLLVVGVCMTLSIANIVGFTKCNKDAKKNIRAFVENSAQNAITSRITSSLQTAFGI

SEQ ID NO: 8862 - protein, 183 aa, Unknown
  Sequence found in Organisms: Cynodon dactylon, Panicum virgatum
MDQRQVVSENYANPITCFFHVLFKAAALAFYILFSLFVKSFVIIFVITVLLAALDFWVVKNVSGRILVGLRWWNEIDDEGNSVWKFECLDGESLARMNKKDSWLFWWTLYLTAAAWIVLGIFSLIRLEADYLLVVGVCLSLSIANIVGFTKCNKDAKKNIQAFAQNALASRVTSSLQSAFGVI

SEQ ID NO: 8863 - protein, 186 aa, Avena sativa
MDRSQVVSENYANPITCLFHVLFKASALAFYILFSLFMKSFVIIFVITVLLAALDFWVVKNVSGRILVGLRWWNEIDDDGNSVWKFECLDGESLARMNKKDSWLFWWTIYLNAAAWIILGVFSLIRLEADYLLVVGVCMTLSIANIVGFTKCNKDAKKNIRAFVENSAQNAITSRITSSLQTAFGI

SEQ ID NO: 8864 - protein, 183 aa, Setaria italica
MDQRQVVSENYANPITCFFHVLFKAAALAFYILFSLFVKSFVIIFVITVLLAALDFWVVKNVSGRILVGLRWWNEIDDEGNSIWKFECLDGESLARMNKKDSWLFWWTLYLTAAAWIVLGIFSLIRLEADYLLVVGVCLSLSIANIVGFTKCNKDAKKNIQAFAQNALASRVTSSLQSAFGVI

SEQ ID NO: 8865 - protein, 183 aa, Zea mays
MDQRQVVSENYANPITCFFHVLFKAGALAFYILFSLFVKSFVIIFVITVLLAALDFWVVKNVSGRILVGLRWWNEIDDDGNSVWKFECLDGESLARMNKKDSWLFWWTLYLTAAAWIVLGIFSLIRLEADYLLVVGVCLSLSIANIVGFTKCNKDAKKNIQTFAQNALASRVTSSLQSAFGVI

SEQ ID NO: 8866 - protein, 176 aa, Leymus cinereus x Leymus triticoides
  misc_feature (98)..(98): Xaa can be any naturally occurring amino acid
YANPITCLFHVLFKASALAFYILFSLFVKSFVIIFVITVLLAALDFWVVKNVSGRILVGLRWWNEIDDDGNSVWKFECLDGESLARMNKKDSWLFWWXLYLNAAAWIILGIFSLIRLEADYLLVVGVCLTLSLANIVGFTKCNKDAKKNIRAFAENAAQNAITSRITSSLQSAFGI

SEQ ID NO: 8867 - protein, 183 aa, Pennisetum glaucum
MDQRQVVSENYANPITCFFHVLFKAAALAFYILFSLFVKSFVIIFVITVLLAALDFWVVKNVSGRILVGLRWWNEIDDEGNSIWKFECLDGESLARMNKKDSWLFWWTLYLTAAAWIVLAIFSLIRLEADYLLVVGVCLSLSIANIVGFTKCNKDAKKNIQAFAQNALASRVTSSLQSAFGVI

SEQ ID NO: 8868 - protein, 187 aa, Oryza sativa
MDRPQVVTENYANPVTCLFHVLFKAGALVFYILFSLFVKSFVIIFVITVFLAALDFWVVKNVSGRILVGMRWWNEIDDEGNSVWKFECLDGEALARMNKKDSWLFWWTLYLTAAAWIILGIFSLIRLEADYLLVVGVCLTLSLANIVGFTRCNKDAKKNIRGYFEGHAQNAITSRITSTLQSAFGVI

SEQ ID NO: 8869 - protein, 183 aa, Saccharum officinarum
MDQRQVVSENYANPITCFFHVLFKAGALAFYILFSLFVKSFVIIFVITVLLAALDFWVVKNVSGRILVGLRWWNEIDDEGNSVWKFECLDGESLARMNKKDSWLFWWTLYLTAAAWIVLGIFSLIRLEADYLLVVGVCLSLSIANIVGFTKCNKDAKKNIQTFAQNALASRVTSSLQSAFGVI

SEQ ID NO: 8870 - protein, 183 aa, Sorghum bicolor
MDQRQVVSENYANPITCFFHVLFKAGALAFYILFSLFVKSFVIIFVITVLLAALDFWVVKNVSGRILVGLRWWNEIDDEGNSVWKFECLDGESLARMNKKDSWLFWWTLYLTAAAWIVLGIFSLIRLEADYLLVVGVCLSLSIANIVGFTKCNKDAKKNIQTFAQNALASHVTSSLQSAFGVI

SEQ ID NO: 8871 - protein, 183 aa, Eragrostis curvula
MDQRQVVSENYANPITCFFHVLFKAAALAFYILFSLFVKSFVIIFVITVLLAALDFWVVKNVSGRILVGLRWWNEIDDKGNSVWKFECLDGESLARMNEKDSWLYWWTLYLTDAAWIDLGIFSLIRLEADYLLVVGVCLSLSIANIVGFTKCNKDAKKNIQAFAQNALASRVTSSLQSAFGVL

SEQ ID NO: 8872 - protein, 186 aa, Secale cereale
  misc_feature (22)..(22): Xaa can be any naturally occurring amino acid
  misc_feature (153)..(153): Xaa can be any naturally occurring amino acid
  misc_feature (161)..(161): Xaa can be any naturally occurring amino acid
PWIGPSGQRELCQSYNLPLPCXLQASALAFYILFSLFVKSFVIIFVITVLLAALDFWVVKNVSGRILVGLRWWNEIDDDGNSVWKFECLDGESLARMNKKDSWLFWWTLYLNAAAWIILGIFSLIRLEADYLLVVGVCLTLSLANIVGFTKCXKDAKKNIXAFAENAAQNAITFRITSSLQSAFGI

SEQ ID NO: 8873 - protein, 183 aa, Oryza sativa
MDQHQVVGENYANPKTCFFHVLFKAGALAFYILSALFVTNFVIIFVITVLLAALDFWVVKNVSGRILVGLRWWNEIDDEGNSVWKFECLDGESLARMNKKDSWLFWWTLYLTAAAWIVLGIFSLIRLHADYLLVVGVCLSLSIANIVGFTKCNKDAKKNVADWTRTTLLSSGVRSTIQSAFGV

SEQ ID NO: 8874 - protein, 184 aa, Panicum virgatum
MDQQPQGISENYANPKTCLFHVLFKAAALAFYILSALFVNNFVIIFVITVLLAALDFWVVKNVSGRILVGLRWWNEINDEGESVWKFECLDGESLARMNKKDSWLFWWTLYLTAAAWIILGIFSLIRLQADYLLVIGVCLSLSIANIVGFTKCNKDAKKNIQDWTTNALLSGSVRSHLQSAFGV

SEQ ID NO: 8875 - protein, 183 aa, Musa acuminata
MDPVQPTGENYANPKTCLFHVLFKAAALAFYILSAIFIDSFVIIFVVTVFLAALDFWVVKNVSGRILVGLRWWNEIDEQGESIWKFECLDQESLARMNKKDSWLFWWTLYLTAVAWIFLGIFSLIRFQADYLLVVGVCLTLSIANIVGFTKCRKDAKKQIQQFATQTIASRFTSSLQSAFSVV

SEQ ID NO: 8876 - protein, 183 aa, Phaseolus coccineus
MDPNQSVGENYANPKTCFFHVLFKAAALAFYILSALFIDNFVIIFVVTVLLAALDFWVVKNVSGRILVGLRWWNEINDLGESVWKFECLDHESLARMNKKDSWLFWWTLYLTAIAWIFLAIFSLIRLQADYLLVVGVCLTLSIANIVGFTKCKKDAKKQIQQFASQTIASRFSSTLQSAFSVV

SEQ ID NO: 8877 - protein, 183 aa, Musa acuminata
MDPVQPTGENYANPRTCFFHVLFKAAALAFYILSAIFIDSFVIIFVVTVFLAALDFWVVKNVSGRILVGLRWWNEIDEQGESVWKFECLDQESLARMNKKDSWLFWWTLYLTAVAWIFLGIFSLIRFQADYLLVVGVCLTLSIANIVGFTKCRKDAKKQIQQFATQTIASRFTSSLQSAFSVV

SEQ ID NO: 8878 - protein, 183 aa, Glycine max
MDPNQPVGENYANPRTCFFHVLFKAAALAFYILSALFIDNFVIIFVVTVLLAALDFWVVKNVSGRILVGLRWWNEINDLGESVWKFECLDHESLARMNKKDSWLFWWTLYLTAILWIVLAIFSLIRLQADYLLVVGVCLTLSIANIVGFTKCKKDAKKQIQQFASQTIASRFSSTLQSAFSVV

SEQ ID NO: 8879 - protein, 916 aa, Triticum aestivum
MESHGDDLPPPPPLPPNAEPIKAESADDLPPPPPLPPIKPEEAKKISKPKRALIARPGFGKRGNPIQLVTNHFKVSLKTTDEFFHHYYVNLKYEDDRPVDGKGVGRKVIDKLSQTYASELAHKDFAYDGEKSLFTIGALPQINNEFVVVLEDVSSGKTPANGSPGNDSPDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPRRPTYFPIELCQLVPLQRYTKSLSTLQRSSLVEKSRQKPQERMSVLSDVLKRSSYDTEPMLKACGISIAQGFTQVSGRVLQAPKLKAGNGEDIFTRNGRWNFNNKRLARACVVDRWAVVNFSARCNTMNLVNDLIKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8880 - protein, 918 aa, Secale cereale
MESHGDDLPPPPPLPPNAEPIKAELADDLPPPPPLPPNKSEEAKKISKPKRALIARPGFGKRGNPIQLVTNHFKVSLKTTDEFFHHYYVNLKYEDDRPVDGKGVGRKVIDKLQQTYASDLANKDFAYDGEKSLFTIGALPQINNEFVVVLEDVSSGKTPANGSPGNDSPGNDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPKRPTYFPIELCQLVPLQRYTKSLSTLQRSSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTTNLVNDLMKCGAMKGITVEKPHIVIEENGSMRRAPAPKRVEDMFEQIKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFHQVLNIELDQIIEACKFLDENWNPKFTLIVAQKNHHTKFFMPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8881 - protein, 918 aa, Secale cereale
MESHGDDLPPPPPLPPNAEPIKAELADDLPPPPPLPPNKPEEAKKISKPKRALIARPGFGKRGNPIQLVTNHFKVSLKTTDEFFHHYYVNLKYEDDRPVDGKGVGRKVIDKLQQTYASDLANKDFAYDGEKSLFTIGALPQINNEFVVVLEDVSSGKTPANGSPGNDSPGNDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPKRPTYFPIELCQLVPLQRYTKSLSTLQRSSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTTNLVNDLMKCGAMKGITVEKPHIVIEENGSMRRAPAPKRVEDMFEQIKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFHQVLNIELDQIIEACKFLDENWNPKFTLIVAQKNHHTKFFMPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8882 - protein, 918 aa, Triticum aestivum
MESQGDDLPPPPPLPPNAEPIKAESADDLPLPPPLPPIKPEEAKKISKPKRALIARPGFGKRGNPIQLVTNHFKVSLKTTDEFFHHYYVNLKYEDDRPVDGKGVGRKVIDKLSQTYASELAHKDFAYDGEKSLFTIGALPQINNEFVVVLEDVSSGKTPANGSPGNDSPGNDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPRRPTYFPIELCQLVPLQRYTKSLSTLQRSSLVEKSRQKPQERMSVLSDVLKRSSYDTEPMLKACGISIAQGFTQVSGRVLQAPKLKAGNGEDIFTRNGRWNFNNKRLARACVVDRWAVVNFSARCNTMNLVNDLIKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPENVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8883 - protein, 489 aa, Secale cereale
MSVLSDVLKHSSYDTEPMLKACGISIAQGFTQVAGRVLQAPKLKAGNGEDIFTRNGRWNFNNKRLARACVVDRWAVVNFSARCNTMNLVNDLMKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFHQVLNIELDQIIEACKFLDENWNPKFTLIVAQKNHHTKFFMPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8884 - protein, 916 aa, Triticum aestivum
MESHGEDLPPPPPLPPNAEPIKAESADDLPPPPPLLPIKPEEAKKISKPKRALIARPGFGKRGNPIQLVTNHFKVSLKTTDEFFHHYYVNLKYEDDRPVDGKGVGRKVIDKLAQTYPSELAHKDFAYDGEKSLFTIGALPQINNEFVVVLEDVSSGKTPANGSPGNDSPDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPRRPTYFPIELCQLVPLQRYTKSLSTLQRSSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTMNLVNDLIKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8885 - protein, 918 aa, Secale cereale
MESHGDDLPPPPPLPPNAEPIKAESADDLPPPPPPPPNKPEEAKKISKPKRALIARPGFGKRGNPIQLVTNHFKVSLKTTDEFFHHYYVNLKHEDDRPVDGKGVGRKVIDKLQQTYPSELAHKDFAYDGEKSLFTIGALPQINNEFVVVLEDVSSGKTPANGSPGNDSPGNDKKRVKRPYQTKTFKVELSYAARIPMSAIAMALKGQESEHTQEAIRVIDIILRQHSAKQGCLLVRQSFFHNNPSNFVDLGGAVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPKRPTYFPIELCQLVPLQRYTKSLSTLQRSSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTMNLVNDLMKCGGMKGITVEKPHIVIEENGSMRRAPAPKRVEDMFEQVKSKLPGAPKFLLCILAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFHQVLNIELDQIIEACKFLDENWNPTFTLIVAQKNHHTKFFMPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8886 - protein, 136 aa, Secale cereale
MPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRLHEKVRSSMFFC

SEQ ID NO: 8887 - protein, 921 aa, Hordeum vulgare
MESHVVEGDDLPPPPPLPPNAEPVKAQSADDLPRPPPLPPVKPEEAKKISKPRRALIARPGFGKRGNPIQLVTNHFKVSLKTTDEFFHHYYVNLKYEDDRPVDGKGVGRKVIDKLQQTYASDLAHKDFAYDGEKSLFTIGALPQINNEFVVVLEDFSTGKTPANGSPGNDSPGNDKKRVKRPYQTKTFKVELSFAARIPMSAIAMALKGQESEHTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWPKAKRALKNLRIKTSPANTEYKIVGLSDRNCYEQMFSLKQRNGGNGEPEAIEISVYDYFVKNRGIELRYSGDFPCINVGKPKRPTYFPIELCQLVPLQRYTKSLSTLQRSSLVEKSRQKPQERMSVLSDVLKRSSYDTEPMLRACGISIAQGFTQVAGRVLQAPKLKAGNGEDIFTRNGRWNFNNKRLARACVVDRWAVVNFSARCNTVNLVSDLIKCGAMKGITVEKPHTIIEENGAMRRAPAPKRVEDMFEQVKSKLPGAPKFLLCVLAERKNSDVYGPWKRKCLADFGIVTQCVAPTRVNDQYLTNVLLKINAKLGGMNSLLQIEMSPSIPLVSKVPTLILGMDVSHGSPGQSDIPSIAAVVGSREWPLVSKYRASVRSQSPKLEMIDSLFKPQGTEDDGLVRECLIDFYTSSGKRKPDQIIIFRDGVSESQFNQVLNIELDQIIEACKFLDENWNPKFTLIVAQKNHHTKFFMPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSTASGPVQELPRLHEKVRSSMFFC

SEQ ID NO: 8888 - protein, 904 aa, Oryza sativa
MESNSGEIEELPPPPPLPPNAEPIKTDDTKKLSKPKRALMARSGCGKKGQPIQLLTNHFKVSLKAADEFFHHYYVNLKYEDDRPVDGKGIGRKVLDKLQQTYASELANKDFAYDGEKSLFTIGALPQVNNEFTVVLEDFNTGKSSANGGSPGNDSPGNDRKRVRRPYQTKTFKVELNFAAKIPMSAIAQALRGQESENTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFTLKQRNGDGEPEGVEVSVYEYFVKNRGIELRYSGDFPCINVGKPKRPTYFPIELCSLVPLQRYTKALSTLQRSSLVEKSRQKPEERMSVLSDVLKRSNYDSEPMLNSCGISIARGFTQVAGRVLQAPKLKAGNGEDLFARNGRWNFNNKRLIKASSIEKWAVVNFSARCNIRDLVRDIIKCGGMKGIKVEDPFDVIEEDPSMRRAPAARRVDGMIDKMQKKLPGQPKFLLCVLAERKNSDIYGPWKRKCLAEFGIITQCVAPTRVNDQYITNVLLKINAKLGGLNSLLQIETSPSIPLVSKVPTIILGMDVSHGSPGQSDIPSIAAVVSSREWPLVSKYRASVRSQSPKLEMIDGLFKPQGAQEDDGLIRELLVDFYTSTGKRKPDQVIIFRDGVSESQFTQVLNIELDQIIEACKFLDENWSPKFTLIVAQKNHHTKFFVPGSQNNVPPGTVVDNAVCHPRNNDFYMCAHAGMIGTTRPTHYHILHDEIGFSADDLQELVHSLSYVYQRSTTAISVVAPICYAHLAAAQVSQFIKFDEMSETSSSHGGHTSAGSAPVPELPRLHNKVRSSMFFC

SEQ ID NO: 8889 - protein, 902 aa, Setaria italica
MESHNGEADDLPPPPPLNAGDEPLKAEETKKLSKPKRVLVPRKGFGKKGQPIRLVTNHFKVSLKNTEEFFFHYYVNLKYEDDTPVDRKGAGRSVIEKLQQTYATELANKDFAYDGEKSLFTIGALPQVNNEFTVVVEDVSTGKTPANGSPGNDSPPGSDRKRVRRPYNTKTYKVELSFAARIPMNAIAHALRGQESEHTQEAIRVIDIILRQHSAKQGCLLVRQSFFHNNPSNFVDLGGSVMGCRGFHSSFRATQSGLSLNIDVSTTMIVKPGPVVDFLLANQKVDHPNMIDWAKAKRSLRNLRIKITPTNAENKIAGLSDKPCRETMFTLKRRNGDNGDSEEISVYDHFVKNRGIELRYSGDFPCINVGKPKRPSYFPIELCNLVSLQRYTKALSTLQRSSLVEKSRQKPQERMSVLSDVLQRSNYDSEPMLMACGISIAKSFTEVDGRVLQPPKLKAGNGEDIFTRNGRWNFNNKRLIRASSVDKWAVVNFSARCNVRDLVRDLIKCGGMKGIKVEPPFNAFEENPSMRRAPAVRRVEDMFEQVKTKLPGAPKFLLCVLAERKNSDVYGPWKKKCLAEFGIVTQCVAPTRVNDQYLTNVLLKINAKLGGLNSMLQVESSPAMPLISKVPTMILGMDVSHGSPGQSGVPSIAAVVSSREWPLISKYRASVRSQSPKMEMIDSLFKPRGTDDDGLIRECLIDFYTSSGKRKPDQIIIFRDGVSESQFNQVLNIELDQIIEACKFLDEKWNPKFTLIIAQKNHHTKFFIPGAPENVPPGTVVDNKVCHPRNYDFYMCSHAGMIGTTRPTHYHILHDEIGFNPDDLQELVHSLSYVYQRSTTAISVVAPICYAHLAAAQVGQFIKFEEMSETSSSQGEHTSAGSVPVQELPRLHEKVRSSMFFC

SEQ ID NO: 8890 - protein, 902 aa, Pennisetum glaucum
MESHNGEAEDLPPPPPLNSGDEPLKAEEIKKLSKPKRALVPRKGFGKKGQPIRLVTNHFKVSLKNTEEFFYHYYVNLKYEDDTPVDRKGAGRSVIEKLKQTYATELANKDFAYDGEKSLFTIGALPQINNEFTVVVEDISTGKTPANGSPGNDSPPGSDRKRVRRPYNTKTYKVELSFAAKIPMNAIAHALRGQESEHTQEAIRVIDIILRQHSAKQGCLLVRQSFFHNNPSNFVDLGGGVMGCRGFHSSFRATQSGLSLNIDVSTTMIVKPGPVVDFLIANQKVDHPSKIDWAKAKRSLKSLRIKINPTNSENKIVGLSEKPCRETMFTLKRRNGDSVESEEISVYDHFVKNRGIELRYSADLPCINVGKPKRPSYFPIELCNLVSLQRYTKSLSTLQRSSLVEKSRQKPQERMSVLSDVLQRSNYDSEPMLMACGISIAKSFTEVDGRVLQPPKLKAGNGEDIFTRNGRWNFNNKRLIRASSIDKWAVVNFSARCNVRDLVRDLIKCGGMKGINVEPPFNVFEENPSMRRAPPVRRVEDMFEQVKTKLPGAPKFLLCILAERKNSDVYGPWKKKCLAEFGIVTQCVAPTRVNDQYLTNVLLKINAKLGGLNSLLQVESSPAMPLISKVPTMILGIDVSHGSPGQSGVPSIAAVVSSREWPLISKYRASVRSQSPKMEMIDSLFKPRGTDDDGLIRECLIDFYTSSGKRKPDQIIIFRDGVSESQFNQVLNIELDKIIEACKFLDEKWDPKFTLIVAQKNHHTKFFIPGVPDNVPPGTVVDNKVCHPKNYDFYMCSHAGMIGTTRPTHYHILHDEIGFNPDDLQELVHSLSYVYQRSTTAISVVAPICYAHLAAAQVGQFIKFEEMSETSSSHGEHTSAGSVPVQELPRLHEKVRSSMFFC

SEQ ID NO: 8891 - protein, 902 aa, Panicum virgatum
MDSHNGEADDLPPPPPLNACIEPLKSEETKKLLKPKRALIPRKGFGKKGQQIRLVTNHFKVSLKNTDEFFYHYYVNLKYEDDTPVGKGAGRSVIEKLQQTYATELANKDFAYDGEKSLFTIGALPQNINEFTVVVEDVSTGKTPANGSPGNDSPPGSDRKRVRRPYNTKTYKVELSFAAKIPMNAIAHALKGQESEHTQEAIRVIDIILRQHSANQGCLLVRQSFFHNNPSNFVELGGGVMGCRGFHSSFRATQSGLSLNIDVSTTMIVQPGPVINFLLANQKVDNPNKIDWQKAKRSLKNLRIKITPTNAVNKIVGLSDRPCRETMFTLKRRNGDNGDSEEISVYDHFVKNRGIELKYSADFPCINVGKQKRPSYFPIELCTLVSLQRYTKSLTTLQRSSLVEKSRQKPQERMSVLSDVLKRSNYDSEPMLKACGISIAKSFTEVDGRVLQAPKLKAGNGEDIFTRNGRWNFNNKRLIKASSVDKWAVVNFSARCNVRDLVRDLIKCGGMKGINVEPPFDAFEENPSMRRAPAVRRVEEMFEQVKTKLPGAPKFLLCILAERKNSDIYGPWKKKCLAEFGIVTQCVAPPPRVNDQYLTNVLLKINAKLGGLNSILQVESSPAMPLISKVPTMILGMDVSHGSPGQSGVPSIAAVVSSREWPLISKYRASVRSQSAKMEMIDSLFKPQGTDDNGLIRECLIDFYTSSGKRKPDQIIIFRDGVSESQFSQVLNIELDQIIEACKFLDEKWDPKFTLIVAQKNHHTKFFIPGAPDNVPPGTVVDNKVCHPRNYDFYMCSHAGMIGTTRPTHYHILHDEIGFNPDDLQELVHSLSYVYQRSTTAISVVAPICYAHLAAAQVGQFIKFDEMSETSSSHGEHTSAGSVPVQELPRLHDKVRSSMFFC

SEQ ID NO: 8892 - protein, 902 aa, Cenchrus ciliaris
MESHNSEADDLPPPPPLNSGDEPLKAEETKMLSKPKRALVPRKGFGKKGQPIRLVTNHFKVALKNTEEFFYHYYVNLKYEDDTPVDRKGAGRSVIEKLQQTYATELANKDFAYDGEKSLFTIGALPQNINEFTVVVEDISTGKAPANGSPGNDSPPGSDRKRVRRPYNTKTYKVELSYAAKIPMNAIAHALRGQESEHTQEAIRVIDIILRQHSAKQGCLLVRQSFFHNNPSNFVDLGGGVMGCRGFHSSFRATHKGLSLNIDVSTTMIVKPGPVVDFLIENQKVDHPNKIDWAKAKRSLKNLRIKISPGNAENKIVGLSDRPCRETMFTLKRRNGDNVDSEEISVYDHFVKNRGIELRYSGDLPCINVGKPKRPSYFPIELCNLVPLQRYTKSLSTLQRSSLVEKSRQKPQERMSVLSDVLQRSNYDSEPMLMACGISIAKSFTEVDGRVLQAPKLKAGNGEDIFTRNGRWNFNNKRLIRASSIDKWAVVNFSARCNVRDLVRDLIKCGGMKGINVEAPFNVFEENPNMRRAPAVRRVEDMFEQVKTKLPGAPKFLLCILAERKNSDVYGPWKKKCLAEFGIVTQCVAPTRVNDQYLTNVLLKINAKLGGLNSMLQVESSPAMPLISKVPTMILGMDVSHGSPGQSGVPSIAAVVSSREWPLISKYRASVRSQSPKTEMIDSLFKQRGTDDDGLIRECLIDFYTSSGKRKPDQIIIFRDGVSESQFNQVLNIELDQIIEACKFLDEKWEPKFTLIVAQKNHHTKFFIPGNPDNVPPGTVVDNKVCHPKNYDFYMCSHAGMIGTTRPTHYHILHDEIGFNPDDLQELVHSLSYVYQRSTTAISVVAPICYAHLAAAQVGQFIKFEEMSETSSSHGEHTSAGSVPVQELPRLHEKVRSSMFFC

SEQ ID NO: 8893 - protein, 899 aa, Panicum virgatum
MEPHNGEADDLPPPPPLDAGIEPLKADETKKMLKPKRALVPRQGFGKKGQPIKLLTNHFKVSLKNTEEFFYHYYVNLKYEDDTPVDSKGAGRIVIEKLQQTYATELANKDFAYDGEKSLFTIGALPQINNEFTIVVEDASTGKTPANGSPGNDSSPGSDRKRVRRPYNTKTYKVGLSFAAKIPMSAIALALKGQESEHTQEAIRVIDIILRQHSAKQGCLLVRQSFFHNNPSNFVDLGGGVMGCRGFHSSFRATQSGLSLNIDVSTTMIVKPGPVADFLMANQKVDNPNMIDWTKAKRSLKNLRIKITPTNAENKIVGLSDRSCRETMFTLKRRDGDSEEISVFDYFVKNRRIELRYSGDFPCINVGKPKRPTYFPIELCTLVSLQRYTKSLSTLQRSSLVEKSRQKPQERMSVLSDVLKRSNYDSEPMLMACGISIAKSFTEVDGRVLQAPKLKAGNGEDIFTRNGRWNFNNKRLIRASSVERWAVVNFSARCNVRDLVRDLIKCGGMKGIKVEDPFDAFEEHPSMRRAPAVKRVEEMFEQVKSKLPGAPKFLLCVLAERKNSDVYGPWKKKCLAEFGIVTQCVAPTRVNDQYLTNVLLKINAKLGGLNSMLQVESSPAMPLISKVPTMILGMDVSHGSPGQSGVPSIAAVVSSREWPLISKYRASVRSQSPKMEIIDSLFKPQGKDDKGLIRECLIDFYTSSGKRKPDQIIIFRDGVSESQFSQVLNIELDKIIEACKFLDETWDPKFTLIVAQKNHHTKFFIPGAPENVPPGTVVDNKVCHPRNYDFYMCSHAGMIGTTRPTHYHILHDEIGFNPDDLQELVHSLSYVYQRSTTAISVVAPICYAHLAAAQVGQFIKFDEMSETSSSHGEHTSAGSAPVQELPSLHEKVRSSMFFC

SEQ ID NO: 8894 - protein, 901 aa, Saccharum officinarum
MESHTGEADDLPPPPPLAAGVEPLKADETKAPLKLRSPVQRNGFGRKGQQIKLITNHFKVSLMNAADYFYHYYVNLKYEDDTPVDRKGSGRKVIEKLQQTYAAELANKDFAYDGEKSLFTIGALPQVKNEFTVVVDDVSTGKTPANGSPGNDSPPGSDRKRIRRPYNTKTYKVELSFAAKIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLLANQKVSDPSMIDWAKAKRALKNLRIKTSPANQEQKIVGLSDRPCREQLFTLKRKNGNDGDSEEITVFDYFVKNRGIELQYSGDLPCINVGKPKRPTYFPVELCSLLPLQRYTKALSTLQRSALVEKSRQKPQERMSVLSDVLQRSNYDAEPMLKACGITIARSFTEVDGRVLQPPKLKAGNGEDIFTRNGRWNFNNKRLIRASSVEKWAVVNFSARCNVRDLVRDLIKCGGMKGIMVEAPFDVFDENPSMRRSPAVRRVEDMFEQVKTKLPGAPKFLLCVLAERKNSDIYGPWKKKCLAEFGIVTQCVAPTRVNDQYLTNVLLKINAKLGGMNSLLQIETSPAIPLVSKVPTIILGMDVSHGSPGHSDVPSIAAVVSSREWPLISKYRASVRTQSPKMEMMDSLFKPRETEDDGLIRECLIDFYTSSGKRKPDQVIIFRDGVSESQFNQVLNIELQQIIEACKFLDEKWNPKFTLIIAQKNHHTKFFIPGKPDNVPPGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 8895 - protein, 900 aa, Sorghum bicolor
MESHNGEADDLPPPPPLNAGVEPLKADETKVPLKHRTLVQRNGFGRKGQQIKLLTNHFKVSLMNAADYFYHYYVNLKYEDDTPVDRKGSGRKVIEKLQQTYAAELANKDFAYDGEKSLFTIGALPQVKNEFTVVVDDVSTGKTPANGSPGNDSPPGSDRKRIRRPYNTKTYKVELSFAARIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLLANQKVNHPGMIDWAKAKRSLKNLRIKTSPANQEQKIVGLSDRPCCEQLFTLKHKNGNGDSEEITVYDYFVKNRGIELQYSGDLPCINVGKPKRPTYFPVELCSLLPLQRYTKALSTLQRSSLVEKSRQKPQERIGVLSDVLQRSNYDAEPMLKACGITIARSFTEVDGRILQPPKLKAGNGEDIFTRNGRWNFNNKRLIKGSSVEKWAVVNFSARCNVRDLVRDLIKCGGMKGIMVEAPFDVFEENPSMRRSPAVRRVEDMFEQVKTKLPGAPKFLLCVLAERKNSDIYGPWKKKCLAEFGIVTQCVAPTRVNDQYLTNVLLKINAKLGGMNSLLQIETSPAIPQVSKVPTIILGMDVSHGSPGHSDVPSIAAVVSSREWPLISKYRASVRTQSPKMEMIDSLFKPRETEDDGLIRECLIDFYTSSGKKKPDQVIIFRDGVSESQFNQVLNIELQQIIEACKFLDEKWNPKFTLIIAQKNHHTKFFIPGKTENVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 8896 - protein, 898 aa, Zea mays
MESHNGEADDLPPPPPLAAGVEPLKADETKMPLKPRSLVQRNGFGRKGQQIKLITNHFKVSLMKAEDFFYHYYVNLKYEDDTPVDRKGSGRKVIEKLQQTYAAELANKDFAYDGEKSLFTIGALPQVKMEFTVVDEDVSTGKTPANGSPGNDSPPGSDRKRVRRPYNTKTYKVELSFAAKIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLIANQKVNDPSMIDWAKAKRSLKNLRIKTSPANQEQKIVGLSDRPCREQLFTLKHKNGESEEITVFDYFVKNRGIKLEYSGDLPCINVGKPKRPTYFPVELCSLLPLQRYTKALSTLQRSSLVEKSRQKPQERMSVLSDVLQRSNYDAEPMLKACGITIARNFIEVDGRVLQPPKLKAGNGEDIFTRNGRWNFNNKKLIRASSVEKWAVVNFSARCNVRDLVRDLIKCGGMKGIMVDAPFAVFDENPSMRRSPAVRRVEDMFEQVKTKLPGAPKFLLCVLAERKNSDIYGPWKKKCLAEFGIVTQCVAPTRVNDQYLTNVLLKINAKLGGLNSLLQIETSPAIPLVSKVPTIILGMDVSHGSPGHSDIPSVAAVVSSREWPLISKYRASVRTQSPKMEMIDSLFKPRETDDDGLIRECLIDFYTSSGKRKPDQVIIFRDGVSESQFNQVLNIELQQIIEACKFLDEKWNPKFTLIIAQKNHHTKFFIPGKPDNVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 8897 - protein, 196 aa, Zea mays
MTGKVLLVAVLILVGVASRCSGSRGLQGDHVAEQKFGGGGYGGGGGYGGYGGGGGGGGGGYGGGGGGGGGGYGGGGGYTPGYSGTGTCDYWKSHPDAIISCIGSLGSILGSFGDVCSAFFGSKLQTLQDALCNTRTDCYGDLLREGAAAYLNSIAAEKYAYSTQQVQDCIAVALTSKAAAVAQAAMFKKANYACSY

SEQ ID NO: 8898 - protein, 187 aa, Panicum virgatum
MMSGKALLVAVLLVGVASRCSGSRGLQWGHIAEQKYGGGGYGGGGGGYGGGGGYGGGGGGGGYGGGGGYTPGYSGTGTCDYWKSHPDAIISCIGSLGSILGSFGDVCSAFFGSKLQTLQDALCNTRTDCYGDLLREGAAAYLNSVASQKYAYTTQQVKDCIAVALTSEAAAAAQAAMFKKANYACHY

SEQ ID NO: 8899 - protein, 184 aa, Saccharum officinarum
MSGKVLLVAVLLVGVASRCSGSRGLQGDHVAEQKYGGGGYGGGGSGGGYGGGGSGGGYGGGGGGGYTPGYSGTGTCDYWKSHPDAIISCIGSLGSILGSLGDVCSAFFGSKLQTLQDALCNTRTDCYGDLLREGAAAYLNSVASKKYAYSTQQVKDCIAVALTSEAAAVAQAAMFKKANYACHY

SEQ ID NO: 8900 - protein, 199 aa, Sorghum bicolor
MSGKVLLVAVLLVGVAASRCSGSRGLQGGDHVAEQKYGGGGYGGGGSGGGYGGGGGGGGYGGYGGGGGGSGYGGGGGGYTPAYSGTGTCDYWKSHPDAIISCIGSLGSILGSLGDVCSAFFGSKVQTLQDALCNTRSDCYGDLLREGAAAYLNSVAAKKQQFAYSTQQVKDCIAVGLTSKAAAVAQAAMFKKANYACHY

SEQ ID NO: 8901 - protein, 167 aa, Panicum virgatum
MMSGKALLVAVLLVGVASRCSGSRGLQGDHIAEQKYGGGGYGGGGGGGYTPGYSGTGTCDYWKSHPDAIISCIGSLGSILGSFGDVCSAFFGSKLQTLQDALCNTRTDCYGDLLREGAAAYLNSVAAQKYAYTTQQVKDCIAVALTSEAAAAAQAAMFKKANYACHY

SEQ ID NO: 8902 - protein, 669 aa, Pennisetum glaucum
MARLGALLLPVAAAAAALLLLLSALPGARGFYLPGSYPHKYNPGEPLSVKVNSLTSIDTEMPFSYYSLPFCVPPEGVKDSAENLGELLMGDRIENSPYRFKMYTNESDVFLCRSAPLAPDAFALLKKRIDEMYQVNLILDNLPAIRYTRKDDYFLRWTGYPVGIRVGVDYYVFNHLQFTVLVHKYEDANVARVMGTADATDVIPAGGKDKDAGAAGSSTGWMVVGFEVVPCSIKHNPEDVKSTKMYDRYPSKIKCDPTTVSMSIKENEPIVYTYEVSFVESDIKWPSRWDAYLKMEGAKVHWFSILNSLMVIAFLAGIVFVILLRTVRRDLTKYEELDSEAQAQMNEELSGWKLVVSDVFRAPSNPMLLCVMVGDGVQILGMAVVTILFAALGFMSPASRGTLITGMLFFYLVLGILAGYAGVRVWKTIKCGDHSGWVGVSWRVACFFPGIAFLILTTLNFLLWGSQSTGAIPFSLFVVLLLLWFCISVPLTLVGGFLGAKAPHIEYPVRTNQIPREIPPQRYPSWLLVLGAGTLPFGTLFIELFFIMSSIWMGRVYYVFGFLFIVMLLLVIVCAEVSLVLTYMHLCVEDWKWWWKSFFASGSVAIYIFLYSINYLVFDLKSLSGPVSATLYIGYSLFMVIAIMLATGTVGFISSFCFVHYLFSSVKAD

SEQ ID NO: 8903 - protein, 650 aa, Panicum virgatum
SAATLLLSALPGARGFYLPGSYPHKYNPGELLNVKVNSLTSIDTEMPFSYYSLPFCVPPEGVKDSAENLGELLMGDRIENSPYRFKMYTNESDVFLCRSAPLAPDAFALLKKRIDEMYQVNLILDNLPAIRYTKKDDYFLRWTGYPVGIRVGVDYYVFNHLQFTVLVHKYEDANVARVMGAADATDVIPAGAKDGGAANSGWMVVGFEVVPCSIKHNPEDVKSHKMYDRYPSKIKCDPTTVSMSIKENEPIVYTYEVSFVESDIKWPSRWDAYLKMEGAKVHWFSILNSLMVIAFLAGIVFVILLRTVRRDLTKYEELDSEAQAQMNEELSGWKLVVSDVFRAPSKPMLLCVMVGDGVQILGMAVVTILFAALGFMSPASRGTLITGMLFFYLVLGILAGYVGVRVWKTIKCGDHSGWVGVSWRVACFFPGISFLILTTLNFLLWGSQSTGAIPFSLFVVLLLLWFCISVPLTLVGGFLGAKAPHIEYPVRTNQIPREIPPQKYPSWLLVLGAGTLPFGTLFIELFFIMSSIWMGRVYYVFGFLFIVLLLLVIVCAEVSLVLTYMHLCVEDWKWWWKSFFSSGSVAIYIFLYSINYLVFDLKSLSGPVSATLYIGYSLFMVIAIMLATGTVGFISSFCFVHYLFSSVKAD

SEQ ID NO: 8904 - protein, 661 aa, Zea mays
MARPGALLLAVAVAALLAAAVPGARGFYLPGSYPHKYNVGDDLNVKVNSLTSIDTEMPFSYYSLPFCEPQDGVKDSAENLGELLMGDRIENSPYRFRMYTNESDVFLCRSPPLGADAFSLLKKRIDEMYQVNLILDNLPAIRYTRKDDYIMRWTGYPVGIRVGVDYYVFNHLQFTVLVHKYEDANVARVIGAADATDAIPSGAKDAASSSPGWMVVGFEVVPCSIKHNPEDVKSRKMYDSYPSKIKCDPTTVSMSIKENEPIVYTYEVNFVESDIKWPSRWDAYLKMEGAKVHWFSILNSLMVIAFLAGIVFVILLRTVRRDLTKYEELDSEAQAQMNEELSGWKLVVSDVFRAPSNPMLLCIMVGDGVQILGMAVVTILFAALGFMSPASRGTLITGMLFFYLVLGILAGYVGVRVWKTIKCGDHSGWVAVSWRVACFFPGIAFLILTTLNFLLWGSHSTGAIPFSLFVVLLLLWFCISVPLTLVGGFLGAKAPHIEYPVRTNQIPREIPPQKYPSWLLVLGAGTLPFGTLFIELFFIMSSIWMGRVYYVFGFLFVVLLLLVIVCAEVSLVLTYMHLCVEDWKWWWKSFFSSGSVAIYIFLYSINYLIFDLKSLSGPVSATLYIGYSLFMVIAIMLATGTVGFISSFCFVHYLFSSVKAD

SEQ ID NO: 8905 - protein, 658 aa, Brachypodium distachyon
MARLFFLVAAAVAVLMSAPVAHAFYLPGSYPHKYNPGDSLNVKVNSLTSIDTEIPFSYYSLPFCTPSEGVKDSAENLGELLMGDRIENSPYRFKMYTNETDVLLCRSAPLAPDAFSLLKKRIDEMYQVNLILDNLPAIRYTKKDDYFLRWTGYPVGIRVGVDYYVFNHLQFTVLVHKYEDPNVARVMGTGDATDGIPTGGGKDAAGSSGWMVVGFEVVPCSIKHSPEDVKSLKMYSKYPSKIKCDPATVSMSIKENEPIVYTYEVTFVESDIKWPSRWDAYLKMEGAKVHWFSILNSLMVIAFLAGIVFVILLRTVRRDLTRYEELDSEAQAQMNEELSGWKLVVSDVFRAPSNPILLCMMVGDGVQILGMAVVTILFAALGFMSPASRGTLITGMLFFYLVLGILAGYASVRVWKTIKCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8906 - protein, 665 aa, Oryza sativa
MARLLPFLVAAAAALVAVSLSAPGADGFYLPGSYPHKYNPGEPLSVKVNSLTSIDTEIPYSYYSLPFCTPPDGVKDSAENLGELLMGDRIENSPYRFRMHANDSDLFLCRSPPLAADAFNLLKKRIDEMYQVNLILDNLPAIRYTKKDDYFLRWTGYPVGIRVGVDYYVFNHLQFTVLVHKYEEANVARVMGTGDATDGFPSTGKDGSGGAAGSSGWMVVGFEVVPCSIKHNPDDVKSLKMYGKYPRSIKCDPTTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCVMVGDGVQILGMAVVTILFAALGFMSPASRGTLITGMLFFYLVLGILAGYVGVRVWKTIKCGDHTGWMAVSWRVACFFPGIAFLILTTLNFLLWGSQSTGAIPFSLFVILILLWFCISVPLTLVGGLLGAKAPHIEYPVRTNQIPREIPPQKYPSWLLVLGAGTLPFGTLFIELFFIMSSIWMGRVYYVFGFLFIVLLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8907 - protein, 665 aa, Avena sativa
MAPRLRALRLLLALAAAAAVLLSSPPSTDAFYLPGSYPHKYNPGEILNVKVNSLTSIDTEIPFSYYSLPFCTPPEGVKDSAENLGELLMGDRIETSPYRFRMHANETDVLLCRSDPLSPGAFALMKKRIDEMYQVNLILDNLPAIRYTRKDDYFLRWTGYPVGIRVAADYYVFNHLQFTVLVHKYEDPNVARVMGTGDASDGIPTGKDGASSSSSGWMVVGFEVVPCSIKHNPDDVKSLKMYGKYPSRIKCDPTTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKASHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFIHYLFSSVKAD

SEQ ID NO: 8908 - protein, 670 aa, Hordeum vulgare
MARPRSTRALLALALAAAAAALLLATPPAAHAFYLPGSYPHKYSPGEPLSVKVNSLTSIDTEIPYSYYSLPFCAPPEGVKDSAENLGELLMGDRIESSPYRFRMHANESDVLLCRSPPLDPKTFALLKRRIDEMYQVNLILDNLPAIRYTRKDDYFLRWTGYPVGIRVGVDYYVFNHLQFTVLVHRYEDPNVARVMGAAGDASDGAIPAATAGRDASASSGWMVVGFEVVPCSIKHNPEDAKAVKMYGRFPSKIKCDPTTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8909 - protein, 664 aa, Triticum aestivum
MAAARPRLLLLLAAAAAALLLTPAHAFYLPGSYPHKYAPGEPLSVKVNSLTSIDTEIPYSYYSLPFCAPPEGVKDSAENLGELLMGDRIESSPYRFKMHANESDVLLCRSAPLSPPDFALLKRRIDEMYQVNLILDNLPAIRYTRKDDYFLRWTGYPVGIRVGVDYYVFNHLQFTVLVHRYEDPNVARVMGAAGDASDGAAVPANAGKDASAAPGWMVVGFEVVPCSIKHNPEDARAVKMYGKFPSKIKCDPSTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8910 - protein, 657 aa, Hordeum vulgare
ALAAAAAALLLATPPAAHAFYLPGSYPHKYSPGEPLSVKVNSLTSIDTEIPYSYYSLPFCAPPEGVKDSAENLGELLMGDRIESSPYRFRMHANESDVLLCRSPPLDPKTFALLKRRIDEMYQVNLILDNLPAIRYTRKDDYFLRWTGYPVGIRVGVDYYVFNHLQFTVLVHRYEDPNVARVMGAAGDASDGAIPAATAGRDASASSGWMVVGFEVVPCSIKHNPEDAKAVKMYGRFPSKIKCDPTTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8911 - protein, 666 aa, Secale cereale
MAKAAARPRLLLLLAAAAAALLLLAPAPARAFYLPGSYPHKYAPGEPLSVKVNSLTSIDTEIPYSYYSLPFCAPPEGVKDSAENLGELLMGDRIESSPYRFRMHANESDVLLCRSPPLSPPDFALLKRRIDEMYQVNLILDNLPAIRYTRKDDYFLRWTGYPVGIRVGVDYYVFNHLQFTVLVHKYEDPNVARVMGAAGDASDGPANTGKDASAAPGWMVVGFEVVPCSIKHNPEDARAVKMYGRFPSKIKCDPSTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8912 - protein, 651 aa, Triticum aestivum
AAAAALLLAPAHAFYLPGSYPHKYAPGEPLSVKVNSLTSIDTEIPYSYYSLPFCAPPEGVKDSAENLGELLMGDRIESSPYRFKMHANESDVLLCRSAPLSPPDFALLKRRIDEMYQVNLILDNLPAIRYTRKDDYFLRWTGYPVGIRVGVDYYVFNHLQFTVLVHRYEDPNVARVMGAAGDASDGAAVPANAGKDASAAPGWMVVGFEVVPCSIKHNPEDARAVKMYGKFPSKIKCDPSTVSMSIKENEPIVYTYEVSFVESDIKWPSRWDAYLKMEGAKVHWFSILNSLMVIAFLAGIVFVILLRTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 8913 - protein, 656 aa, Elaeis guineensis
MVFFWRFRLWILLSLLVLPSGEGFYLPGSYPHKYLVGDTLSVKVNSLTSIDTEIPYGYYSLPFCKPQEGIKDSAENLGELLMGDRIENSPYRFKMFTNESDVLLCRANPLSTQDFNLLKKRIDEMYQVNLILDNLPAIRYTKKGEYFLRWTGYPVGIRAGDTYYVFNHLRLKVLVHKYEETNVAKVMGTGDASDAIPSLDKSGSGPGWMVVGFEVVPCSFQHDSESIKNLKMYDKYPAKIQCDPTTVGMAIKENQPVVFTYEVSFVESDIKWPSRWDAYLKMEGAKVHWFSILNSLMVIAFLAGIVLVIFLRTVRRDLTRYEELDKEAQAQMNEELSGWKLVVGDVFRAPSHPQLLCVMVGDGVQILGMAVVTILFAALGFMSPASRGTLITGMLFFYMVLGIVAGYVAVRIWKTIRCGDHSGWVSVSWRVACFFPGIAFLILTMLNFLLWGSHSTGAIPLSLFIVLLLLWFCISVPLTLVGGFLGAKAPHIEYPVRTNQIPREIPPQKYPSWLLVLGAGTLPFGTLFIELFFIMSSIWMGRVYYVFGFLFIVLILLVVVCAEVSLVLTYMHLCVEDWKWWWKAFFSSGSVAIYIFLYSVNYLVFDLKSLSGPVSATLYLGYSLFMVIAIMLATGTIGFISSFWFVHYLFSSVKLD

SEQ ID NO: 8914 - protein, 657 aa, Elaeis guineensis
MGIISRFRLWILLFLLFFLSGEGFYLPGSYPHKYMVGDTLSVKVNSLTSIDTEIPFSYYSLPFCKPQEGIKDSAENLGELLMGDRIENSPYRFKMFTNESDILLCRTGPLSTQDFNLLKKRIDEMYQINLILDNLPAIRYTNKGDYVLRWTGYPVGIRAGDAYYVFNHLKFTVLVHKYEETNVAKVMGTGDASAAIPSLDKSGSGSPGWMVVGFEVVPCSFQHDSESIKNLKMYDKYPAKIQCDSTTVAMSMKEKQPIVFTYEVSFVESDIKWPSRWDAYLKMEGAKVHWFSILNSLMVIAFLAGIVLVIFLRTVRRDLTRYEELDKEAQAQMNEELSGWKLVVADVFRAPSHPQLLCVMVGDGVQILGMAVVTILFAALGFMSPASRGTLITGMLFFYLVLGIAAGYAAVRIWKTIRCGDPSGWASVSWRVACFFPGIAFLILTMLNFLLWGSHSTGAIPISLFIVLLLLWFCISVPLTLVGGLLGAKTPHFEYPVRTNQIPREIPPQKYPSWLLVLGAGTLPFGTLFIELFFIMSSIWMGRVYYVFGFLFIVLILLVVVCAEVSLVLTYMHLCVEDWKWWWKSFFSSGSVAIYIFLYSVNYLVFDLKSLSGPVSATLYLGYSLLMVIAIMLATGTIGFISSFWFVHYLFSSVKLD

SEQ ID NO: 8915 - protein, 659 aa, Musa acuminata
MGFFRRFGLWLLFSSLADLRSGDGFYLPGSYPHEYQVGDALSVKVNSLTSIETEMPFGYYSLPFCRPQEGIKDSAENLGELLMGDRIENSPYRFKMFTNESDVFLCGSNPLSSQDFDLLKKRIDEMYQVNVILDNLPAIRYTKKDDYVLRWTGYPVGVRAGDAYYVFNHLKFTVFVHKYEDANAARVVGSTGDAADVIQTTGKSGSGKPGWMVVGFEVVPCSFLHNAESIKNVKMYDKYPAKIQCDPITVAMKLTQNQPIVFTYEVAFVESDIKWPSRWDAYLKMEGAKVHWFSILNSLMVIAFLAGIVLVILLRTVRRDLTRYEELDKESQAQMNEELSGWKLVVGDVFRAPDHPLLLCVMVGDGVQILGMAIVTILFAALGFMSPASRGTLITGMLFFYLILGIVAGYFAVRIWKTIKCGDHSGWVGVSWRVACFFPGIAFLILTTLNFLLWGSQSTGAIPISLFIVLLLLWFCISVPLTLTGGFLGAKAPHIEYPVRTNQIPREIPPQKYPSWLLVIGAGTLPFGTLFIELFFIMSSLWMGRVYYVFGFLLVVLILLVIVCAEVSLVLTYMHICVEDWKWWWKSFFASGSVALYIFLYSVNYLVFDLKSLSGPVSATLYLGYSLFMVIAIMLATGTVGFISSFWFVHYLFSSVKLD

SEQ ID NO: 8916 - protein, 656 aa, Vitis vinifera
MDLFRQFKIWVLFTCLVFQCGCGFYLPGSYPHKYDIGNTLSVKVNSLTSIDTEMPFSYYSLPFCKPPEGVKDSAENLGELLMGDRIENSPYRFKMYTNETQIFLCKSDPLSADDFKILKKRIDEMYQVNLILDNLPAIRYTKKEGFFLRWTGYPVGIKVQDMYYVFNHLKFTVLVHKYEETNMARVMGTGDAAEGIPTVDRTSNVPGYMVVGFEVVPCSVSHNFDSVKNLKIYDKYPSAINCDPTTVEMAVKEGQPMVFTYDVSFVESDIKWPSRWDAYLKMEGAKVHWFSILNSLMVITFLAGIVLVIFLRTVRRDLTRYEEIDKEAQAQMNEELSGWKLVVADVFRAPDNPALLCIMVGDGVQILGMAVVTILFAALGFMSPASRGTLITGMLFFYMVLGIAAGYVAVRLWRTIGCGDSKGWVSVSWRVACFFPGIAFLILTTLNFLLWGSHSTGAIPFSLFVILLLLWFCISVPLTLVGGYLGAKAPHIEYPVRTNQIPREIPAQKYPSWLLVLGAGTLPFGTLFIELFFIMSSIWMGRVYYVFGFLFIVLILLVVVCAEVSLVLTYMHLCVEDWKWWWKSFFASGSVAIYIFLYSINYLVFDLKSLSGPVSATLYIGYSLFMVFAIMLATGTVGFLSSFWFVHYLFSSVKLD

SEQ ID NO: 8917 - protein, 657 aa, Musa acuminata
MGFFRRLALWILISCLAVRSGDGFYLPGSYPHRYPAGGALPVKVNSLTSIETEMPFSYYSLPFCRPAEGIKDSAENLGELLMGDRIENSPYRFKMFTNESDVFLCRTDPLSAQDFRLLKKRIDEMYQVNLILENLPAIRYTKKDDYVLRWTGYPVGIMIADAYYVFNHLKFTVLVHKYEETNVARVMGTGDAAEAIPTVDKAGSGSPSWMVVGFEVVPCSFQHDADLVKALKMYDKYPVNIQCDPKAVAMRVKENQPIVFTYEVAFVESDIKWPSRWDAYLKMEGAKVHWFSILNSLMVIAFLAGIVLVILLRTVRRDLTRYEELDKEAQAQMNEELSGWKLVVGDVFRAPSHPLLLCVLVGDGVQILGMAIVTILFAALGFMSPASRGTLITGMLFFFLVLGIAAGYVAVRMWKTIKTGDHTGWISVSWRVACFFPGIAFLILTTLNFLLWGSHSTGAIPISLFIILLLLWFCISVPLTLVGGFLGAKAPHIEYPVRTNQIPREIPPQKYPPWLLVLGAGTLPFGTLFIELFFIMSSIWMGRVYYVFGFLFIVMILLVVVCAEVSLVLTYMHLCVEDWKWWWKSFFSSGSVAIYIFLYSVNYLVFDLKNLSGPISASLYLGYSLLMVIAIMLATGTIGFISAFGFVHYLFSSVKLD

SEQ ID NO: 8918 - protein, 655 aa, Aristolochia fimbriata
MGAFDRFGVWVLVAFLVVGSGNGFYLPGSYPHKYQVGDILSVKVNSLTSIDTEMPFTYYSLPFCKPKGGVKDSAENLGELLMGDRIENSPYRFKMNINETEIFLCRTNPLTSDEFKLMTKRIDEMYQVNLILDNLPAIRYTKKDEYFLRWTGYPVGIKVQDLYYIFNHLKFTVLVHKYEEANVARVIGTGDAAELMPTTKGSEVPGYMVVGFEVVPCSSQHDAESVKNLNMYDKYPSAINCDPSTVAMTVKEGQPLVFSYEVSFVESDIKWPSRWDAYLKMEGAKVHWFSILNSLMVIAFLAGIVLVIFLRTVRRDLTRYEELDKEAQAQMNEELSGWKLVVGDVFRAPSNASLLCVMVGDGVQILGMAVVTILFAALGFMSPASRGTLITGMLFVYLVLGILAGYVAVRLWRTIGCGDFTGWVSVSWRVACFFPGIAFLILTVLNFLLWGSQSTGAIPFSLFVILLLLWFCISVPLTLTGGYFGAKAPHIEYPVRTNQIPREIPAQKYPSWLLVLGAGTLPFGTLFIELFFIMSSLWMGRVYYVFGFLFIVMILLVIVCAEVSLVLTYMHLCVEDWKWWWKSFFASGSVAIYIFLYSVNYLVFDLKSLSGPVSATLYLGYSLFMVLAIMLATGTVGFLSSFWFVHYLFSSVKLD

SEQ ID NO: 8919 - protein, 659 aa, Musa acuminata
MGSLRGFGLWLLVSCLAIIRSGDGFYLPGSYPHEYQVGNLLSVKVNSLTSIETELPFTYYSLPFCRPPEGIKDSAENLGELLMGDRIENSPYRFKMFTNESDILLCRTDPLSAKDFNLLKKRIDEMYQVNVILDNLPAIRYTRKGDFLLRWTGYPIGVRAGDAYYLFNHLKFTVLVHKYEETNVARVVGSTGDAADVIQTTDKSGSGKPGWMVVGFEVVPCSFLHNAESAKNLKTYDKYPAKIQCDPTTVAMKLNENQPVVFTYEVAFVESDIKWPSRWDAYLKMEGAKVHWFSILNSLMVIAFLAGIVLVILLRTVRRDLTRYEELDKESQAQMNEELSGWKLVVGDVFRAPSHPLLLCAMVGDGVQILGMAVVTILFAALGFMSPASRGTLITGMLFFYLILGIAAGYVAVRMWKTINVGDHSGWVSVSWRVACFFPGIAFLILTTLNFLLWGSHSTGAIPFSLFVVLLLLWFCISVPLTLAGGFIGAKAPHIEYPVRTNQIPREIPPQKYPSWLLVIGAGTLPFGTLFIELFFIMSSLWMGRVYYVFGFLLIVLILLVVVCAEVSLVLTYMHLCVEDWKWWWKSFFSSGSVALYIFLYSVNYLVFDLKSLSGPVSATLYLGYSLFMVIAIMLATGTVGFISSFCFVHYLFSSVKLD

SEQ ID NO: 8920 - protein, 654 aa, Elaeis guineensis
MASKICATIFFSLLLLPSGHGFYLPGSYPHKYGVGDPLSVKANSLTSIETELPYGYYSLPFCRPQEGIKDMAENLGELLMGDRIENSPYRFKMRTNESDVFLCRSGPLSADDFNLLKKRIDEMYQVNLILDNLPAIRYTNRDGFLLRWTGYPVGIKVADGYYLFNHLKFTVLVHKYEETNVASVMGTGDAAEMIPSKSGKSGPPGYMVVGFEVVPCSFQHDPESVKNAKMYDKYPAKINCDPATVAMAIKENQPVVFSYEVEFVESDIKWPSRWDAYLKMEGAKVHWFSILNSLMVIAFLAGIVLVILLRTVRRDLTRYEELDKEAQAQMNEELSGWKLVVSDVFRAPDNPTLLCVMVGDGLRILGMAVVTILFAALGFMSPASRGALITGMLFFYMVLGILAGYGAVRLWKTLRSGDHSGWVSVSWRVACFFPGIAFLILTILNFLLWGSHSTGAIPFSLFVILLLLWFCISVPLTMVGGFLGAKAPHLEYPVRTNQIPREIPPQRYPSWLLVLGAGTLPFGTLFIELFFIMSSLWMGRVYYVFGFLFIVLILLVVVCAEVSLVLTYMHLCVEDWRWWWKAFFASGSVAIYIFLYSVNYLVFDLKSLSGPVSATLYLGYSLLMVLAIMLATGTVGFISSFWFVHFLFSSVKLD

SEQ ID NO: 8921 - protein, 657 aa, Tripterygium wilfordii
MDPLGRFKIWVLTVLLIVQSGFGFYLPGSYPHKYAVGDTLSVKVNSITSIDTEMPFSYYSLPFCKPEGGIKDSAENLGELLMGDRIENSPYRFKMFTNESEVLLCRTDPLSADNFKILKKRIDDMYQVNLILDNLPAIRYTKKDGYVLRWTGYPVGIKVQDLYYVFNHLKFTVLVHKYEETNVARVMGTGDGAEMIPANRDGDSGKPGYMVVGFEVVPCSFKHNSDSVKKSKMYEKYPSKIQCDPTTVAMPIKENEPIVFTYEVTFEESDIKWPSRWDAYLKMEGSKVHWFSILNSLMVITFLAGIVLVIFLRTVRRDLTRYEELDKEAQAQMNEELSGWKLVVGDVFRAPSSPALLCVMVGDGVQILGMGVVTILFAALGFMSPASRGTLITGMLFFYLVLGIAAGYVAVRLWRTIGCGDHKGWVSVAWKAACFFPGIAFLILTVLNFLLWGSHSTGAIPFSLFVILLLLWFCISVPLTLVGGYFGAKAPHIEYPVRTNQIPREIPAQKYPSWLLVLGAGTLPFGTLFIELFFIMSSLWMGRVYYVFGFLFIVMILLVVVCAEVSLVLTYMHLCVEDWKWWWKSFFASGSVAIYIFLYSVNYLIFDLKSLSGPVSATLYLGYSLLMVLAVMVSTGTVGFLSSFWFVHYLFSSVKLD

SEQ ID NO: 8922 - protein, 654 aa, Theobroma cacao
MGNFGIWVLTICLLFQSGYGFYLPGSYPHKYVVGDYLSVKVNSLTSIDTEMPFSYYSLPFCKPTEGVKDSAENLGELLMGDRIENSPYRFKMYTNETEIFLCQSNKLSADDFKLLKKRIDEMYQVNLILDNLPAIRYTRKEGFMLRWTGYPVGVKVQDVYYVFNHLKFKVLVHKYEETNVARVMGTGDAAEVIPTVGNGGSDAPGYMVVGFEVVPCSVLHNGNSVKNLNMYEKYPSPIKCESTTVSMPIKEGEPIVFTYEVVFEESDIKWPSRWDAYLKMEGSKVHWFSILNSLMVITFLAGIVLVIFLRTVRRDLTRYEELDKEAQAQMNEELSGWKLVVGDVFRAPSNPALLCIMVGDGVQILGMAVVTILFAALGFMSPASRGTLITGMLFFYMILGIVAGYVAVRLWRTIGCGDHKGWVSVAWKAACFFPGIAFLILTTLNFLLWGSHSTGAIPFSLFVILLLLWFCISVPLTLVGGYFGAKAPHIEYPVRTNQIPREIPAQKYPSWLLVLGAGTLPFGTLFIELFFIMSSIWMGRVYYVFGFLFIVLVLLVVVCAEVSLVLTYMHLCVEDWKWWWKSFFASGSVAIYIFLYSINYLIFDLKSLSGPVSATLYLGYSLFMVLAIMIATGTIGFLSSFWFVHYLFSSVKLD

SEQ ID NO: 8923 - protein, 657 aa, Ricinus communis
MESFACFKIWVLTIFLIFQSGYGFYLPGSYPHKYNVGETLSVKVNSITSIDTEMPFSYYSLPFCKPAEGVKDSAENLGELLMGDRIENSPYRFRMHVNESEVFLCKTDPLSADSFKLLKKRIDEMYQVNLILDNLPAIRYTKKESYLLRWTGFPVGIKVQDAYYVFNHLRFTVLVHKYEEANVARVMGTGDGAEVIPTIGNGGSDIPGYMVVGFEVVPCNVMHNVQSVKNTKMYEKYPAQIKCDPTTVSMPIKENEPIVFTYEVNFEESDIKWPSRWDAYLKMEGSKVHWFSIMNSLMVITFLAGIVLVIFLRTVRRDLTRYEELDKEAQAQMNEELSGWKLVVGDVFRAPANPSLLCVMVGDGVQILGMAIVTIMFAALGFMSPASRGTLITGMLIFYMILGIAAGYVAVRLWRTIGCGDHKGWVSVSWKAACFFPGIAFLILTILNFLLWGSQSTGAIPFSLFVILILLWFCISVPLTLIGGYFGAKAPHIEYPVRTNQIPREIPAQKYPSWLLVLGAGTLPFGTLFIELFFIMSSIWMGRVYYVFGFLLIVFILLVVVCAEVSLVLTYMHLCVEDWKWWWKSFFASGSVAIYIFLYSINYLVFDLKSLSGPVSATLYLGYSLLMVLAIMFATGTVGFLSSFWFVHYLFSSVKLD

SEQ ID NO: 8924 - protein, 657 aa, Eucalyptus grandis
MDFFDRFKIWVLAVSLVLNCGCGYYLPGSYPHKYSVGDTLSVKVNSLTSIDTEIPYSYYSLPFCQPLEGVKDSAENLGELLMGDRIENSPYQFKMYTNESEIFSCRTDPLTADSFKLLKERIDEIYQVNLILDNLPAIRYTKKEEFFLRWTGYPVGIKVQDTYYVFNHLKFTVLVHKYEETNVARVMGTGDAAEMIPTIGNDGSDVQGYMVVGFEVVPCSVMHNADSVKNLKMYEKYPSSIKCDPTTVSMAIKEGQPIVFTYEVAFEESDIKWPSRWDAYLKMEGSKVHWFSILNSLMVITFLAGIVLVIFLRTVRRDLTRYEELDKEAQAQMNEELSGWKLVVGDVFRTPSNPALLCIMVGDGVQILGMAVVTILFAALGFMSPASRGTLITGMLFFYMILGVVAGYVAVRLWRTIGSGDHKGWVSVAWKAACFFPGIAFLILTVLNFLLWGSHSTGAIPFSLFVILLLLWFCISVPLTLFGGYLGAKAPQIEYPVRTNQIPREIPPQKYPSWLLVLGAGTLPFGTLFIELFFIMSSLWMGRVYYVFGFLFVVLILLVVVCAEVSLVLTYMHLCVEDWKWWWKSFFASGSVAIYIFLYSVNYLVFDLKSLSGPVSATLYLGYSLFMVTAIMLTTGTVGFLSSFWFVHYLFSSVKLD

SEQ ID NO: 8925 - protein, 657 aa, Euonymus alatus
MDPLGRFKIWVLTVFLIVQSGFGFYLPGSYPHKHVVGDTLSVKVNSITSIDTEMPFSYYSLPFCEPEGGVKDSAENLGELLMGDRIENSPYRFKMYTNESEVLLCRTDPLSTDNFKILKKRIDEMYQVNLILDNLPAIRYTGKDGYSLRWTGYPVGIKVQGLYYVFNHLKFTVLVHKYEETNVARVMGTGDGAEMIPTVGDGDSGKPGYMVVGFKVIPCSFKHNTDSVKKSKMYEKYPSKIQCDPTTVAMPIKENEPIVFTYEVTFKESDIKWPSRWDAYLKMEGSKVHWFSILNSLMVITFLAGIVLVIFLRTVRRDLTRYEELDKEAQAQMNEELSGWKLVVGDVFRAPSSPALLCVMVGDGVQILGMAIVTILFAALGFMSPASRGTLITGMLFFYMVLGLAAGYVAVRLWRTIGFGDHKGWVSVAWKAACFFPGIAFLILTVLNFLLWGSQSTGAIPFSLFVILLLLWFCISVPLTLVGGYFGAKAPHIEFPVRTNQIPREIPAQKYPSWLLVLGAGTLPFGTLFIELFFIMSSLWMGRVYYVFGFLFIVMILLVVVCAEVSLVLTYMHLCVEDWKWWWKSFFASGSVAIYIFLYSVNYLIFDLKSLSGPVSATLYLGYSLLMVLAIMVSTGTVGFLSSFWFVHYLFSSVKLD

SEQ ID NO: 8926 - protein, 218 aa, Catharanthus roseus
MHVIWSGFWFTSGSYPHKYGIGDFLNVKVNSLTSIDTELPFSYYSLPFCPPKEGIKDSAENLGELLMGDRIENSPYRFKMYTNESDVFLCQTKPLSGEEFKLFKKRIDEIYQVNLILDNLPAIRYTRKEGYFLRWTGYPIGIKVKDVYYVFNHLKFTVLIHKYEETNVARVMGTGDAAEVIPTVGNDGSEAPGYMVVGFEVVPCSVQHNADSVKNLKI

SEQ ID NO: 8927 - protein, 657 aa, Fagus grandifolia
MGFFNQFRIWVLTICLVFQSGYGFYLPGSYPHKYVVGDLLSVKVNSLTSIDTEMPFSYYSLPFCKPDEGVKDSAENLGELLMGDRIENSPYQFKMYTNESDIFLCKSDPLSADSFKILTKRIDEMYQVNLILDNLPAIRYTKKEGYVLRWTGYPVGVKLQDVYYIFNHLKFNVLIHKYEDANVARVMGTGDAAEVIPSVGKGDSDEPGYMVVGFEVVPCSVVHTVDSVKNVKKYGKYPNPLKCDPNTVSMPIKQGQPIVFTYEVTFEVSDIKWPSRWDAYLKMEGSKVHWFSILNSLMVITFLAGIVLVIFLRTVRRDLTRYEELDKEAQAQMNEELSGWKLVVGDVFRAPNNPALLCIMVGDGVQILGMAVVTILFAALGFMSPASRGTLITGMLFFYMILGIAAGYVAVRLWRTIGCGDPKGWVSVSWKAACFFPGIAFLILTTLNFLLWGSHSTGAIPFSLFVILLLLWFCISVPLTLVGGYLGAKAPHIEYPVRTNQIPREIPAQKYPSWLLVLGAGTLPFGTLFIELFFIMSSIWMGRVYYVFGFLFIVLILLVVVCAEVSLVLTYMHLCVEDWKWWWKSFFASGSVAIYIFLYSVNYLVFDLKSLSGPVSATLYLGYSLFMVVAIMLATGTVGFLSSFWFVHYLFSSVKLD

SEQ ID NO: 8928 - protein, 664 aa, Amorphophallus konjac
MGSSHGTGIWFLLPLLLLLLLGDAGVHVHGFYLPGSYPHKYEVGDALSVKVNSLTSIDTEMPFSYYSLPFCHPPEGVRDSAENLGELLMGDRIETSPYRFRMYTNESDILLCRTGPLSAADLALLRERIDQMYQVNLILDNLPAIRYTRKDDFVLRWTGYPVGIRIQDVYYLFNHLKFRVLVHKYEETNVARVMGTGDAAEVIPAVAGSADGPPGYMVVGFEVVPCSFQHDSEAAKNLKMYDKYPSKIQCEPTTVAMAVKENQPLVFSYEVEFVESDIKWPSRWDAYLKMEGARVHWFSILNSLMVIAFLAGIVLVILLRTVRRDLTRYEELDKEAQAQMNEELSGWKLVVGDVFRAPGNPVLLCVMVGDGVQILGMAVVTILFAALGFMSPASRGALVTGMLFFYLVLGIAAGYSSVRLWKTIRVGDHSGWMSVSWRVACFFPGIAFLILTTLNFLLWGSHSTGAIPLSLFVILLLLWFCISVPLTLVGGYLGAKAPHIEYPVRTNQIPREIPAQRYPSWLLVVGAGTLPFGTLFIELFFIMSSLWMGRVYYVFGFLFIVMVLLVVVCAEVSLVLTYMHLCVEDWKWWWKSFFSSGSVALYIFLYSVNYLVFDLKSLSGPVSATLYLGYSLFMVLAIMLATGTVGFLSSFWFVHYLFSSVKLD

SEQ ID NO: 8929 - protein, 657 aa, Manihot esculenta
MDYFSHLKIWILALSMIFQSVYGFYLPGSYPHKYNVGESLSVKVNSITSIDTEMPFSYYSLPFCQPAEGIKDSAENLGELLMGDRIENSPYRFKMHVNESEIFLCRTDPLSADNFKLLKERIDEMYQVNLILDNLPAIRYTKKDAYLLRWTGYPIGIKVQDAYYVFNHLKFTVLVHKYEEANMARVMGTGDGAEVIPTIGNGGSDIPGYMVVGFEVVPCNFMHNVQSVKNSKMYDKYPSPIKCDPTTVSMPIKENEPIVFTYEVTFEESDIKWPSRWDAYLKMEGSKVHWFSIMNSLMVITFLAGIVLVIFLRTVRRDLTRYEELDKEAQAQMNEELSGWKLVVGDVFRAPTNASLLCVMVGDGVQILGMAVVTILFAALGFMSPASRGTLITGMLLFYMILGIAAGYVAVRLWRTIGCGDHKGWMSVSWRSACFFPGIAFFILTMLNFLLWGSHSTGAIPISLFIILILLWFCISVPLTLIGGYFGAKAPHIEYPVRTNQIPREIPAQKYPSWLLVLGAGTLPFGTLFIELFFIMSSIWMGRVYYVFGFLLIVFILLVVVCAEVSLVLTYMHLCVEDWKWWWKSFFASGSVAIYIFLYSINYLVFDLKSLSGPVSATLYLGYSLLMVLAIMFATGTVGFLSSFWFVHYLFSSVKLD

SEQ ID NO: 8930 - protein, 657 aa, Plantago ovata
MDHRCMIWIVVVSLAAVFGVGNGFYLPGSYPHKYGVGEFLNVKVNSLTSIDTEMPFSYYSLPFCQPKEGVKDSAENLGELLMGDRIENSPYRFKMYTNESEVFLCQTKPLNAGEFKLLKERIDEMYQVNVILDNLPAIRYTNKEGFVMRWTGYPVGAKVADGYYIFNHLKFTVLVHKYEETNVARVMGTGDAAEVIPTIGNSGSDAPGYMVVGFEVVACSYQHNTDAIKNLKMYEKYPSPIKCDPGTVAMAVKENEPIAFSYEVVFEERDIKWPSRWDAYLKMEGAKVHWFSILNSLMVITFLAGIVLVIFLRTVRRDLTRYEEIDKEAQAQMNEELSGWKLVVGDVFRAPSNPALLCVMVGDGVQILGMAVVTILFAALGFMSPASRGTLITGMLFFYMILGIAAGYVAVRMWRTIFVGDNKGWISVSWKVACFFPGISFLILTTLNFLLWGSHSTGAIPFSLFVVLILLWFCISVPLTLVGGYFGAKAPHIEYPVRTNQIPREIPPQKYPSWLLVLGAGTLPFGTLFIELFFIMSSIWMGRVYYVFGFLFVVLILLVVVCAEVSLVLTYMHLCVEDWKWWWKSFFASGSVAIYIFLYSINYLIFDLKSLSGPVSATLYLGYSLFMVLAIMLATGTVGFLSSFWFVHYLFSSVKLD

SEQ ID NO: 8931 - protein, 657 aa, Vinca minor
MESFRKFKICVLFICMLFEVGFGFYLPGSYPKKYGIGDPLNVKVNSLTSIDTELPFSYYSLPFCQPDEGIKDSAENLGELLMGDRIENSPYRFKMYTNESDIFLCQTKPLSGEEFKLFKKRIDEIYQVNLILDNLPAIRYTRKEGYFLRWTGYPIGIKVQDLYYVFNHLKFTVLIHKYEETNVARVMGTGDAAEVIPTVPNGGSEAPGYMVVGFEVVPCSVQHNADSVKKIKMYEKYPSPIKCDPSMVAMAIKENEPVSFSYEVSFVESDIKWPSRWDAYLKMEGAKVHWFSILNSLMVITFLAGIVFVIFLRTVKRDLTRYEELDKEAQAQMNEELSGWKLVVADVFRAPSNPALLCVMVGDGIQILGMAVVTILFAALGFMSPASRGTLITGMLFFYMILGIAAGYVAVRMWRTIFVGDHKGWVSVSWKVACFFPGIAFLILTTLNFLLWGSHSTGAIPFSLFVILILLWFCISVPLTLVGGYFGAKAPHIEYPVRTNQIPREIPPQKYPSWLLVLGAGTLPFGTLFIELFFIMSSLWMGRVYYVFGFLLIVLILLVVVCAEVSLVLTYMHLCVEDWKWWWKSFFASGSVAIYIFLYSVNYLIFDLKSLSGPVSATLYLGYSLFMVIAIMLATGAVGFLSSFWFVHYLFSSVKLD

SEQ ID NO: 8932 - protein, 657 aa, Euphorbia peplus
MESMAQSKIWVLFVCLIFQLGHGFYLPGSYPHKYNVGESLSVKVNSITSIDTEMPFSYYSLPFCKPKEGVKDSAENLGELLMGDRIENSPYKFKMHVNESEIFLCKSDPLSADSYKLLKKRIDEMYQVNLILDNLPAIRYTKKDSYLLRWTGYPVGIKVQDAYYVFNHLKLTVLVHKYEEANVARVMGTGDGAEVIPSMGNGGSDIPGYMVVGFEVVPCNFMHNVQSVKDTKMYEKYPSQIKCDPTTVAMPIKENEPIVFTYEVTFEESEIKWPSRWDAYLKMEGSKVHWFSIMNSLMVITFLAGIVLVIFLRTVRRDLTRYEELDKEAQAQMNEELSGWKLVVGDVFRAPTNASLLCVMVGDGVQILGMAIVTIFFAALGFMSPASRGTLITGMLIFYMILGVAAGYVAVRLWRTIGCGDHKGWVSVSWRAACFFPGIAFFILTLLNFLLWSSHSTGAIPISLFIVLILLWFCISVPLTLIGGYFGAKAPHIEYPVRTNQIPREIPAQKYPSWLLVLGAGTLPFGTLFIELFFIMSSIWMGRVYYVFGFLLIVFILLVVVCAEVSLVLTYMHLCVEDWKWWWKSFFASGSVAIYIFLYSINYLIFDLKSLSGPVSATLYLGYSLLMVLAIMFATGTVGFISSFWFVHYLFSSVKLD

SEQ ID NO: 8933 - protein, 576 aa, Tropaeolum majus
MGDRIENSPYRFKMYKNESEIFLCRTPALSADNFKLLKKRIDEMYQVNLILDNLPAIRYTVKESYNLRWTGYPVGIKVQDVYYLFNHLKFKVLVHKYEETNVASVMGTGDAAEVIPAVPKGEPEVPGYMVVGFEVIPCSFMHNSETVKKLKMYGKYTSPIRCDPTTVSMPIKEGQPMVFTYEVLFEESDIKWPSRWDAYLKMEGSKVHWFSILNSLMVITFLAGIVLVIFLRTIRRDLTRYEELDKEAQAQMNEELSGWKLVVGDAFRAPSNPSLLCVMVGNGIQILGMAVVTILFAALGFMSPASRGTLITGMLFFFMILGIAAGYVAVRIWKTIHLGDHKGWVSVSWKVACFFPGIAFSILTTLNFLLWGSHSTGAIPISLFVILLLLWFCISVPLTLIGGYLGAKAPHIEYPVRTNQIPREIPAQKYPSWLLVLGAGTLPFGTLFIELFFIMSSIWMGRVYYVFGFLLVVMILLVVVCAEVSLVLTYMHLCVEDWKWWWKSFFASGSVAIYIFLYSINYLVFDLKSLSGPVSATLYLGYSLLMVFAIMLATGTVGFLSSFWFVHYLFSSVKLD

SEQ ID NO: 8934 - protein, 425 aa, Vinca minor
MYEKYPSPIKCDPSMVAMSIKENEPVSFSYEVSFVESDIKWPSRWDAYLKMEGAKVHWFSILNSLMVITFLAGIVFVIFLRTVKRDLTRYEELDKEAQAQMNEELSGWKLVVADVFRAPSNPALLCVMVGDGMQILGMAIVTILFAALGFMSPASRGTLITGMLFFYMILGIAAGYVAVRMWRTIFVGDHKGWVSVSWKVACFFPGIGFLILTTLNFLLWGSHSTGAIPFSLFVILILLWFCISVPLTLVGGYFGAKAPHIEYPVRTNQIPREIPPQKYPSWLLVLGAGTLPFGTLFIELFFIMSSLWMGRVYYVFGFLLIVLILLVVVCAEVSLVLTYMHLCVEDWKWWWKSFFASGSVAIYIFLYSVNYLIFDLKSLSGPVSATLYLGYSLFMVIAIMLATGAVGFLSSFWFVHYLFSSVKLD

SEQ ID NO: 8935 - protein, 657 aa, Tabernaemontana elegans
MESFRKFKIWVLFFCMISGVGFGFYLPGSYPHKYGVGDFLSVKVNSLTSIDTEIPFGYYSLPFCQPSEGIRDSAENLGELLMGDRIENSPYRFKMYTNESDIFLCKTKPLSGEEFKLFKKRIDEIYQVNLILDNLPAIRYTRKEGYFLRWTGYPIGIKVQDAYYVFNHLKFTVLIHKYEETNVARVMGTGDAAEVIPTVGNAGSEAPGYMVVGFEVVPCSVPHNADSVKNLKIYDKYPSPIKCDPSMVSMAIKENEPISFSYEVSFVESDIKWPSRWDAYLKMEGAKVHWFSILNSLMVITFLAGIVFVIFLRTVKRDLTRYEELDKEAQAQMNEELSGWKLVVGDVFRAPSYPSLLCVMVGDGIQILGMAVVTILFAALGFMSPASRGTLITGMLFFYMILGIAAGYVAVRMWRTIFCGDHKGWVSVSWRVACFFPGVAFLILIILNFLLWGSHSTGAIPFSLFVILILLWFCISVPLTLVGGYFGAKAPHIEYPVRTNQIPREIPPQKYPSWLLVLGAGTLPFGTLFIELFFIMSSLWMGRVYYVFGFLLIVLILLVVVCAEVSLVLTYMHLCVEDWKWWWKSFFASGSVAIYIFLYSVNYLIFDLKSLSGPVSATLYLGYSLFMVLAIMLATGAVGFLSSFWFVHYLFSSVKLD

SEQ ID NO: 8936 - protein, 656 aa, Cannabis sativa
MEFFDRFRIWVLVICLIFNLGHGFYLPGSYPHKYVDGDYLNVKVNSLTSIDTEMPFSYYSLPFCKPPEGVKDSAENLGELLMGDRIENSPYKFKMYKNESDIFLCKSDALSPDHFKILTKRIDEMYQVNLILDNLPAIRYTQKEGYTLRWTGYPVGVKVKDSYYIFNHLKFKVLVHEYEDANMARVMGTGDAAEVIPTIAKGDEVPGYMVVGFEVIPCSIMHNADSVKNLKIYEKYPSPIKCDPTSVSVPVKEGQPIVFTYEVEFEKSDIKWPSRWDAYLKMEGSKVHWFSILNSLMVITFLAGIVLVILLRTVRRDLTRYEELDKEAQAQMNEELSGWKLVVGDVFRAPSHPALLCIMVGDGVQILGMAVVTILFAALGFMSPASRGTLITGMLFFYMILGIVAGYVAVRLWRTIGCGDSKGWVSVSWRAACFFPGIAFLILTTLNFLLWGSHSTGAIPFSLFVILLLLWFCISVPLTLVGGYFGAKAPHIEFPVRTNQIPREIPPQKYPSWLLVLGAGTLPFGTLFIELFFIMSSIWMGRVYYVFGFLFIVMILLVVVCAEVSLVLTYMHLCVEDWKWWWKSFFASGSVAIYIFLYSVNYLIFDLKSLSGPVSATLYLGYSLFMVLAIMLATGTVGFLSSFWFVHYLFSSVKLD

SEQ ID NO: 8937 - protein, 657 aa, Tropaeolum majus
MDLGSGFRIGSLIICLLFQFGYGFYLPGSYPHKYGVGDYLSVKVNSLTSIDTEMPFSYYSLPFCTPPEGIKDSAENLGELLMGDRIENSPYRFKMYKNESEIFLCRTPALSADNFKLLKKRIDEMYQVNLILDNLPAIRYTVKESYNLRWTGYPVGIKVQDVYYLFNHLKFKVLVHKYEETNVASVMGTGDAAEVIPAVPKGEPEVPGYMVVGFEVIPCSFMHNSETVKKLKMYGKYTSPIRCDPTTVSMPIKEGQPMVFTYEVLFEESDIKWPSRWDAYLKMEGSKVHWFSILNSLMVITFLAGIVLVIFLRTIRRDLTRYEELDKEAQAQMNEELSGWKLVVGDAFRAPSNPSLLCVMVGNGIQILGMAVVTILFAALGFMSPASRGTLITGMLFFFMILGIAAGYVAVRIWKTIHLGDHKGWVSVSWKVACFFPGIAFSILTTLNFLLWGSHSTGAIPISLFVILLLLWFCISVPLTLIGGYLGAKAPHIEYPVRTNQIPREIPAQKYPSWLLVLGAGTLPFGTLFIELFFIMSSIWMGRVYYVFGFLLVVMILLVVVCAEVSLVLTYMHLCVEDWKWWWKSFFASGSVAIYIFLYSINYLVFDLKSLSGPVSATLYLGYSLLMVFAIMLATGTVGFLSSFWFVHYLFSSVKLD

SEQ ID NO: 8938 - protein, 658 aa, Aquilegia formosa
MGFLDQFKIWVLIISCLFLQSGNGFYLPGSYPHKYEHGDSLFVKVNSLTSIDTEIPYSYYSLPFCKPLEGIKDSAENLGELLMGDRIENSPYKFKMYTNESDLFLCRSDPLTADDFKMLTKRIDEMYQVNLILENLPAIRYTKKEGYYLRWTGYPVGIKVQDVYYVFNHLKFKVLVHKYEEPNVARVMGTGDVPDVIPNKVKGGSDVPGYMVVGFEVVPCSFQHDPNSVKNMKMYENYQAGIKCDPTTVAMAVKEGQPLVFTYEVSFEESDIKWPSRWDAYLKMEGAKVHWFSILNSVMVITFLAGIVLVIFLRTVRRDLTRYEELDKEAQAQMNEELSGWKLVVGDVFRAPTNAKLLCIMVGNGVQILGMAVVTILFAALGFMSPASRGTLITGMLFIYLVLGIAAGYVAVRMWRTICCGVITGWVSVSWRAACFFPGIAFLILTVLNFLLWGSHSTGAIPFSLFVVLLLLWFCISVPLTLIGGYLGAKAPHIEYPVRTNQIPREVPAQKYPSWLLVLGAGTLPFGTLFIELFFIMSSIWMGRVYYVFGFTFIVLILLVVVCAEVSLVLTYMHLCVEDWRWWWKSFFASGSVAIYIFLYSINYLVFDLKNLSGPVSATLYLGYSLFMVLAIMLATGTVGFLSSFWFVHYLFSSVKLD

SEQ ID NO: 8939 - protein, 658 aa, Silene vulgaris
MGSLSNLGIWVIVICMIFETGIGFYLPGSYPHKYKVGDVLSVKVNSLTSIDTEIPFSYYSLPFCKPEEGVKDSAENLGELLMGDRIENSPYRFKMYQNESEIVLCKTNALSPDEFKLLKTRIDEMYQVNLILDNLPAIRYTKKDNFFLRWTGYPVGIKVQDAYYLFNHLKLTVLVHKYEEASVARVMGTGDAVEMVPGGNGVGGSDEPGYMVVGFEVVPCSVQHDMNAIKDLKMYGKYPGKINCDPTTVSMAVKENEPVAFSYEVSFVESDIKWPSRWDAYLKMEGAKVHWFSILNSLMVITFLAGIVLVIFLRTVRRDLTRYEELDKEAQAQMNEELSGWKLVVGDVFRAPSHPVLLCVMVGDGVQLLGMGVVTIMFAALGFMSPASRGTLLTGMVFFYMILGIAAGYVGVRLWRTIGCGDHKGWVSVSWKAACFFPGIAFLILTVLNFLLWGSHSTGAIPFSLYVVLILLWFCISVPLTLIGGYFGAKAPHIEYPVRTNQIPREIPPQKYPSWLLVLGAGTLPFGTLFIELFFIMSSLWMGRVYYVFGFLFVVLILLVVVCAEVSLVLTYMHLCVEDWKWWWKSFFASGSVAIYIFLYSINYLIFDLKSLSGPVSATLYLGYSLFMVLAIMLVTGTVGFLSSFWFVHYLFSSVKLD

SEQ ID NO: 8940 - protein, 657 aa, Solanum phureja
MRSFEKFKIWVLLICLVFELGYGFYLPGSYPHKYEVGDLLNVKVNSLTSIDTELPYSYYSLPFCQPQEGVKDSAENLGELLMGDRIENSPYRFKMHSNETEIFMCQTKPLSGEEFKLLKKRIDEMYQVNLILDNLPAIRYTRKAGYFLRWTGYPVGIKVQDAYYVFNHLKFTVLVHKYEETNVARVMGTGDGAEVISTVGKDGSEEPGYMVVGFEVVPCSVQHAPDSAKNLKMYNKYPTPIKCDPTTVAMAIKENEPVSFTYEVNFVESDIKWPSRWDAYLKMEGAKVHWFSILNSLMVITFLAGIVLVIFLRTVRRDLTRYEELDKEAQAQMNEELSGWKLVVSDVFRAPSNPGLLCAMVGDGVQILGMGVVTIMFAALGFMSPASRGTLITGMLFFYMILGVAAGYVAVRLWRTIFCGDHKGWISVSWKAACFFPGIAFLILTTLNFLLWGSHSTGAIPFSLFVVLILLWFCISVPLTLVGGYLGAKAPHIEYPVRTNQIPREIPPQKYPSWLLVLGAGTLPFGTLFIELFFIMSSLWMGRVYYVFGFLLIVMILLVIVCAEVSLVLTYMHLCVEDWKWWWKSFFASGSVAIYIFLYSVNYLIFDLKSLSGPVSATLYLGYSLFMVLAIMLATGTVGFLSSFWFVHFLFSSVKLD

SEQ ID NO: 8941 - protein, 666 aa, Eucalyptus grandis
MDFFDRFKIWVLAVSLVVNCGCGYYLPGSYPHKYSVGDTLSVKVNSLTSIDTEIPYSYYSLPFCQPLEGVKDSAENLGELLMGDRIENSPYQFKMYTNESEIFSCRTDPLTADSFKLLKERIDEIYQVNLILDNLPAIRYTKKEEFFLRWTGYPVGIKVQDTYYVFNHLKFTVLVHKYEETNVARVMGTGDAAEMIPTIGNDGSDVQGYMVVGFEVVPCSVMHNADSVKNLKMYEKYPSSIKCDPTTVSMAIKEGQPIVFTYEVAFEESDIKWPSRWDAYLKMEGSKVHWFSILNSLMVITFLAGIVLVIFLRTVRRDLTRYEELDKEAQAQMNEELSGWKLVVGDVFRTPSNPALLCIMVGDGVQILGMAVVTILFAALGFMSPASRGTLITGMLFFYMILGVVAGYVAVRLWRTIGSGDHKGWVSVAWKAACFFPGIAFLILTVLNFLLWGSHSTGAIPFSLFVILLLLWFCISVPLTLFGGYLGAKAPQIEYPVRTNQIPREIPPQKYPSWLLVLGAGTLPFGTLFIELFFIMSSLWMGRVYYVFGFLFVVLILLVVVCAEVSLVLTYMHLCVEDWKWWWKSFFASGSVAIYIFLYSVNYLVFDLKSLSGPVSATLYLGYSLFMVTAIMLTTGTVGFLSSFWFVHYLFSSILYYLLSLSFYFC

SEQ ID NO: 8942 - protein, 654 aa, Unknown
  Sequence found in Organisms: Gossypium hirsutum, Gossypium raimondii
MASFGIWVLTIFLVFQSGYGFYLPGSYPHKYKVGDPLSVKVNSLTSIDTEMPFSYYSLPFCKPAEGVKDSAENLGELLMGDRIENSPYRFKMYTNETLIFLCQSGKLSADEFKLLKERIDEMYQVNLILDNLPAIRYTVKEGFVSRWTGYPIGVKFQDMYYVFNHLKFKVLVHKYEETNVARVMGTGDAVDVFPSGGKGGSDVPGYMVVGFEVIPCSVMHNGNVVKDLKMYDKYPSEIKCDTTTVTVPIKEGEPIVFTYEVAFEESDIKWPSRWDAYLKMEGSKVHWFSILNSLMVITFLAGIVLVIFLRTVRRDLTRYEELDKEAQAQMNEELSGWKLVVGDVFRAPSHPALLCIMVGDGVQILGMGVVTILFAALGFMSPASRGTLITGMLFFYMILGIAAGYVAVRLWRTIGCGDHKGWASVAWKAACFFPGIAFLILTILNFLLWGSHSTGAIPFSLFVILLLLWFCISVPLTLVGGYFGAKAPHIEYPVRTNQIPREIPAQKYPSWLLVLGAGTLPFGTLFIELFFIMSSIWMGRVYYVFGFLLIVMVLLVVVCAEVSLVLTYMHLCVEDWKWWWKSFFASGSVAIYIFLYSVNYLIFDLKSLSGPVSATLYLGYSLFMVLAIMLATGTIGFLSSFWFVHYLFSSVKLD

SEQ ID NO: 8943 - protein, 657 aa, Prunus persica
MEFSHRLTTWVLTIFLIFQSGYGWYLPGSYPHKYVVGDTLGVKVNSLTSIDTEIPFSYYSLPFCQPQDGVKDSAENLGELLMGDRIENSPYQFKMYTNESEIFLCHTGPLSGDQFNLLKKRIDEMYQVNLILDNLPAIRYTKKEGFVLRWTGYPVGIKVKDVYYVFNHLKFKVLVHKYEEPNVARVMGTGDGAEVIPTVAKSDSDVPGYIIVGFEVIPCSFMHNADSVKKSKMYEKYPAPIKCDPTTVAMPVNEKQPIVFTYEVEFEESDIKWPSRWDAYLKMEGSKVHWFSILNSLMVITFLAGIVLVIFLRTVRRDLTRYEELDKEAQAQMNEELSGWKLVVGDVFRAPSNASLLCIMVGDGVQILGMAVVTILFAALGFMSPASRGTLITGMLFFYMILGIAAGYVAVRLWRTIGCGDHKGWVSVSWKVACFFPGIAFLILTTLNFLLWGSHSTGAIPFSLFVILLLLWFCISVPLTLIGGYLGAKAPHIEYPVRTNQIPREIPAQKYPSWLLVLGAGTLPFGTLFIELFFIMSSIWMGRVYYVFGFLFIVLILLVVVCAEVSLVLTYMHLCVEDWKWWWKSFFASGSVAIYIFLYSINYLVFDLKSLSGPVSATLYLGYSLFMVVAIMLATGTVGFLSSFWFVHYLFSSVKLD

SEQ ID NO: 8944 - protein, 273 aa, Sorghum bicolor
MAMRAAPAAATGFFSPSSVSPRRFSSATPPASLSTGRCIQRHRLRAFPSSEIPLEELNPSVDLLRKTAEAVGDFRKTPIYIVGTDCTAKRNIAKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQRYDELKERYGVSDITVSVQSVASQRGYSSVDSVTLEDMVLEIVRQIEKLIRAKEMMEAAGRPF

SEQ ID NO: 8945 - protein, 273 aa, Saccharum officinarum
MAMRAATAAATGFFSPSSVSPRRFSSATPPASLSIGRCIQRHRLRAFPSSEIPLEELNPSVDLLRKTGEAVGDFRKTPIYIVGTDCTAKRNIAKLLANSIIYRYLCSEELLEDVLGGKDALRAFKESDEKAYLEVETEGLKQLTSMGSLVLCCGDGAVMNSTNLGLLRHGVSIWIDVPLEMAANDMLKSTGTQATTDPDSFSQAMSKLRQRYDELKERYGVSDITVSVQSVASQRGYSSVDLVTLEDMVLEIVRQIEKLIRAKEMMEAAGRPF

SEQ ID NO: 8946 - protein, 274 aa, Panicum virgatum
MAMRAATAAATGFFSSPSSVSPRRFSSSSPPASLSAGRCIRRHRLRAFPSSELPLEELNPSVDLLRKTAEAVGDFRKTPIYIVGTDCTAKRNIGKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDELKERYGISDITVSVQKVASQLGYSSVDSVTLEDMVLEIVRQIERLIRAKAMMEAAGKPF

SEQ ID NO: 8947 - protein, 274 aa, Setaria italica
MAMRAAPAAATGFFSSPSTVSPRRFSFATPPASLSAGRRIRLHRLRAFPSSELPLEELNPSVDLLRKTAEAVGDFRKTPIYIVGTDCTAKRNIGKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQHDDLKERYGISDITVSVQNVASQLGYSSVDSVTLEDMVLEIVRQIERLIRTKAMMEAAGKPF

SEQ ID NO: 8948 - protein, 274 aa, Panicum virgatum
MAMRAATAAATGFFSSPSSVSPRRFSSSSPPASLSAGRCIRRHRLRAFPSSELPLEELNPSVDLLRKTAEAVGDFRKTPIYIVGTDCTAKRNIGKLLANSIIYRYLCSEELLVDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDDLKERYGISDITVSVQKVASQLGYSSVDSVTLEDMVLEIVKQIERLIRTKAMMEAAGKPF

SEQ ID NO: 8949 - protein, 270 aa, Cynodon dactylon
MAMRAAAATFFSSSHVSPRPFFSATPPAPSFAGRSVHCRRLRAFPATELTLEELNPSVELLRKTAEAVGDFRKTPIYIVGTDCTAKRNISKLLANTIIYRYLCSEELLEDVLGGKDALRAFKESDEKGYLEVETEGLKQLTSMGSLVLCCGDGAVMNSTNLGLLRHGVSIWIDVPLEMAVNDMLKSMGTEASSDPDSFSQAMGKLRQRYDDLKERYGISDITVSVQNVASQLGYGSIDSLTLEDMVLEIVRQIERLIQAKAMMEAAGKPF

SEQ ID NO: 8950 - protein, 269 aa, Eragrostis curvula
MAMRAAATFFSSSPISPRPFFSATPPAPSFTGRSAHCRRLRAFPTTELTVEELNPSVDLLRKTAEAVGDFRKTPIYIVGTDCTAKRNISKLLANTIIYRYLCSEELLEDVLGGKDALRDFRESDEKGYLEVETEGLKQLTSMGSLVLCCGDGAVMNSTNLGLLRHGVSIWIDVPLEMAVNDMLKSMGTVATSDPDTFTQVMGKLRQQYDELKERYGISDITVSVQNVASQLGYGSIDSLTLEDMVLEIVRQIERLIRAKAMMEAAGKPF

SEQ ID NO: 8951 - protein, 273 aa, Triticum aestivum
MAMAMRAAAAFFSPSVSPSPKQQQTHAVFSTRRGSTRRIHPRRLRAFPATELTLEELNPSVALLRKTAEAVGDFRKTPIYIVGTDCNAKRNIAKLLANSIIYRYLCSEDLLEDVLGGKDALAAFRESDEKGYLEVETEGLKQLTSMGSLVLCCGDGAVMNSTNLGLLRHGVSIWIDVPLELAVNDMLKSKGAQAISDPDSFSQAMAKLRQRYDDLKERYAVSDVTVSVQNVASQLGYSSIDSLSLEDMVIEIVSRIEKLIQAKAMMEAAGKPE

SEQ ID NO: 8952 - protein, 312 aa, Sorghum bicolor
MAAGLSGAAMTGFVAKNPLLAAAAAARRRAHPLAGRALPFSPLTTTRAARRRGLGTVTCFVPPDTEHPAARAPAAPVPVPVPETALDEEARAAAARRIAEKKARKRSERRTYLVAAMMSSLGFTSMAVAAVYSRFSWQMEGGEVPVSEMLGTFALSVGAAVGMEFWARWAHRALWHASLWHMHESHHRPREGPFELNDVFAIINAVPAICLLAYGFFHRGLVPGLCFGAGLGITLFGMAYMFVHDGLVHRRFPVGPIANVPYFRRVAAAHKIHHMDKFEGVPYGLFLGPKELEEVGGLDELEKELARIGRTI

SEQ ID NO: 8953 - protein, 311 aa, Setaria italica
MAAGLSGAAMTSSFAAKNPALLAAARRRAPPLAGRALPFSPLTTARAPRRRGLGTVTCFVPQATEGKTAPAAPVPVPVPVPDTALEEEARAAAARRIEERKARKQSERRTYLVAAVMSSLGVTSMAVAAVYYRFSWQMEGGEVPVTEMFGTFALSVGAAVGMEFWARWAHRALWHASLWHMHESHHRPREGPFELNDVFAIINAVPAISLLSYGFFHRGFVPGLCFGAGLGITLFGMAYMFVHDGLVHRRFPVGPIANVPYFRRVAAAHKIHHMDKFEGVPYGLFLGPKELEEVGGLDELEKELARISRAM

SEQ ID NO: 8954 - protein, 283 aa, Panicum virgatum
  misc_feature (176)..(176): Xaa can be any naturally occurring amino acid
  misc_feature (245)..(245): Xaa can be any naturally occurring amino acid
RRRAPPALAGRALPFSPLTTARAPRRRGLGTVVTCFVPQDTERPTAAHVPVPETALEEEARAAAARRVAERKARKLSERRTYLVAAVMSSLGVTSMAVAAVYYRFSWQMEGGEVPVTEMFGTFALSIGAAVGMEFWARWAHRALWHASLWHMHESHHRPREGPFELNDVFAIINAXPAISLLAYGFFHRGFVPGLCFGAGLGITLFGMAYMFVHDGLVHRRFPVGPIANVPYFRRVAAAHKIHHXDKFEGVPYGLFLGPKELEEVGGLDELEKELARIRSRGM

SEQ ID NO: 8955 - protein, 309 aa, Oryza sativa
MATGLSGGAMTSFAVKKPLLAAAVRRRSWPPPSGRALPFSPLTRTPRSRGLGTVTCFVPQGTESQQAPAPSPPPTVPVPVPSLEEEAAAAAARRIAERKARKLSERRTYLVAAVMSSLGFTSMAVAAVYYRFHWQLEGGDVPMTEMFGTFALSVGAAVGMEFWAQWAHRSLWHASLWHMHESHHRAREGPFELNDVFAITNAVPAISLLAYGFFHRGIVPGLCFGAGLGITLFGMAYMFVHDGLVHRRFPVGPIANVPYFRRVAAAHKIHHTDKFEGVPYGLFLGPKELEEVGGLEELEKELARINRSL

SEQ ID NO: 8956 - protein, 297 aa, Hordeum vulgare
MAAGLSGSTMASFAVKNPLLAAARYRTLPSRAGRPLPFSPFTRTARRRGQETVTCFVPQEPATVPVPSLEEEAASAAARRVAERKARKQSERRTYLVAAVMSSLGVTSMAIASVYYRFAWQMEGGEVPMTEMLGTFALSVGAAVGMEFWAQWAHKALWHASLWHMHESHHRPRDGPFELNDVFAIINAVPAIALLAYGFFHRGLVPGLCFGAGLGITLFGMAYMFVHDGLVHRRFPVGPIADVPYFRRVAAAHKIHHMDKFEGVPYGLFLGPKELEDVGGLDELEQELARINRTRSI

SEQ ID NO: 8957 - protein, 308 aa, Hordeum vulgare
MAAGLSGSTMASFAVKNPLLAAARYRTLPSRAGRPLPFSPFTRTARRRGQETVTCFVPQEGQAPGPAPVPEPATVPVPSLEEEAASAAARRVAERKARKQSERRTYLVAAVMSSLGVTSMAIASVYYRFAWQMEGGEVPMTEMLGTFALSVGAAVGMEFWAQWAHKALWHASLWHMHESHHRPRDGPFELNDVFAIINAVPAIALLAYGFFHRGLVPGLCFGAGLGITLFGMAYMFVHDGLVHRRFPVGPIADVPYFRRVAAAHKIHHMDKFEGVPYGLFLGPKELEDVGGLDELEQELARINRTRSI

SEQ ID NO: 8958 - protein, 313 aa, Brachypodium distachyon
MAAGLSRATMASFAVKNPLLAAAAARCRALPSFAAARRLPFSPLTRTPPRRRGLETVTCFVPQETQASGAAASSPAPAPAPVPSLEEEAASAASRRVAERKARKHSERRTYLVAAVLSSLGVTSMAIASVYYRFAWQMEGGEVPMTEMLGTFALSVGAAVGMEFWAQWAHRALWHASLWHMHESHHRPRDGPFELNDVFAIINAVPAICLLAYGFFHRGLIPGLCFGAGLGITLFGMAYMFVHDGLVHRRFPVGPIANVPYFRRVAAAHKIHHMDKFEGVPYGLFLGPKELEDVGGLDELDKELARINRNRSI

SEQ ID NO: 8959 - protein, 303 aa, Triticum aestivum
MAAGLSGSTMASFAVKNPLLAAAARFRTLPSRAGRPLPFSPFTRTARRRGQETVTCFVPQEGQAPGPAPEPVPSLEEEAASAAERRVAERKARKQSERRTYLVAAVMSSLGVTSMAIASVYYRFAWQMEGGEVPMTEMLGTFALSVGAAVGMEFWAQWAHKALWHASLWHMHESHHRPRDGPFELNDVFAIINAGPAIALLAYGFFHRGLIPGLCFGAGLGITLFGMAYMFVHDGLVHRRFPVGPIADVPYFRRVAAAHKIHHMDKFEGVPYGLFLGPKELEDVGGLDELEQELARINRTRSI

SEQ ID NO: 8960 - protein, 312 aa, Avena sativa
MAAGLSGATMTGFAVKNPLLAAAAARCRTLPSRHLPFSPFTRTPRRRGLETVTCFVPQVGQAPAGPAPEPATVPVPVPMPMPSLEEEAASAAARRIAEKKARKQSERRTYLVAAVMSSLGVTSMAIASVYYRFAWQMEGGEVPMTEMLGTFALSVGAAVGMEFWAQWAHKALWHSSLWHMHESHHRPRDGPFELNDVFAIINAGPAIALLAFGFFHSGLIPGLCFGAGLGITLFGMAYMFVHDGLVHRRFPVGPIANVPYFRRVAAAHKIHHMDKFEGVPYGLFLGPKELEEVGGLDELEQELAKINRTRSI

SEQ ID NO: 8961 - protein, 474 aa, Sorghum bicolor
MPLGSPVKRLLRRAAKGRLDKAELAVAGLAAAAAALLLLLLCASSLRCSAAALVSAHGRLWAGGVSIAAASDADAAADVDKRPVSAPATAAAGSGGDDEEECDLFDGEWVSAGGGGYPLYDSRDCPFLDVGFRCAENGRPDTSYTKWRWQPSRCHLPRFDAKSMLEKLRNKRVVFVGDSIGRNQWESLLCMLSSAVHNKSSIYEVNGNPITKHMGFLIFNFTDYNCTVEYYRSPFIVLQGRPPAGAPEIVRYSIRVDAMDWMSDRGKWKDADVLIFNTGHWWNNEKTIRGGAYFQVGDEVKMGMTVADAYRRSIQTLSDWLHKEVNTSKTHVIYRTYAPVHFRGGDWKTGGSCHLETLPDVMPVKSLDEWADLLQPVNDFLGSNLRSKLVGLDLLNVTRMTAQRKDGHLSVYLSPSGPVPRYKQDCSHWCLPGVPDTWNELLYALVMRKHEKMGQNASLASTRTLHTEDGNVFS

SEQ ID NO: 8962 - protein, 442 aa, Zea mays
MLPGSPVKRLLRRAAKGRREKAELAGLAAAAAALLLLCAASLRCSATARGRLWAGGVSIAAAGSGGEEECDLFDGDWVWAGGGGGYPLYDSRDCPFLDVGFRCAENGRPEASYTKWRWQPSRCHLPRFDAKSMLEKLRNKRVVFVGDSIGRNQWESLLCMLSSAVHNKSSIYEVNGSPITKHMGFLIFNFRDYNCTVEYYRSPFIVLQGRAPAGAPEIVRYSIRVDAMDWMSDRGKWKDADVLIFNTGHWWNNEKTIRGGAYFQVGDEVKMGMSVAEAYRRSIETLSDWLRKEVNTSKTHVIYRTYAPVHFRDGDWKTGGSCHLETLPDAMPVKSLDEWADLLQPVDEFLGSDLGSELAGVDLLRVTGMTAQRKDGHLSVYLSPSGPVPRYRQDCSHWCLPGVPDAWNELLYALVMRRHKKMAGTRTPDAEEGDVFSSGSSS

SEQ ID NO: 8963 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 8964 - protein, 559 aa, Saccharum officinarum
MASSGFSWTLPDHPKLPKGKQVAVVVLDGWGEANPDQYNCIHVAQTPVMDSLKNGAPEKWRLVKAHGTAVGLPSDDDMGNSEVGHNALGAGRIFAQGAKLVDSALASGKIYNGDGFNYIKESFESGTLHLIGLLSDGGVHSRLDQLQLLLKGASERGAKKIRVHILTDGRDVLDGSSVGFVETLENDLSELRGKGIDAQIASGGGRMYVTMDRYENDWDVVKRGWDAQVLGEAPYKFKSALEAVKTLRAQPNANDQYLPPFVIVDDSGNAVGPVLDGDAVVTLNFRADRMVMLAKALEYADFDKFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALEIAEKARDALLSGKFDQVRVNLPNGDMVGHTGDIEATVVACKAADEAVKIILDAVEQVGGIYLVTADHGNAEDMVKRNKAGKPLLDKNGGIQILTSHTLQPVPVAIGGPGLHPGVKFRNDIETPGLANVAATVMNLHGFQAPADYEQTLIEVADN

SEQ ID NO: 8965 - protein, 559 aa, Sorghum bicolor
MASSGVSWTLPDHPKLPKGKPVAVVVLDGWGEASPDQYNCIHVAQTPVMDSLKNGAPEKWTLVKAHGTAVGLPSDDDMGNSEVGHNALGAGRIFAQGAKLVDSALASGKIYSGDGFNYIKESFESGTLHLIGLLSDGGVHSRLDQLQLLLKGASERGAKKIRVHILTDGRDVLDGSSVGFVETLENDLSELRGKGIDAQIASGGGRMYVTMDRYENDWDVVKRGWDAQVLGEAPYKFKSALEAVKTLRAQPNANDQYLPPFVIVDDSGKAVGPVLDGDAVVTLNFRADRMVMLAKALEYADFDKFDRVRVPKIRYAGMLQYDGELKLPSRYLVSPPEIDRTSGEYLVKNGVRTFACSETVKFGHVTFFWNGNRSGYFDETKEEYVEVPSDSGITFNVAPKMKALEIAEKARDALLSGKFDQVRVNLPNGDMVGHTGDIEATVVACKAADEAVKIILDAVEQVGGIYLVTADHGNAEDMVKRNKAGKPLLDKNGGIQILTSHTLQPVPVAIGGPGLHSGVKFRKDIETPGLANVAATVMNLHGFVAPADYEQTLIEVADN

SEQ ID NO: 8966 - protein, 559 aa, Cenchrus ciliaris
MATSGFSWTLPDHPKLPKGKPVAVVVLDGWGEADADQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGASERGAKRIRVHILTDGRDVLDGSSVGFVETLENDLSELRGKGIDAQIASGGGRMYVTMDRYENDWDVVKRGWDAQVLGEAPYKFKSALEAVKTLRAEPKANDQYLPPFVIVDESGKAVGPVLDGDAVVTINFRADRMVMLAKALEYADFDKFDRVRVPKIRYAGMLQYDGELKLPSRYLVSPPEIERTSGEYLVKNGIRTFACSETVKFGHVTFFWNGNRSGYFDETKEEYVEIPSDSGITFNVAPKMKALEIAEKARDALLSGKFDQVRVNLPNGDMVGHTGDIEATVVACKAADEAVKMILDAVEQVGGIYLVTADHGNAEDMVKRNKAGKPLLDKSGGIQILTSHTLQPVPVAIGGPGLHPGVKFRTDIQTPGLANVAATVMNLHGFEAPADYEPTLIEVADN

SEQ ID NO: 8967 - protein, 559 aa, Panicum virgatum
MASSGFSWTLPDHPKLPKGKQVAVVVLDGWGEANADEYNCIHVAQTPVMDSLKNGAPEKWRLVKAHGTAVGLPSDDDMGNSEVGHNALGAGRIFAQGAKLVDQALASGKIYEGDGFNYIKESFENGTLHLIGLLSDGGVHSRLDQLQLLLKGASERGAKKIRVHILTDGRDVLDGSSVGFVETLENDLSQLREKGIDAQIASGGGRMYVTMDRYENDWDVVKRGWDAQVLGEAPHKFKSALEAVKTLRAEPNANDQYLPPFVIVDDSGKAVGPVLDGDAVVTINFRADRMVMLAKALEYADFDKFDRVRVPKIRYAGMLQYDGELKLPSRYLVSPPEIERTSGEYLVKNGIRTFACSETVKFGHVTFFWNGNRSGYFDETKEEYVEIPSDSGITFNVAPKMKALEIAEKARDAILSGKFDQVRVNLPNGDMVGHTGDIEATVVACKAADEAVKIILDAVEQVGGIYLVTADHGNAEDMVKRNKAGKPLLDKSGGIQILTSHTLQPVPVAIGGPGLHPGVKFRNDIQTPGLANVAATVMNLHGFEAPADYEPTLIEVADN

SEQ ID NO: 8968 - protein, 559 aa, Panicum virgatum
MASSGFSWTLPDHPKLPKGKPVAVVVLDGWGEANADQYNCIHVAQTPVMDSLKNGAPERWRLVKAHGTAVGLPSDDDMGNSEVGHNALGAGRIFAQGAKLVDQALASGKIYEGDGFNYIKESFENGTLHLIGLLSDGGVHSRLDQLQLLLKGASERGAKRIRVHILTDGRDVLDGSSVGFVETLENDLSQLREKGIDAQIASGGGRMYVTMDRYENDWDVVKRGWDAQVLGEAPHKFKSALEAVKTLRAEPNANDQYLPPFVIVDDSGKAVGPVLDGDAVVTINFRADRMVMLAKALEYADFDKFDRVRVPKIRYAGMLQYDGELKLPSRYLVSPPEIERTSGEYLVKNGICTFACSETVKFGHVTFFWNGNRSGYFDETKEEYVEIPSDSGITFNVAPKMKALEIAEKARDALLSGKFDQVRVNLPNGDMVGHTGDIEATVVACKAADEAVKIILDAVEQVGGIYVVTADHGNAEDMVKRNKAGKPALDKSGGIQILTSHTLQPVPVAIGGPGLHPGVKFRNDIQTPGLANVAATVMNLHGFEAPADYETTLIEVADN

SEQ ID NO: 8969 - protein, 559 aa, Setaria italica
MASSGISWTLPDHPKLPKGKPVAVVVLDGWGEADADQYNCIHVAQTPVMDSLKNGAPEKWRLVKAHGTAVGLPSDDDMGNSEVGHNALGAGRIFAQGAKLVDKALASGKIYEGDGFNYIKESFENGTLHLIGLLSDGGVHSRLDQLQLLLKGASERGAKRIRVHILTDGRDVLDGSSVGFVETLENDLSQLRGKGIDAQIASGGGRMYVTMDRYENDWTVVKRGWDAQVLGEAPYKFKSALEAVKTLRAEPKANDQYLPPFVIVDDSGKAVGPVLDGDAVVTINFRADRMVMLAKALEYADFDKFDRVRVPKIRYAGMLQYDGELKLPNRYLVSPPEIERTSGEYLVKNGIRTFACSETVKFGHVTFFWNGNRSGYFDETKEEYVEIPSDSGITFNVAPKMKALEIAEKARDALLSGKFDQVRVNLPNGDMVGHTGDIEATVVACKAADEAVKMILDAVEQVGGIYLVTADHGNAEDMVKRNKAGKPLLDKSGGIQILTSHTLQPVPVAIGGPGLHPGVKFRTDIQTPGLANVAATVMNLHGFEAPADYETTLIEVADN

SEQ ID NO: 8970 - protein, 559 aa, Pennisetum glaucum
MATSGFSWTLPDHPKLPKGKPVAVVVLDGWGEADADQYNCIHVAETPVMDSLKNGAPEKWRLVKAHGTAVGLPSDDDMGNSEVGHNALGAGRIFAQGAKLVDNALASGKIYEGDGFNYIKESFENGTLHLIGLLSDGGVHSRLDQLQLLLKGASERGAKRIRVHILTDGRDVLDGSSVGFVETLENDLSQLRGKGIDAQIASGGGRMYVTMDRYENDWDVVKRGWDAQVLGEAPYKFKSALEAVKTLRAEPKANDQYLPPFVIVDDSGKAVGPVVDGDAVVTINFRADRMVMLAKALEYADFDKFDRVRVPKIRYAGMLQYDGELKLPSRYLVSPPEIERTSGEYLVKNGIRTFACSETVKFGHVTFFWNGNRSGYFDETKEEYVEIPSDSGITFNVAPKMKALEIAEKARDALLSGKFDQVRVNLPNGDMVGHTGDIEATVVACKAADEAVKMILDAVEQVGGIYLVTADHGNAEDMVKRNKAGKPQLDKSGGIQILTSHTLQPVPVAIGGPGLHPGVKFRTDIQTPGLANVAATVMNLHGFEAPADYETTLIEVEDK

SEQ ID NO: 8971 - protein, 556 aa, Cynodon dactylon
MATAWTLPEHPKLPKGKTVAVVVLDGWGEANPDQYNCIHVAQTPVMDSLKNGAPEKWRLVKAHGTAVGLPSDDDMGNSEVGHNALGAGRIFAQGAKLVDSALASGKIYDGEGFNYIKESFENGTLHLIGLLSDGGVHSRLDQVQLLLKGASERGAKRIRVHILTDGRDVLDGSSVGFVETLENDLSQLREKGIDAQIASGGGRMYVTMDRYENDWSVVKRGWDAQVLGEAPHKFKSAVEAVKTLRAVPDANDQYLPPFVIVDESGTAVGPIVDGDAVVTFNFRADRMVMLAKALEYADFDKFDRVRVPKIRYAGMLQYDGELLLPKRYLVSPPEIERTSGEYLVKNGVSTFACSETVKFGHVTFFWNGNRSGYFDESKEEYVEVPSDSGITFNVKPKMKAVEIAEKARDAILSGKFDQVRVNLPNGDMVGHTGDIEATVVACKAADEAVKIILDAVEQVGGIYLVTADHGNAEDMVKRNKAGKPLLDKSGAIQILTSHTLQPVPVAIGGPGLHPGVKFRSDIQIPGLANVAATVMNLHGFEAPADYEPTLIEVADN

SEQ ID NO: 8972 - protein, 559 aa, Oryza sativa
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACSETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 8973 - protein, 559 aa, Oryza sativa
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACSETVKFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 8974 - protein, 559 aa, Brachypodium distachyon
MASSGSSWTLPDHPKLPKGKTVAVIVLDGWGEASPDKYNCIHVAQTPVMDSLKNGAPEKWTLVKAHGTAVGLPSDDDMGNSEVGHNALGAGRIFAQGAKLVDAALASGKIYEGAGFNYIKESFDKGTLHLIGLLSDGGVHSRLDQVQLLLKGASERGAKRIRLHILTDGRDVLDGSSVGFVETIENDLSQLREKGVDARIASGGGRMNVTMDRYENDWGVVKRGWDAQVLGEAPYKFQSALEAVKTLRAEPKANDQYLPPFVIVDESGKSVGPIVDGDAVVTFNFRADRMVMLAKALEFADFDKFDRVRVPKIKYAGMLQYDGELKLPSKYLVDPPLIERTSGEYLVKNGVRTFACSETVKFGHVTFFWNGNRSGYFDETKEEYVEIPSDSGITFNEQPKMKALEIAEKTRDAILSGKFDQVRINLPNGDMVGHTGDIEATVVACKAADEAVKIVLDAVEQVGGIYLVTADHGNAEDMVKRNKAGQPMLDKSGSIQILTSHTLQPVPVAIGGPGLHPGVKFRSDIQTPGLANVAATVMNLHGFEAPADFETTLIEVVDK

SEQ ID NO: 8975 - protein, 557 aa, Hordeum vulgare
MATSDWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQILGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETKEEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 8976 - protein, 559 aa, Elaeis guineensis
MGSSEFSWKLADHPKLPKRKTVAVVVLDGWGEANPDKYNCIHVAQTPTMDSLKQGAPERWRLVRAHGTAVGLPTEDDMGNSEVGHNALGAGRIYAQGAKLVDLALASGKIYEGEGFKYIKECFDQGTLHLIGLLSDGGVHSRLDQLQLLLKGASENGAKRIRVHFLTDGRDVLDGSSIGFVETLENDLLKLREKGVDAQIASGGGRMYVTMDRYENDWGVVKRGWDAQVLGEAPHKFRSAVEAVKKLREDPKANDQYLPPFVIVDESGKAVGPIVDSDAVVTFNFRADRMVMLAKALEYEDFDKFDRVRFPKIRYAGMLQYDGELKLPSHYLVSPPEIERTSGEYLVHNGIRTFACSETVKFGHVTFFWNGNRSGYFDSSMEEYVEIPSDAGITFNVQPKMKALEIAEKARDAILSGKFDQVRVNLPNGDMVGHTGDIEATIVACKAADDAVKIILDAIEQVGGIYVVTADHGNAEDMVKRNKSGQPLLDKKGDIQILTSHTLQPVPIAIGGPGLAPGVRFRNDVPDGGLANVAATVMNLHGFEAPNDYEPTLIEVVDN

SEQ ID NO: 8977 - protein, 494 aa, Secale cereale
MELLLVSQVTTTWATVKLATMPLALVGSLLRARSLLMLLLLLGRFGEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 8978 - protein, 557 aa, Secale cereale
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 8979 - protein, 557 aa, Secale cereale
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 8980 - protein, 557 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 8981 - protein, 556 aa, Avena sativa
MATSWTLPDHPTLPKNKLVAVVVLDGWGEASADQYNCIHRAETPVMDSLKNGAPEKWTLVKAHGTAVGLPSDDDMGNSEVGHNALGAGRIFAQGAKLVDAALASGKIWEDEGFNYIKESFAEGTLHLIGLLSDGGVHSRLDQVQLLVKGASERGAKRIRLHILTDGRDVLDGSSVGFVETIENDLAQLRGQGVDARVASGGGRMYVTMDRYENDWDVVKRGWDAQVLGEAPHKFKSALEAVKTLRAEPKANDQYLPPFVIVDESGKSVGPIVDGDAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEVPSDSGITFNEQPKMKALEIAEKTRDAILSGKFDQVRINLPNGDMVGHTGDIEATVVACKAADEAVKIVLDAVEQVGGIYLVTADHGNAEDMVKRNKSGQPALDKNGSIQILTSHTLQPVPVAIGGPGLHPGAKFRSDIKTPGLANVAATVMNLHGFLAPDDYETTLIEVAAK

SEQ ID NO: 8982 - protein, 557 aa, Triticum aestivum
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAEKTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 8983 - protein, 558 aa, Musa acuminata
MGSSDFSWKLADHPTLPKGKTVAVVVLDGWGEANPDKYNCIHVAQTPTMDSLKQGAPERWRLVRAHGTAVGLPTEDDMGNSEVGHNALGAGRIYAQGAKLVDLALASGKIYEGEGFKYIKESFDQGTLHLIGLLSDGGVHSRLDQLQLLLKGSSENGAKRIRVHILTDGRDVLDGSSVGFVETLESDLAKLREKGIDAQIASGGGRMYVTMDRYENDWDVVKRGWDAQVLGEAPYKFRSAVEAVKKLREDTKANDQYLPPFVIVDESGKAVGPIVDGDAVVTFNFRADRMVMIAKSLEYEDFDKFDRVRFPKIRYAGMLQYDGELKLPSKYLVSPPEIERTSGEYLVHNGVRTFACSETVKFGHVTFFWNGNRSGYFDATMEEYVEIPSDSGITFNVRPKMKALEIAEKARDAILSRKFDQVRVNLPNGDMVGHTGDIEATVVACKAADEAVKIILDAIEQVGGIYVVTADHGNAEDMVKRNKTGQPQLDKAGNIQILTSHTLQPVPIAIGGPGLAPGVRFRNNVPDGGLANVAATVMNLHGFEAPSDYEPTLIEVDN

SEQ ID NO: 8984 - protein, 552 aa, Triticum aestivum
WTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAEKTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 8985 - protein, 557 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 8986 - protein, 557 aa, Triticum aestivum
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWNAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAEKTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 8987 - protein, 557 aa, Triticum aestivum
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 8988 - protein, 559 aa, Musa acuminata
MGSSDFSWKLADHPKLPKGKTVAVVVLDGWGEADPDQYNCIHVAQTPTMDSLKKGAPERWRLVRAHGTAVGLPTEDDMGNSEVGHNALGAGRIFAQGAKLVDLALASGKIFEGEGFKYIKECFDKSTLHLIGLLSDGGVHSRLDQLQLLLKGCSENGAKRIRVHILTDGRDVLDGSSVGFVEILENDLAKLREKGIDAQIASGGGRMYVTMDRYENDWGVVKRGWDAQVLGEAPHKFRSAVEAVKKLREAPKANDQYLPPFVIVDESGKAVGPIVDGDAVVTFNFRADRMVMIAKALEYADFDKFDRVRVPKIRYAGMLQYDGELKLPSRYLVSPPEIDRTSGEYLVHNGIRTFACSETVKFGHVTFFWNGNRSGYFNSSMEEYVEIPSDSGITFNVQPKMKALEIAEKVRDAILSRKFDQVRVNLPNGDMVGHTGDIEATVVGCKAADEAVKIILDAIEQVGGIYVVTADHGNAEDMVKRNKTGQPLLDKAGKIQILTSHTLQPVPIAIGGPGLASGVRFRKDVPDGGLANVAATVMNLHGFEAPTDYEPTLIEVVDN

SEQ ID NO: 8989 - protein, 556 aa, Avena sativa
MATSWTLPDHPKLPKGKLVTIIVLDGWGEATADQYNCIHRAETPVMDSLKNGAPEKWTLVKAHGTAVGLPSDDDMGNSEVGHNALGAGRIFAQGAKLVDAALASGKIWEDEGFNYIKESFAEGTLHLIGLLSDGGVHSRLDQVQLLVKGASERGAKRIRLHILTDGRDVLDGSSVGFVETIENDLAQLREKGVDARVASGGGRMYVTMDRYENDWGVVKRGWDAQVLGEAPYKFKSALEAVKTLRAEPKANDQYLPPFVIVDESGKSVGPIVDGDAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLPNGDMVGHTGDIEATVVACKAADEAVKIVLDAVEKVGGIYLVTADHGNAEDMVKRNKSGQPALDKSGSIQILTSHTLQPVPVAIGGPGLHPGVKFRTDINTPGLANVAATVMNLHGFLAPDDFETTLIEVADK

SEQ ID NO: 8990 - protein, 132 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLLPYLVC

SEQ ID NO: 8991 - protein, 322 aa, Secale cereale
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKLSTLGCFNMMVS

SEQ ID NO: 8992 - protein, 178 aa, Triticum aestivum
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRFAFTFLLMGVMFWMAVVLVS

SEQ ID NO: 8993 - protein, 357 aa, Elaeis guineensis
MGSSEFSWKLADHPKLPKGKTVAVVVLDGWGEANPDKYNCIHVAETPAMDSLKKGAPDRWRLVRAHGTAVGLPTEDDMGNSEVGHNALGAGRIYAQGAKLVDLALASGKIYEGEGFKYIKECFDQGTLHLIGLLSDGGVHSRLDQLQLLLKGASENGAKRIRVHVLTDGRDVLDGSSVGFVETLENDLLKLREKGVDAQIASGGGRMYVTMDRYENDWGVVKRGWDAQVLGEAPHKFQSAVEAVKKLREVPKANDQYLAPFVIVDESGKAVGPIVDGDAVVTFNFRADRMVMLAKALEYEDFDKFDRVRFPKIRYAGMLQYDGELKLPSHYLVSPPEIERTSGEYLVHNGIRYFCLQ

SEQ ID NO: 8994 - protein, 559 aa, Coffea canephora
MGSSGFSWKLNDHPKLPKGKVIAMVVLDGWGEANPNQYNCIHVAETPVMDSLKNGAPEKWRLVKAHGKAVGLPTDDDMGNSEVGHNALGAGRIYAQGAKLVDLALESGKIYDDEGFKYIKESFETGTLHLIGLLSDGGVHSRLDQLQLLLKGASERGAKRIRVHALTDGRDVLDGTSVGFMETLENDLAKLREKGIDAQIASGGGRMYVTMDRYENDWDVVKRGWDAQVLGEAPHKFTNAVEAVKKLREEPKANDQYLPPFVIVDENGKSVGPILDGDAVVTFNFRADRMVMLAKALEYEDFDKFDRVRFPKIRYAGMLQYDGELKLPSHYLVSPPEIERTSGEYLVHNGVSTFACSETVKFGHVTFFWNGNRSGYFDPSKEEYVEIPSDSGITFNVKPKMKALEIAEKARDAILSGKFHQVRVNLPNSDMVGHTGDIEATVVACKAADDAVKMILDAIEQVGGIYVVTADHGNAEDMVKRNKKGEPLLDKNGNVQILTSHTLEPVPIAIGGPGLAPGVKFRQGLPGAGLANVAATVMNLHGYEAPSDYEPTLIEVVDN

SEQ ID NO: 8995 - protein, 559 aa, Aristolochia fimbriata
MGSSDFSWKLADHPKLPKGKTIAVVVLDGWGEANPDKYNCIHVAETPVMDSLKKGAPDRWRLVRAHGTAVGLPTEDDMGNSEVGHNALGAGRIYAQGAKLVDLALASGKIYDGEGFNYIKESFNTNTLHLIGLLSDGGVHSRLDQLQLLVKGASERGAKRIRLHILTDGRDVLDGSSVGFVETIEKDLADLRAKGVDAQIASGGGRMYVTMDRYENDWEVIKRGWDAQVLGEAPYKFRNAVEAVKKLREDPKNNDQYLPPFVIVDEQGKSVGPIVDGDAVVTFNFRADRMVMLAKALEYADFDKFDRVRVPKIRYAGMLQYDGELKLPSRYLVSPPEIERTSGEYLVHNGVRTFACSETVKFGHVTFFWNGNRSGYFNSEMEEYVEIPSDSGITFNVKPNMKALEIAEKARDAILSGKFHQVRVNLPNSDMVGHTGDIDATVVACKAADDAVKMILDAVEKVGGIYVVTADHGNAEDMVKRNKKGEPQLDKEGKIQILTSHTLQPVPIAIGGPGLGPGVKFRKDVPQGGLANVAATVMNLHGLEAPADYEPTLIEVVDN

SEQ ID NO: 8996 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 8997 - protein, 557 aa, Papaver somniferum
MGSAEVSFKLADHPKLPKGKVVAQIVLDGWGEANPDQFNCIHVAQTPTMDSLKQGAPEKWRLVRAHGKAVGLPTEDDMGNSEVGHNALGAGRIFAQGAKLVDIALASGKIFDGEGFQYIKESFKDGTLHLIGLLSDGGVHSRIDQVQLLLKGASERGAKRIRLHILTDGRDVLDGSSVGFVETIENDLAQLRANGVDAQIASGGGRMYVTMDRYENDWSVVKRGWDAQVLGEAPYKFKSALEAVKTLRAEPKANDQYLPPFVIVDDSGKAVGPVLDGDAVVTFNFRADRMTMLAKALEYDDFKDFDRVRFPKIRYAGMLQYDGELKLPNKYLVSPPEIDRTSGEYLVHNGVRTFACSETVKFGHVTFFWNGNRSGYFKEDMEEYVEIPSDSGITFNAQPLMKALEIGEKARDAILSGKFDQVRVNIPNSDMVGHTGDIEATVVACKAADQAVKMIIDAIEQVGGIYLVTADHGNAEDMVKRNKKGEPLLDKNGNIQILTSHTLQPVPVAIGGPGLAPGVRFRSDVPEGGLANVAATMMNLHGFVAPDDYETTLIEVV

SEQ ID NO: 8998 - protein, 559 aa, Aquilegia formosa
MGSSEFSWKLADHPKLPKGKQLALVVLDGWGEANPDKYNCIHVAETPTMDSLKQGAPEKWRLVKAHGKAVGLPTEDDMGNSEVGHNALGAGRIYAQGAKLVDIALASGSIYDGEGFSYIKECFASGTLHLIGLLSDGGVHSRIDQLQLLLKGASERGAKRIRVHILTDGRDCLDGSSIGFVETLEKDLTELRAKGIDAQIASGGGRMYVTMDRYENDWSVVKRGWDAQVLGEAPYQFTSAVEAVKKLREAPNTSDQYLPPFVIVDDSGKPVGPIVDGDAVVTMNFRADRMVMLAKALEYEDFDKFDRVRVPKIRYAGMLQYDGELKLPNRYLVSPPLIERTSGEYLVKNGVRTFACSETVKFGHVTFFWNGNRSGYFDESMEEYVEIPSDSGITFNVQPKMKALEIAERARDAILSGKFDQIRVNLPNSDMVGHTGDIDATVVACKAADEAVKMILDAIEQVGGIYVVTADHGNAEDMVKRNKKGDPLLDKAGKIQILTSHTLQPVPVAIGGPGLASGVRFRKDVPNGGLANVAATVMNLHGFVAPDDYETTLIEVADS

SEQ ID NO: 8999 - protein, 559 aa, Aquilegia formosa
MGSSEFSWKLADHPKLPKGKQIALVVLDGWGEANPDKYNCIHVAETPTMDSLKQGAPEKWRLVRAHGKAVGLPTEDDMGNSEVGHNALGAGRIYAQGAKLVDLALASGSIYDGEGFNYIKQCFASGTLHLIGLLSDGGVHSRIDQLQLLLKGASERGAKRIRVHILTDGRDCLDGSSIGFVETLEKDLAELRAKGIDAQIASGGGRMYVTMDRYENDWGVVKRGWDAQVLGEAPYQFTSAVEAVKKLREAPNTSDQYLPPFVIVDDSGKPVGPIVDGDAVVTINFRADRMVMLAKALEYEDFDKFDRVRVPKIRYAGMLQYDGELKLPSHYLVSPPLIERTSGEYLVKNGVHTFACSETVKFGHVTFFWNGNRSGYFDETMEEYVEIPSDSGITFNVQPKMKALEIAERARDAILSGKFDQVRVNLPNSDMVGHTGDIDATVVACKAAGEAVKMILDAIEQVGGIYVVTADHGNAEDMVKRNKKGDPLLDKAGNIQILTSHTLQPVPVAIGGPGLASGVRFRKDVPDGGLANVAATVMNLHGFVAPEDYETTLIEVAEN

SEQ ID NO: 9000 - protein, 559 aa, Mesembryanthemum crystallinum
MGSTEFSWKLADHPKLPKGKTLAMVVLDGWGEASANQYNCIHVAETPTMDSLKQGAPEKWRLIRAHGKAVGLPTEDDMGNSEVGHNALGAGRIYAQGAKLVDLALESGKIYDGEGFNYIKESFETNTLHLIGLLSDGGVHSRLDQLQLLLKGSAERGAKRIRVHILTDGRDVLDGSSVGFVETLENDLAQLRAKGVDAQIASGGGRMYVTMDRYENDWSVVKRGWDAQVLGEAPYKFKNAVEAVKTLRQEPKANDQYLPPFVVVDESGKAVGPIVDGDAVVTLNFRADRMVMLAKALEYEDFDKFDRVRFPKIRYAGMLQYDGELKLPNRYLVSPPEIERTSGEYLVHNGVRTFACSETVKFGHVTFFWNGNRSGYFKPEMEEYVEIPSDSGITFNVQPKMKALEIAEKARDAILSGKFDQVRVNLPNSDMVGHTGDIEATVVACKAADEAVKMIIDAIEQVGGIYVITADHGNAEDMVKRDKKGQPAMDKNGNIQILTSHTLEPVPIAIGGPGLTPGVRFRNDIPTGGLANVAATVMNLHGFEAPSDYEPTLIEVVSN

SEQ ID NO: 9001 - protein, 468 aa, Secale cereale
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEVCQGGLVCCGASWWYLSCHS

SEQ ID NO: 9002 - protein, 558 aa, Gossypium hirsutum
MASSGQVSFKLEDHPKLPKGKRIAVVVLDGWGEYKPDQYNCIHVAQTPTMDSLKQGAPDRWRLIRAHGNAVGLPTEDDMGNSEVGHNALGAGRIFAQGAKLVDLALASGKIYDGEGFKYISESFEKGTLHLIGLLSDGGVHSRLDQLQLLLKGASERGAKRIRVHVLTDGRDVLDGSSVGFVETLENDLAKLREKGVDARIASGGGRMYVTMDRYENDWDVVKRGWDAQVLGEAPHKFKNAVEAVKKLRENANDQYLPPFVIVDDNNKAVGPIVDGDAVVTINFRADRMVMLAKALEYQDFNKFDRVRVPKIRYAGMLQYDGELKLPSRYLVSPPEIDRTSGEYLVHNGVRTFACSETVKFGHVTFFWNGNRSGYFNPQMEEYVEIPSDVGITFNVQPKMKALEIGEKARDAILSGKFDQVRVNIPNGDMVGHTGDIEATVVACKAADEAVKMILDAIEQVGGIYIVTADHGNAEDMVKRNKSGEPLLDKNGDLQILTSHTCQPVPIAIGGPGLAPGVRFRSDVPNGGLANVAATVMNLHGFVAPNDYETTLIEVADN

SEQ ID NO: 9003 - protein, 559 aa, Eschscholzia californica
MGSSDISLKLADHPKLPKGKTIALVVLDGWGEAHPDQFNCIHVAQTPTMDSLKTGAPEKWRLVRAHGKAVGLPTEDDMGNSEVGHNALGAGRIFAQGAKLVDSALASGKIYDGEGFNYIKESFANNTLHLIGLLSDGGVHSRLDQVQLLVKGASERGAKRIRIHILTDGRDVLDGSSVGFVETLENDLANLRANGVDAQIASGGGRMYVTMDRYENDWGVVKRGWDAQVLGEAPYKFQNAVEAVKKLRQEPKANDQYLPPFVIVDESGKAVGPVVDGDAVVTFNFRADRMTMLAKALEYEDFNNFDRVRFPKIRYAGMLQYDGELKLPNHYLVSPPEIDRTSGEYLVHNGVRTFACSETVKFGHVTFFWNGNRSGYFNEALEEYVEIPSDSGITFNVQPKMKALEIGEKARDAILSGKFDQVRVNIPNSDMVGHTGDIDATVVACKAADEAVKMILDAIEQVGGIYVVTADHGNAEDMVKRNKKGEPLLDKEGKIQILTSHTLQPVPVAIGGPGLTAGVRFRNDVPEGGLANVAATVMNLHGFVAPSDYETTLIEVAEN

SEQ ID NO: 9004 - protein, 559 aa, Carpinus betulus
MGTSGISWKLPEHPKLPKGKTVAVVVLDGWGEAKPDQYNCIHVADTPTMDSLKQGAPEKWRLVRAHGKAVGLPTEDDMGNSEVGHNALGAGRIFAQGAKLVDLALDSGKIYEGEGFKYIKECFKNGTLHLIGLLSDGGVHSRLDQLQLLLKGASERGAKRIRVHILTDGRDVLDGSSIGFLEILENDLAKLREKGVDAQIASGGGRMYVTMDRYENDWDVVKRGWDAQVLGEAPYKFRNAIEAVKKLREELKVNDQYLPPFVIVDENEKPVGPIVDGDAVVTINFRADRMVMIAKALEYEDFDKFDRVRFPKIRYAGMLQYDGELKLPSHYLVSPPEIERTSGEYLVHNGVRTFACSETVKFGHVTFFWNGNRSGYFNPELEEYVEIPSDSGITFNVQPKMKALEIAEKTRDAILGGKFDQVRVNLPNGDMVGHTGDIEATVVACKVADEAVKIILDAIEQVGGIYVVTADHGNAEDMVKRNKSGQPLLDKNGKLQILTSHTLEPVPIAIGGPGLAPGVRFRKDLPNGGLANVAATVMNLHGFEAPSDYEPTLIEVVDN

SEQ ID NO: 9005 - protein, 559 aa, Cucumis sativus
MGSSGFSWKLPDHPKLPKDKTIGLIVLDGWGEANPDRYNCIHVADTPTMDSLKKGAPEHWRLLKAHGKAVGLPTEDDMGNSEVGHNALGAGRIYAQGAKLVDLALESGKIYDGEGFKYIKESFETGTLHLIGLLSDGGVHSRLDQVQLLLKGASERGAKRIRVHILTDGRDVLDGSSVGFVETLENDLAKLREKGIDAQIASGGGRMYVTMDRYENDWEVVKRGWDAQVLGEAPHKFKSALEAVKTLRAEPKANDQYLPPFVIVDDSGKSVGPIVDGDAVVTFNFRADRMVMIAKALENENFDKFDRVRFPKIRYAGMLQYDGELKLPSHYLVSPPEIERTSGEYLVHNGVRTFACSETVKFGHVTFFWNGNRSGYFNPEMEEYVEIPSDSGITFNVQPKMKAIEIAEKARDAILSRKFHQVRVNLPNGDMVGHTGDIEATVVACKAADDAVKMILDAIERVGGIYVVTADHGNAEDMVKRSKSGEPLLDKNGKIQILTSHTLQPVPIAIGGPGLAPGVRFRNDVPTGGLANVAATVINLHGYEAPSDYETTLIEVVDS

SEQ ID NO: 9006 - protein, 226 aa, Fraxinus spp
MDSLKKGAPEKWRLVKAHGKAVGLPTDDDMGNSEVGHNALGAGRIFAQGAKLVDLALASGKIYEGEGFKYIKESFETGTLHLIGLLSDGGVHSRLDQLQLLLKGASEHGAKRIRVHVLTDGRDVLDGTSVGFVETLENDLSKLREKGVDAQIASGGGRMQVTMDRYENDWDVVKRGWDAQVLGEAPHKFKSAVEAVKKLREAPNANDQYLPPFVIVDDNGKLLGLL

SEQ ID NO: 9007 - protein, 559 aa, Vaccinium corymbosum
MGTSGFSWKLEDHPKLEKGKVIALIVLDGWGEANPDQYNCIHVAETPVMDSLKTGAPDRWRLVRAHGKAVGLPTEDDMGNSEVGHNALGAGRIYAQGAKLVDLALASGKIYDGEGFNYIKESFETGTLHLIGLLSDGGVHSRLDQLQLLMKGASERGAKRIRVHILTDGRDVLDGSSVGFVETLENDLSKLRETGVDAQIASGGGRMYVTMDRYENDWSVVKRGWDAQVLGEAPYKFKSALDAVKTLRQDPKANDQYLPPFVIVGEDGKAVGPIVDGDAVVTVNFRADRMTMLAKALEYENFDKFDRVRFPKIRYAGMLEYDGELKLPKRYLVSPPEIERTSGEYLTHNGVRTFACSETVKFGHVTFFWNGNRSGYFNAEMEEYVEIPSDSGITFNEQPKMKALEIAEKARDAILSRKFHQVRVNLPNSDMVGHTGDIKATVVACKAADEAVKMILDAIEQVGGIYVVTADHGNAEDMVKRNKKGGPLLDKDGNIQILTSHTLQPVPIAIGGPGLAPGVRFRKDVPEGGLANVAATVMNLHGFLAPSDYETTLIEVADN

SEQ ID NO: 9008 - protein, 558 aa, Gossypium raimondii
MASSGQVSFKLEDHPKLPKGKRIAVVVLDGWGEYKPDQYNCIHVAQTPTMDSLKQGAPDRWRLIRAHGNAVGLPTEDDMGNSEVGHNALGAGRIFAQGAKLVDLALASGKIYDGEGFKYISESFEKGTLHLIGLLSDGGVHSRLDQLQLLLKGASERGAKRIRVHVLTDGRDVLDGSSVGFVEILENDLAKLREKGVDARIASGGGRMYVTMDRYENDWDVVKRGWDAQVLGEAPHKFKNAIEAVKKLRENANDQYLPPFVIVDDNNKAVGPIVDGDAVVTINFRADRMVMLAKALEYQDFNKFDRVRVPKIRYAGMLQYDGELKLPSRYLVSPPEIDRTSGEYLVHNGVRTFACSETVKFGHVTFFWNGNRSGYFNPQMEEYVEIPSDVGITFNVQPKMKALEIGEKARDAILSGKFDQVRVNIPNGDMVGHTGDIEATVVACKAADEAVKMILDAIEQVGGIYIVTADHGNAEDMVKRNKSGEPLLDKNGDLQILTSHTCQPVPIAIGGPGLAPGVRFRSDVPNGGLANVAATVMNLHGFVAPNDYETTLIEVADN

SEQ ID NO: 9009 - protein, 557 aa, Papaver somniferum
MGSAEVSFKLADHPKLPKGKVVAQIVLDGWGEANPDQFNCIHVAQTPTMDSLKQGAPEKWRLVRAHGKAVGLPTEDDMGNSEVGHNALGAGRIFAQGAKLVDIALASGKIFDGEGFQYIKESFKDGTLHLIGLLSDGGVHSRIDQVQLLLKGASERGAKRIRLHILTDGRDVLDGSSVGFVETIENDLAQLRANGVDAQIASGGGRMNVTMDRYENDWGVVKRGWDAQVLGEAPYKFKSALEAVKTLRAEPKANDQYLPPFVIVDDSGKAVGPVLDGDAVVTFNFRADRMTMLAKALEYDDFKDFDRVRFPKIHYAGMLQYDGELKLPNKYLVSPPEIDRTSGEYLVHNGVRTFACSETVKFGHVTFFWNGNRSGYFKEDMEEYVEIPSDSGITFNAQPLMKALEIGEKARDAILSGKFDQVRVNIPNSDMVGHTGDIEATVVACKAADQAVKMIIDAIEQVGGIYLVTADHGNAEDMVKRNKKGEPLLDKNGNIQILTSHTLQPVPVAIGGPGLAPGVRFRSDVPEGGLANVAATMMNLHGFVAPDDYETTLIEVV

SEQ ID NO: 9010 - protein, 557 aa, Papaver somniferum
MGSAEVSFKLADHPKLPKGKVIAQIVLDGWGEANPDQFNCIHVAQTPTMDSLKQGAPEKWRLVRAHGKAVGLPTEDDMGNSEVGHNALGAGRIFAQGAKLVDIALASGKIFDGEGFQYIKESFKDGTLHLIGLLSDGGVHSRIDQVQLLLKGASERGAKRIRLHILTDGRDVLDGSSVGFVETIENDLAQLRANGVDAQIASGGGRMYVTMDRYENDWGVVKRGWDAQVLGEAPYKFKSALEAVKTLRAEPKANDQYLPPFVIVDDSGKAVGPVLDGDAVVTFNFRADRMTMLAKALEYDDFKDFDRVRFPKIRYAGMLQYDGELKLPNKYLVSPPEIDRTSGEYLVHNGVRTFACSETVKFGHVTFFWNGNRSGYFKEDMEEYVEIPSDSGITFNAQPLMKALEIGEKARDAILNGKFDQVRVNIPNSDMVGHTGDIEATVVACKAADQAVKMIIDAIEQVGGIYLVTADHGNAEDMVKRNKKGEPLLDKNGNIQILTSHTLQPVPVAIGGPGLAPGVRFRSDVPEGGLANVAATMMNLHGFVAPDDYETTLIEVV

SEQ ID NO: 9011 - protein, 559 aa, Sesamum indicum
MGSSEFSWKLKDHPKLPKGKTIAMVVLDGWGEANPNKYNCIHVAETPTMDSLKNGAPDKWRLVKAHGKAVGLPTDDDMGNSEVGHNALGAGRIYAQGAQLVDIALETGKIYDGEGFKYIKESFETGTLHLIGLLSDGGVHSRLNQLQLLLKGASERGAKRIRVHILTDGRDVLDGSSVGFVETLENDLAKLREKGVDAQVASGGGRMYVTMDRYENDWDVVKRGWDAQVLGEAPHKFKNPVEAVKKLREIPNTNDQYLPPFVIVDENGKAVGPIVDGDAVVTFNFRADRMVMIAKALEYENFDKFDRVRFPKIRYAGMLQYDGELKLPSRYLVSPPEIERTSGEYLVHNGVRTFACSETVKFGHVTFFWNGNRSGYFNPQMEEYVEIPSDSGITFNVQPKMKALEIAEKARDAILSRKFDQVRVNLPNGDMVGHTGDIEATVVACKAADEAVKMILDAIEQVGGIYVVTADHGNAEDMVKRNKKGEPLLDKNGNIQILTSHTLEPVPIAIGGPGLAPGVRFRKDVPNGGLANVAATVINLHGFEAPSDYETTLIEVVDN

SEQ ID NO: 9012 - protein, 559 aa, Citrullus lanatus
MGSSGFSWKLPDHPKLPKDKIVGLIVLDGWGEANPDRYNCIHVAETPTMDSLKKGAPEHWRLLRAHGKAVGLPTEDDMGNSEVGHNALGAGRIYAQGAKLVDLALASGKIYEGEGFKYIKESFETGTLHLIGLLSDGGVHSRLDQVQLLLKGASERGAKRIRVHILTDGRDVLDGSSVGFVETLENDLAKLREKGVDAQIASGGGRMYVTMDRYENDWEVVKRGWDAQVLGEAPHKFKSALEAVKKLREEPKANDQYLPPFVIVDDSGKSVGPIVDGDAVVTFNFRADRMVMIAKALEYENFDKFDRVRFPKIRYAGMLQYDGELKLPSHYLVSPPEIERTSGEYLVHNGVRTFACSETVKFGHVTFFWNGNRSGYFNPEMEEYVEIPSDSGITFNVQPKMKAIEIAEKARDAILSRKFQQVRVNLPNGDMVGHTGDIEATVVACKAADDAVKMILDAIEQVGGIYVVTADHGNAEDMVKRSKSGEPLLDKSGKIQILTSHTLQPVPIAIGGPGLAPGVRFRNDVPNGGLANVAATVINLHGYEAPSDYETTLIEVVDS

SEQ ID NO: 9013 - protein, 559 aa, Ocimum basilicum
MGSSGFSWKLNDHPKLPKGKTIAMVVLDGWGEANANQYNCIHIAETPTMDSLKKGAPEKWRLVRAHGKAVGLPTEDDMGNSEVGHNALGAGRIFAQGAKLVDIALETGKIFDGDGFKYIKESFETGTLHLIGLLSDGGVHSRLDQLQLLLKGVSERGAKRIRCHILTDGRDVLDGTSVGFVETLENDLAKLREKGIDAQIASGGGRMYVTMDRYENDWEVVKRGWDAQVLGEAPHKFKNAVEAVKKLREIPNTNDQYLPPFVIVDDSGKAVGPIVDGDAVVTVNYRADRMVMIASSLEYEKFDKFDRVRFPKIRYAGMLQYDGELKLPSHYLVSPPEIDRTSGEYLVHNGIRTFACSETVKFGHVTFFWNGNRSGCFNPQLEEYVEIPSDSGITFNVKPKMKALEIAEKARDAILSGKFDQVRVNLPNGDMVGHTGDIEATIVACKAADEAVKMILDAVEKVGGIYVVTADHGNAEDMVKRNKKGEPLLDKNGQIQILTSHTLEPVPVAIGGPGLAPGVRFRSDVPNGGLANVAATVMNLHGFEAPSDYETTLIEVVDK

SEQ ID NO: 9014 - protein, 558 aa, Gossypium hirsutum
MASSGQVSFKLEDHPKLPKGKRIAVVVLDGWGEYKPDQYNCIHVAQTPTMDSLKQGAPDRWRLIRAHGNSVGLPTEDDMGNSEVGHNALGAGRIFAQGAKLVDLALASGKIYDGEGFKYISESFEKGTLHLIGLLSDGGVHSRLDQLQLLLKGASERGAKRIRVHVLTDGRDVLDGSSVGFVETLENDLAKLREKGVDARIASGGGRMYVTMDRYENDWDVVKRGWDAQVLGEAPHKFKNAVEAVKKLRENANDQYLPPFVIVDDNNKAVGPIVDGDAVVTINFRADRMVMLAKALEYQDFNKFDRVRVPKIRYAGMLQYDGELKLPSRYLVSPPEIDRTSGEYLVHNGVRTFACSETVKFGHVTFFWNGNRSGYFNPQMEEYVEIPSDVGITFNVQPKMKALEIGEKARDAILSGKFDQVRVNIPNGDMVGHTGDIEATVVACKAADEAVKMILDAIEQVGGIYIVTADHGNAEDMVKRNKSGEPLLDKNGDLQILTSHTCQPVPIAIGGPGLAPGVRFRSDAPNGGLANVAATVMNLHGFVAPNDYETTLIEVADN

SEQ ID NO: 9015 - protein, 560 aa, Populus trichocarpa
MGSPGQNAWKLADHPKLPKGKTIAMVVLDGWGEAKPDQYNCIHVAHTPTMDSFKTTAPEKWRLIKAHGTAVGLPSEDDMGNSEVGHNALGAGRIFAQGAKLVDLALASGKIYDGEGFKYIKECFDNGTLHLIGLLSDGGVHSRLDQLQLLLKGAVENGAKRIRVHILTDGRDVLDGSSIGFVETLEKDLSNLREKGIDAQIASGGGRMYVTMDRYENDWDVVKRGWDAQVLGEAPYKFRNAVEAVKKLREEPKANDQYLPPFVIVDESGNPVGPIKDGDAVVTFNFRADRMAMLAKALEYEDFDKFDRVRVPKIHYAGMLQYDGELKLPSHYLVSPPEIDRTSGEYLVHNGIRTFACSETVKFGHVTFFWNGNRSGYFNQEMEEYVEIPSDVGITFNVQPKMKAIEIAEKARDAILSGKFDQVRVNLPNGDMVGHTGDIEATVVACKVADDAVKMIIDAIEQVGGIFVITADHGNAEDMVKRDKSGKPLLDKNGNLQILTSHTLQPVPIAIGGPGLAPGARFRNDVPTGGLANVAATVMNLHGFEAPSDYEPTLIEVVDN

SEQ ID NO: 9016 - protein, 559 aa, Glycine max
MGSTGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKFFEGGGFKYIKESFENGTLHLIGLLSDGGVHSRLDQLQLLLKGVSERGVKRVRVHILTDGRDVLDGSSVGFVETLENDLANLREKGVDARIASGGGRMNVTMDRYENDWNVVKRGWDAQVLGEAPYKFTNALEAVKKLRAEPKANDQYLPPFVIVDESGKPVGPIVDGDAVVTFNFRADRMTMIAKALEYENFDKFDRVRFPKIRYAGMLEYDGELKLPSHYLVSPPEIDRTSGEYLVYNGIRTFACSETVKFGHVTFFWNGNRSGYFNSELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 9017 - protein, 559 aa, Triphysaria pusilla
MGSSGFSWKLKDHPKLPKGKTIAMVVLDGWGEAKPNQYNCIHVAETPTMDSLKNGAPEKWRLVKAHGKAVGLPTEDDMGNSEVGHNALGAGRIFAQGAKLVDIALETGKLYDGEGFKYIKESFETGTLHLIGLLSDGGVHSRLDQLQLLLKGVSQRGAKRIRVHILTDGRDVLDGSSVGFVETLEKDLTKLRENGIDAQIASGGGRMYVTMDRYENDWEVIKRGWDAQVLGEAPHKFKNAVEAVKKLREVPKSNDQYLPPFVIVDESGKAVGPIVDGDAVVTVNFRADRMVMAAKSLEYADFDKFDRVRVPKIRYAGMLQYDGELKLPSRYLVEPPEIERTSGEYLVNNGVRTFACSETVKFGHVTFFWNGNRSGYFNSDMEEYVEIPSDSGITFNVQPKMKALEIAEKTRDAILSGKFDQVRVNLPNSDMVGHTGDIEATVVACKAADEAVKMILDAIEQVGGIYVVTADHGNAEDMVKRDKKGEPQLDKNGQIQILTSHTLEPVPIAIGGPGLAPGVRFRKDVPNGGLANVAATVMNLHGFEAPSDYETTLIEVVEN

SEQ ID NO: 9018 - protein, 559 aa, Malus domestica
MGSSGFDWKLPDHPKLPKGKVIGLIVLDGWGEANADQYNCIHVAETPVMDSLKKGAPERWRLVRAHGTAVGLPTEDDMGNSEVGHNALGAGRIFAQGAKLVDAALASGKIFEGEGFKYVKESFETNTLHLIGLMSDGGVHSRLDQLLLLLKGASEQGAKKIRVHILTDGRDVLDGSSVGFAEILENDLAKLREKGVDAQIASGGGRMYVTMDRYENDWSVVKRGWDAQVLGEAPYKFKNAVEAIKTLRAEPNANDQYLPPFVIVDDSGKPVGPIVDGDAVVTFNFRADRMVMIAKALEYADFDKFDRVRVPKIRYAGMLQYDGELKLPSHYLVEPPEIDRTSGEYLTYNGVRTFACSETVKFGHVTFFWNGNRSGYFNDKMEEYVEIPSDSGITFNVQPKMKAVEIAEKARDAILSGKFEQVRVNLPNGDMVGHTGDIEATIVACKAADEAVKIILDAIEKVGGIYVVTADHGNAEDMVKRNKTGQPLLDKSGNIQILTSHTLQPVPIAIGGPGLVPGVHFRKDLPSGGLANVAATVMNLHGFQAPSDYEPSLIEVVDN

SEQ ID NO: 9019 - protein, 559 aa, Castanea mollissima
MGSSGFSWKLADHPKLPKGKTVAVVVLDGWGEAKPDQYNCIHVAETPTMDSLKKGDPDKWRLVKAHGSAVGLPTEDDMGNSEVGHNALGAGRIFAQGAKLVDQALESGKIYDGEGFKYISECFEKGTLHLIGLLSDGGVHSRLDQLLLLLKGSGEHGAKRIRVHILTDGRDVLDGSSVGFVETLENYLAELREKGIDAQIASGGGRMYVTMDRYENDWEVVKRGWDAQVLGEAPFKFRNAVEAVKKLRQAPKASDQYLPPFVIADDNGKPVGPIVDGDAVVTINFRADRMVMVAKAFEYEDFDKFDRVRVPKIRYAGMLQYDGELKLPSHYLVSPPEIDRTSGEYLVHNGIRTFACSETVKFGHVTFFWNGNRSGYFNEELEEYVEIPSDSGITFNVQPKMKALEIGEKVRDAILSGKFDQVRVNIPNGDMVGHTGDIEATVVACKAADEAVKMILDAIEQVGGIYVVTADHGNAEDMVKRNKTGQPLLDKTGKIQILTSHTCQPVPIAIGGPGLAPGCRFRRDVPTGGLANVAATVMNLHGFEAPSDYEPTLVEVVDI

SEQ ID NO: 9020 - protein, 555 aa, Eucalyptus grandis
MGSSWKLADHPKLPKGKTIAMVVLDGWGEAKPDQYNCIHIAETPTMDSLKEGAPEKWRLVRAHGTAVGLPTEDDMGNSEVGHNALGAGRIFAQGAKLVDLALASGKIYDGEGFTYIKDSFETGTLHLIGLLSDGGVHSRLDQVQLLVKGSAERGAKRIRVHILTDGRDVLDGSSVGFVETLENDLAELRAKGVDAQIASGGGRMYVTMDRYENDWEVVKRGWDAQVLGEAPYKFTNAVEAVKKLRQEPKANDQYLPPFVIVDDNGKAVGPIVDGDAVVTFNFRADRMVMIAKSLEYEDFDKFDRVRVPKIRYAGMLQYDGELQLPSHYLVSPPEIDRTSGEYLVHNGVRTFACSETVKFGHVTFFWNGNRSGYFNPKMEEYVEIPSDSGITFNVQPKMKAIEIAEKARDAILSGKFDQVRVNLPNSDMVGHTGDIEATIVACKAADEAVKMILDAIEQVGGIYVVTADHGNAEDMVKRNKKGEPALDKSGNIQILTSHTLEPVPVAIGGPGLAPGVRFRSDVPSGGLANVAATVMNLHGFEAPSDYETTLIEVVD

SEQ ID NO: 9021 - protein, 559 aa, Actinidia deliciosa
  misc_feature (450)..(450): Xaa can be any naturally occurring amino acid
MGSSGFSWKLEDHPKLEKGKILAMVVLDGWGEANPDQYNCIHVAETPTMDCLKKGAPDRWRLVRAHGKAVGLPTEDDMGNSEVGHNALGAGRIYAQGAKLVDLALATGKIYDGEGFNYIKESFETGTLHLIGLLSDGGVHSRLDQLQLLLKGASERGAKRIRVHILTDGRDVLDGSSVGFVETLENDLSNLREKGVDAQIASGGGRMYVTMDRYENDWDVVKRGWDAQVLGEAPHKFRSAIEAVKKLRELPKASDQYLPPFVIVDEHGTSVGPIVDGDAVVTLNFRADRMVMLAKALEYENFDKFDRVRFPKIRYAGMLQYDGELKLPSRYLVSPPEIERTSGEYLVNNGVRTFACSETVKFGHVTFFWNGNRSGYFNPEMEEYVEIPSDSGITFNVQPKMKALEIAEKARDAILSRKFHQVRVNLPNSDMVGHTGDIGATVVACKAADXAVQIILDAIEQVGGIYVVTADHGNAEDMVKRNKKGEPLLDKDGKIQILTSHTLEPVPIAIGGPGLAPGVRFRKDVPDGGLANVAATVMNLHGFNAPSDYEPTLIEVVDN

SEQ ID NO: 9022 - protein, 559 aa, Cucumis melo
MGSSGFSWKLPDHPKLPKDKIIGLIVLDGWGEANPDRYNCIHVAETPTMDSLKKGAPEHWRLLRAHGKAVGLPTEDDMGNSEVGHNALGAGRIYAQGAKLVDLALESGKIYEGEGFKYIKESFETGTLHLIGLLSDGGVHSRLDQVQLLLKGASERGAKRIRVHILTDGRDVLDGSSVGFVETLENDLAKLREKGIDAQIASGGGRMYVTMDRYENDWEVVKRGWDAQVLGEAPHKFKNALEAVKTLRAEPKANDQYLPPFVIVDDSGKSVGPIVDGDAVVTFNFRADRMVMIAKALEYENFDKFDRVRFPKIRYAGMLQYDGELKLPSHYLVSPPEIERTSGEYLVHNGVRTFACSETVKFGHVTFFWNGNRSGYFNSEMEEYVEIPSDSGITFNVQPKMKAIEIAEKARDAILSRKFHQVRVNLPNGDMVGHTGDIEATVVACKAADDAVKMILDAIEQVGGIYVVTADHGNAEDMVKRSKSGEPLLDKSGKIQILTSHTLQPVPIAIGGPGLAPGVRFRNDVPTGGLANVAATVINLHGYEAPSDYETTLIEVVDG

SEQ ID NO: 9023 - protein, 559 aa, Momordica charantia
MGSSGFSWKLPDHPKLPKDKTVALIVLDGWGEANPDRYNCIHVAETPTMDSLKKGAPEKWRLLRAHGKAVGLPTEDDMGNSEVGHNALGAGRIFAQGAKLVDLALASGKIFEGEGFKYIKESFATGTLHLIGLLSDGGVHSRLDQLQLLLKGASENGAKRIRVHILTDGRDVLDGSSIGFVETLESDLAKLREKGIDAQVASGGGRMYVTMDRYENDWEVVKRGWDAQVLGEAPHKFKSAAEAVKTLRAETKANDQYLPPFVIVDDSGKSVGPIVDGDAVVTFNFRADRMVMIAKALEYENFDKFDRVRFPKIRYAGMLQYDGELKLPSRYLVSPPEIDRTSGEYLVHNGVRTFACSETVKFGHVTFFWNGNRSGYFNSEMEEYVEIPSDSGITFNVKPKMKAIEIAEKARDAILSRKFHQVRVNLPNGDMVGHTGDIDATVVACKAADDAVKMILDAIEKVGGIYVVTADHGNAEDMVKRNKSGQPLLDKSGNIQILTSHTLEPVPVAIGGPGLAPGVRFRKDVPNGGLANVAATVINLHGYEAPSDYETTLIEVVDS

SEQ ID NO: 9024 - protein, 451 aa, Papaver somniferum
MGSAEVSFKLADHPKLPKGKVIAQIVLDGWGEANPDQFNCIHVAQTPTMDSLKQGAPEKWRLVRAHGKAVGLPTEDDMGNSEVGHNALGAGRIFAQGAKLVDIALASGKIFDGEGFQYIKESFKDGTLHLIGLLSDGGVHSRIDQVQLLLKGASERGAKRIRLHILTDGRDVLDGSSVGFVETIENDLAQLRANGVDAQIASGGGRMYVTMDRYENDWGVVKRGWDAQVLGEAPYKFKSALEAVKTLRAEPKANDQYLPPFVIVDDSGKAAGPVLDGDAVVTFNFRADRMTMLAKALEYDDFKDFDRVRFPKIRYAGMLQYDGELKLPNKYLVSPPEIDRTSGEYLVHNGVRTFACSETVKFGHVTFFWNGNRSGYFKEDMEEYVEIPSDSGITFNAQPLMKALEIGEKARDAILSGKFDQVRVNIPNSDMVGHTGDIEATVLLARLLIKL

SEQ ID NO: 9025 - protein, 559 aa, Cannabis sativa
MGSSGFNFKLADHPKLPKDKIVAMVVLDGWGEAKPDEYNCIHVAETPTMDSLKKGAPERWRLVRAHGTAVGLPTEDDMGNSEVGHNALGAGRIFAQGAKLVDSALATGKIYEGDGFKYIKESFETNTLHLIGLLSDGGVHSRLDQVQLLLKGASENGAKRIRLHILTDGRDVLDGSSVGFVETIENDLAKLRENGVDAQIASGGGRMYVTMDRYENDWEVVKRGWDAQVLGEAPYKFTNALEAVKKLRQEPNTSDQYLPPFVIVDASGKPVGPIVDGDAVVTFNFRADRMVMIAKALEYEDFDKFDRVRVPKIRYAGMLQYDGELQLPSHYLVSPPEIDRTSGEYLTHNGVRTFACSETVKFGHVTFFWNGNRSGYFNPEMEEYVEIPSDSGITFNVKPLMKAVEIAEKARDAILSRKFQQVRVNLPNGDMVGHTGDIEATVVACKAADEAVKIILDAIEQVGGIYVVTADHGNAEDMVKRNKSGKPQLDKNGKIQILTSHTLEPVPIAIGGPGLAPGVRFCNDVPSGGLANVAATVMNLHGFEAPSDYEPTLIEVVDN

SEQ ID NO: 9026 - protein, 558 aa, Gossypium hirsutum
MASSGQVSFKLEDHPKLPKGKRIAVVVLDGWGEYKPDQYNCIHVAQTPTMDSLKQGAPDRWRLIRAHGNSVGLPTEDDMGNSEVGHNALGAGRIFAQGAKLVDLALASGKIYDGEGFKYISESFEKGTLHLIGLLSDGGVHSRLDQLQLLLKGASERGAKRIRVHVLTDGRDVLDGSSVGFVEILENDLAKLRGKGVDARIASGGGRMYVTMDRYENDWDVVKRGWDAQVLGEAPHKFKNAIEAVKKLRENANDQYLPPFVIVDDNNKAVGPIVDGDAVVTINFRADRMVMLAKALEYQDFNKFDRIRVPKIRYAGMLQYDGELKLPSCYLVSPPEIDRTSGEYLVHNGVRTFACSETVKFGHVTFFWNGNRSGYFNPQMEEYVEIPSDVGITFNVQPKMKALEIGEKARDAILSGKFDQVRVNIPNGDMVGHTGDIEATVVACKAADEAVKMILDAIEQVGGIYIVTADHGNAEDMVKRNKSGEPLLDKNGDLQILTSHTCQPVPIAIGGPGLAPGVRFRSDAPNGGLANVAATVMNLHGFVAPNDYETTLIEVADN

SEQ ID NO: 9027 - protein, 559 aa, Elaeis guineensis
MDSSEFSWKLADHPKLPKGKTVAVVVLDGWGEANPDKYNCIHVAETPTMDSLKKGAPERWRLIKAHGTAVGLPTNDDMGNSEVGHNALGAGRIYAQGAKLVDLALASGKIYEGEGFKYIQECFDQGTLHLIGLLSDGGVHSRLDQLQLLLKGDSEHGAKRIRVHILTDGRDVLDGTSVGFVETLENDLSNLREKGIDAQIASGGGRMYVTMDRYENDWEVVKRGWDAHVLGEAPYKFRSALEAVKKLREDPRANDQYLPPFVIVDESGKAVGPIIDGDAVVTFNFRADRMVMIAKALEYENFDKFDRVRFPTIRYAGMLQYDGELKLPSHYLVSPPEIERTSGEYLVHNGIRTFACSETVKFGHVTFFWNGNRSGYFDPNMEEYVEIPSDIGITFNVQPKMKASEIAEKARDAILSCKFHQVRVNLPNGDMVGHTGDIEATIVGCKAADEAVKMILDAVEQVGGIYVVTADHGNAEDMVKRNKFGQPLLDKNGNVQILTSHTVQPVPIAIGGPGLAPGVRFRKDLPTAGLANVAATAMNLHGFEAPSDYEPTLIEVVDN

SEQ ID NO: 9028 - protein, 559 aa, Quercus alba
MGSSGFSWKLADHPKLPKGKTVAVVVLDGWGEAKPDQYNCIHVAETPTMDSLKKGDPDKWRLVKAHGSAVGLPTEDDMGNSEVGHNALGAGRIFAQGAKLVDLALESGKIYDGEGFKYISECFEKGTLHLIGLLSDGGVHSRLDQLLLLLKGSGERGAKRIRVHILTDGRDVLDGSSVGFVETLENYLAELRGKGVDAQIASGGGRMYVTMDRYENDWEVVKRGWDAQVLGEAPFKFRNAVEAVKQLRQAPKASDQYLPPFVIADESGKPVGPIVDGDAVVTINFRADRMVMVAKAFEYEDFDKFDRVRVPKIRYAGMLQYDGELKLPSHYLVSPPEIDRTSGEYLVHNGVRTFACSETVKFGHVTFFWNGNRSGYFNEGLEEYLEIPSDSGITFNVQPKMKALEIGEKVRDAILSGKFDQVRVNIPNGDMVGHTGDIEATVVACKAADEAVKMILDAIEQVGGIYVVTADHGNAEDMVKRNKTGQPLLDKGGKIQILTSHTCQPVPIAIGGPGLAPGCRFRRDLPTGGLANVAATVMNLHGFEPPSDYEPSLIEVVDI

SEQ ID NO: 9029 - protein, 560 aa, Populus trichocarpa
MGSAGQNAWKLADHPKLPKGKTIAMVVLDGWGEAKPDQYNCIHVADTPTMDSFKTTAPERWRLIKAHGTAVGLPSEDDMGNSEVGHNALGAGRIFAQGAKLVDLALASGKIYDGEGFNYIKQSFDNGTLHLIGLLSDGGVHSRLDQLQLLLKGAAERGAKRIRVHFLTDGRDVLDGSSVGFVETLEKDLSNLREKAVDAQIASGGGRMYVTMDRYENDWNVVKRGWDAQVLGEAPYKFRSAVEAVKKLRAEPKANDQYLPPFVIVDESGNPVGPIKDGDAVVTFNFRADRMTMLAKALEYADFDKFDRVRVPKIHYAGMLQYDGELKLPSQYLVTPPEIERTSGEYLVHNGVRTFACSETVKFGHVTFFWNGNRSGYFNEEMEEYVEIPSDVGITFNVQPKMKALEIAEKARDAILSGKFDQVRVNLPNGDMVGHTGDIEATVVACKAADGAVQTIIDAIEQVGGIYVITADHGNAEDMVKRDKSGKPLLDKSGKLQILTSHTLEPVPIAIGGPGLKAGVRFRNDVPTGGLANVAATVINLHGFEAPNDYEPTLIEVVDN

SEQ ID NO: 9030 - protein, 559 aa, Amborella trichopoda
MDSAGFSWKLADHPKLPKGKTVAVVVLDGWGEANPDKYNCIYVAKTPTMDSLKEGLPEKWRLVRAHGTAVGLPTEDDMGNSEVGHNALGAGRIYAQGAKLVDFALASGKIYEGEGFKYIKECFDKGTLHLIGLLSDGGVHSRLDQLQLLLKGASEHGAKRIRVHILTDGRDVLDGSSVGFVETLENDLAKLREKGVDAQIASGGGRMYVTMDRYENDWDVVKRGWYAHVLGEAPYKFRSALEAVKKLREDLKVSDQYLPPFVIVDESGKPVGPTMDGDAVVTFNFRADRMVMLAKALEYEDFDKFDRVRFPKIRYAGMLQYDGELMLPSQYLVSPPEIERTSGEYLVHNGIRTFACSETVKFGHVTFFWNGNRSGCFNPKLEEYVEIPSDSGITFNVQPKMKALEIAEKARDAILSGKFDQVRVNLPNSDMVGHTGDIEATVVGCEAADEAVKMILDAVEKVGGIYLVTADHGNAEDMVKRDKKGKPQLDKAGNIQILTSHTLQPVPVAIGGPGLKQGVRFRSDLPQAGLANVAATFMNFHGFVAPDDYEPTLIEVVDN

SEQ ID NO: 9031 - protein, 559 aa, Vitis vinifera
MGSSGFSWKLADHPKLPKGKILGMVVLDGWGEANPDQYNCIHVADTPTMDSLKKGAPEKWRLVKAHGSAVGLPTEDDMGNSEVGHNALGAGRIYAQGAKLVDFALDSGKIYEGEGFKYIKECFETGTLHLIGLLSDGGVHSRIDQLQLLLKGASENGAKRIRVHILTDGRDVLDGSSVGFVETLENDLAKLREKGVDAQIASGGGRMYVTMDRYENDWEVVKRGWDAQVLGEAPHKFRSAVEAVKKLREDTKASDQYIPPFVIVDENGKPVGPIVDGDAVVTFNFRADRMVMIAKSLEYEDFDKFDRVRFPKIHYAGMLQYDGELKLPNHYLVSPPEIERTSGEYLVHNGVRTFACSETVKFGHVTFFWNGNRSGYFDPSMEEYVEIPSDSGITFNVKPKMKAVEIAEKARDAILSRKFHQVRVNLPNGDMVGHTGDIEATIVACKAADEAVKIILDAIEQVGGIYVVTADHGNAEDMVKRNKSGQPLLDKTGKIQILTSHTLQPVPIAIGGPGLAAGVRFRNDVPGGGLANVAATVMNLHGYEAPSDYEPTLIEVIDN

SEQ ID NO: 9032 - protein, 556 aa, Quercus alba
MGSSWKLADHPKLPKGKTVAVVVLDGWGEAKPDQYNCIHVAETPTMDSLKKGDPDKWRLVKAHGSAVGLPTEDDMGNSEVGHNALGAGRIFAQGAKLVDLALESGKLYDGEGFKYISECFEKGTLHLIGLLSDGGVHSRLDQLLLLLKGSSERGAKRIRVHILTDGRDVLDGSSVGFVETLENYLAELRGKGVDAQIASGGGRMYVTMDRYENDWEVVKRGWDAQVLGEAPFKFRNAVEGVKQLRQAPKASDQYLPPFVIADESGKPVGPIVDGDAVVTINFRADRMVMVAKAFEYEDFDKFDRVRVPKIRYAGMLQYDGELKLPSHYLVSPPEIDRTSGEYLVHNGIRTFACSETVKFGHVTFFWNGNRSGYFNEELEEYVEIPSDSGITFNVQPKMKALEIGEKVRDAILSGKFDQVRVNIPNGDMVGHTGDIEATVVACKAADEAVKMILDAIEQVGGIYVVTADHGNAEDMVKRNKTGQPQLDKGGKIQILTSHTCQPVPIAIGGPGLAPGCRFRRDIPTGGLANVAATVMNLHGFEAPGDYEPTLIEVVDI

SEQ ID NO: 9033 - protein, 558 aa, Trigonella foenum-graecum
MGSTDFSWKLPDHPKLPKGKTIAVVVLDGWGEANPNEYNCIHIAETPTMDSLKKGAPEHWRLVRAHGKAVGLPTEDDMGNSEVGHNALGAGRIFAQGAKLVDIALETGKIFEGDGFNYIKESFETGTLHLIGLLSDGGVHSRLDQVQLLLKGASERGVKRIRLHILTDGRDVLDGSSVGFVETLENDLAKLREKGIDAKIASGGGRMNVTMDRYENDWGVVKRGWDAQVLGEAPFKFTNALEAVKTLRAEPKANDQYLPPFVIVDENGKSVGPIVDGDAVVTFNFRADRMTMLAKALEYENFDNFDRVRVPKIRYAGMLEYDGELKLPRHYLVSPPEIDRTSGEYLVKNGVRTFACSETVKFGHVTFFWNGNRSGYFNDKLEEYVEIPSDSGITFNEQPLMKAVEIAEKARDAILSGKFDQIRVNLPNGDMVGHTGDIEATIVACKAADQAVKIILDAIEQVGGIYVVTADHGNAEDMVKRDKSGKPQLKDGKVQILTSHTLEPVPIAIGGPGLAPGVRFRNDVPTGGLANVAATVMNLHGFEAPSDYETTLIEVVDK

SEQ ID NO: 9034 - protein, 165 aa, Phalaenopsis aphrodite
MGSFDFSWKLADHPKLPKGKTVAVVVLDGWGEAKPDEYNCIHTAKTPTMDSLKTGAPEKWRLVRAHGTAVGLPTEDDMGNSEVGHNALGAGRIFAQGAKLVDLALASGKIYEGDGFKYIKESFDKGTLHLIGLLSDGGVHSRLDQLQLLLKGASENGAKRIRVHF

SEQ ID NO: 9035 - protein, 559 aa, Tropaeolum majus
MGSSGVNWKLADHPKLPKDKILAMIVLDGWGEANPDKYNCIHVAETPVMDSLKNGAPDKWRLIKAHGTAVGLPTEDDMGNSEVGHNALGAGRIYAQGAKLVDIALASEKIYDEDGFKYISESFESGTLHLISLLSDGGVHSRIDQLQLLLKGASERGAKRIRVHILTDGRDVLDGSSVGFAETLESDLAKLRENGIDAQVASGGGRMYVTMDRYENDWSVVKRGWDAQVLGEAPYKFKSAVEAIKTLRQEPKANDQYLPPFVIVDDSGKAVGPIVDGDAVVTMNFRADRMVMLAKALEYENFNNFDRVRFPKIRYAGMLQYDGELKLPSRYLVSPPLIERTSGEYLVHNGVRTFACSETVKFGHVTFFWNGNRSGYFKEDMEEYVEIPSDSGITFNVKPKMKALEIAEKARDAILSRKFQQVRVNLPNSDMVGHTGDIEATVVACKAADEAVKMIIDAIEQVSGIYVVTADHGNAEDMVKRDKAGKPAMDKSGNIQILTSHTLQPVPVAIGGPGLASGVRFRKDVPTGGLANVAATVMNLHGYIAPDDYETTLIEVVDA

SEQ ID NO: 9036 - protein, 559 aa, Amorphophallus konjac
MGSSGFSWKLADHPKLPKGKTIGLIVLDGWGEANPDKYNCIHVAETPTMDSLKKGAPEKWRLIRAHGMAVGLPTEDDMGNSEVGHNALGAGRIFSQGAKLVDHALASGKIYEGEGFKYIKECFDQGTLHLLGLLSDGGVHSRLDQLQLLLKGASENGAKRIRVHVLTDGRDVIDGTSVGFVETLENDLVKLREKGVDAKIASGGGRMYVTMDRYENDWDVIKRGWDAQVLGEAPHKFRSAVEAVKKLREAPKANDQYLPPFVIVDESGKAVGPIVDGDAVVTFNFRADRMVMVAKAFEYEKFDKFDRVRVPKIHYAGMLQYDGELKLPSHYLVAPPEIERTSGEYLVHNGVRTFACSETVKFGHVTFFWNGNRSGYFDPSMEEYVEIPSDVGITFNVQPNMKAVEIAEKARDAILSRKYDQVRVNLPNGDMVGHTGDIEATIVACKAADEAVKMILDAIEQVGGIYVVTADHGNAEDMVKRNKSGQPLLDKSGNIQILTSHTLQPVPIAIGGPGLAPGVRFRNDLPAGGLANVAATVMNLHGFEAPSDYEPTLIEVVDN

SEQ ID NO: 9037 - protein, 559 aa, Amorphophallus konjac
MGSSDFSWKLADHRQLPKGKTIAVVVLDGWGEANGDQYNCIHVAETPTMDSLKQGAPEKWRLIRAHGMAVGLPTEDDMGNSEVGHNALGAGRIYAQGAKLVDFALASGKIYEGEGFKYIKECFDQGTLHLIGLLSDGGVHSRLDQLQLLLKGARENGAKRIRVHILTDGRDVLDGSSVGFVETLENDLAKLREKGVDARIASGGGRMYVTMDRYENDWDVVKRGWDAQVLGEAPYKFQNAVEAVKKLREDPKANDQYLPPFVIVDESGKAVGPIVDGDAVVTFNFRADRMVMVAKAFEYENFDKFDRVRFPKVHYAGMLQYDGELKLPSHYLVDPPEIERTSGEYLVHNGVRTFACSETVKFGHVTFFWNGNRSGYFDPSMEEYVEIPSDSGITFNVQPKMKAVEIAEKARDAILSGKFQQVRVNLPNGDMVGHTGDIDATIVACKAADEAVKMILDAIEQVGGIYVVTADHGNAEDMVKRNKKGQPLLDKNGKIQILTSHTLQPVPIAIGGPGLAPGVRLRTDVPDGGLANVAATVMNLHGFEAPSDYEPTLIEVVDN

SEQ ID NO: 9038 - protein, 556 aa, Quercus alba
MGSSWKLADHPKLPKGKTVAVVVLDGWGEAKPDQYNCIHVAETPTMDSLKKGDPDKWRLVKAHGSAVGLPTEDDMGNSEVGHNALGAGRIFAQGAKLVDLALESGKLYDGEGFKYISECFEKGTLHLIGLLSDGGVHSRLDQLLLLLKGSSERGAKRIRVHILTDGRDVLDGSSVGFVESLENYLAELRGKGVDAQIASGGGRMYVTMDRYENDWEVVKRGWDAQVLGEAPFKFRNAVEGVKQLRQAPKASDQYLPPFVIADESGKPVGPIVDGDAVVTINFRADRMVMVAKAFEYEDFDKFDRVRVPKIRYAGMLQYDGELKLPSHYLVSPPEIDRTSGEYLVHNGIRTFACSETVKFGHVTFFWNGNRSGYFNEELEEYVEIPSDSGITFNVQPKMKALEIGEKVRDAILSGKFDQVRVNIPNGDMVGHTGDIEATVVACKAADEAVKMILDAIEQVGGIYVVTADHGNAEDMVKRNKTGQPQLDKGGKIQILTSHTCQPVPIAIGGPGLAPGCRFRRDIPTGGLANVAATVMNLHGFEAPGDYEPTLIEVVDI

SEQ ID NO: 9039 - protein, 559 aa, Orobanche aegyptiaca
MGSTGFSWKLKDHTKLSKGKTIAMVVLDGWGEAKPNQYNCIHVAETPTMDSLKNGAPDRWRLVKAHGKAVGLPTDDDMGNSEVGHNALGAGRIYAQGAKLVDIALETGKIFDGEGFNYVKQSFETGTLHLIGLLSDGGVHSRLDQLQLLLKGASEHGAKRIRVHILTDGRDVLDGSSVGFVETLEKDLANLREKGVDARIASGGGRMNVTMDRYENDWDVVKRGWDAQVLGEAPHKFKCAVEAVKKLREIPKMNDQYLPPFVIVDESGKAVGPIVDGDAVVTFNFRADRMVMIAKSLEYEDFAKFDRVRVPKIRYAGMLQYDGELKLPSHYLVSPPEIERTSGEYLVNNGVRTFACSETVKFGHVTFFWNGNRSGYFNKDMEEYVEIPSDSGITFNVQPKMKALEIAEKARDAILSRKFDQVRVNLPNGDMVGHTGDIEATVVACKVADEAVKMILDAIEQVGGIYVVTADHGNAEDMVKRNKKGEPELDKNGKIQILTSHTLEPVPIAIGGPGLAPGVRFRKDVPHGGLANVAATVMNLHGFEAPSDYEPTLIEVVDI

SEQ ID NO: 9040 - protein, 558 aa, Fragaria vesca
MGSTGDWKLADHPKLPKGKTIALIVLDGWGEAEADQYNCIHVAETPTMDSLKNGKPDKWRLVRAHGTAVGLPTEDDMGNSEVGHNALGAGRIFAQGAKLVDQALESGKIYQGEGFKYIKEVFGTGTLHLIGLLSDGGVHSRLDQVQLLLKGVAEHGAKRIRLHVLTDGRDVLDGSSVTFAETLEEDLAKLREKGVDAQIASGGGRMYVTMDRYENDWSVVKRGWDAQVLGEAPYKFKSAVEAIKTLRAEPKANDQYLPPFVIVDDSGKPVGPIVDGDAVVTFNFRADRMVMAAKAFEYADFDKFDRVRVPKIRYAGMLQYDGELKLPNRYLVEPPEIDRTSGEYLTYNGVRTFACSETVKFGHVTFFWNGNRSGYFNPEMEEYVEIPSDSGISFNVQPKMKAVEIAEKARDAILSKKFEQVRVNLPNGDMVGHTGDIEATVVACKAADEAVKIILDAVEQVGGIYVVTADHGNAEDMVKRNKTGQPALDKSGKIQILTSHTLQPVPIAIGGPGLSPGVRFRRDLPSGGLANVAATMINLHGFEAPADYEPSLIEVVDN

SEQ ID NO: 9041 - protein, 559 aa, Malus domestica
MGSSGIDWKLPDHPKLPKGKVIGLIVLDGWGEANADQYNCIHVAETPVMDSLKKGAPERWRLVRAHGTAVGLPTEDDMGNSEVGHNALGAGRIFAQGAKLVDAALASGKMFEGEGFKYIKESFATNTLHLIGLMSDGGVHSRLDQLLLLLKGASEQGAKRIRVHVLTDGRDVLDGSSVGFAEILENDLAKLREKGVDAQVASGGGRMYVTMDRYENDWSVVKRGWDAQVLGEAPYKFKNVVEAIKTLRAEPKANDQYLPPFVIVDDSGKPVGPIVDGDAVVTFNFRADRMVMLAKALEYADFDKFDRVRVPKIRYAGMLQYDGELKLPSKYLVEPPEIDRTSGEYLTYNGVRTFACSETVKFGHVTFFWNGNRSGYFNDKMEEYVEIPSDSGITFNVQPKMKAIEIAEKARDAILSGKFEQVRVNLPNSDMVGHTGDIDATVVACKAADEAVKIIFDAIEKAGGIYVVTADHGNAEDMVKRNKTGQPLLDKNGNIQILTSHTLQPVPIAIGGPGLAPGVRFRKDLPSGGLANVAATVMNLHGFQAPSDYEPSLIEVVDN

SEQ ID NO: 9042 - protein, 556 aa, Medicago truncatula
MGSTDFSWKLPDHPKLPKGKTVAVIVLDGWGEANANEYNCIHNAETPTMDSLKQGAPEHWRLVRAHGKAVGLPTEDDMGNSEVGHNALGAGRIFAQGAKLVDIALETGKIFEGDGFNYIKESFETGTLHLIGLLSDGGVHSRLDQVQLLLKGASERGVKRVRLHILTDGRDVLDGSSVGFVETLENDLAKLREKGIDAQIASGGGRMNVTMDRYENDWGVVKRGWDAQVLGEAPHKFTNALEAIKTLRAAPKANDQYLPPFVIVDESGKSVGPIVDGDAVVTFNFRADRMTMLAKALEYEKFDNFDRVRVPKIRYAGMLEYDGELKLPKHYLVSPPEIDRTSGEYLVKNGVRTFACSETVKFGHVTFFWNGNRSGYFDEKLEEYVEIPSDSGITFNEQPLMKALEIGEKARDAILSGKFDQIRVNIPNGDMVGHTGDIEATVVACKAADKAVKMILDAIEQVGGIYVVTADHGNAEDMVKRDKAGKPLLKDGKVQILTSHTLEPVPIAIGGPGLTPGVRFRNDVPTGGLANVAATVMNLHGFEAPSDYETTLIEVV

SEQ ID NO: 9043 - protein, 558 aa, Phaseolus coccineus
MGSSGVSWKLADHPKLPKGKTVAVVVLDGWGEAKPNEYNCIATAETPCMDSLKKGAPELWRLVRAHGTAVGLPTEDDMGNSEVGHNALGAGRIFAQGAKLVDIALATGKFFEGEGFNYIKESFANGTLHLIGLLSDGGVHSRLDQLQLLLKGVGERGVKRVRVHILTDGRDVLDGSSVEFVETLENDLAKLQEKGIDAKIASGGGRMNVSMDRYENDWNVVKRGWDAQVLGEAPYKFTNALEAVKKLRAEPKANDQYLPPFVIVDESGKPVGPIVDGDAVVTFNFRADRMVMIAKSLEYENFDKFDRVRVPKIRYAGMLEYDGELKLPSHYLVSPPEIDRTSGEYLVKNGIRTFACSETVKFGHVTFFWNGNRSGYFNAELEKYVEIPSDSGITFNEKPNMKALQIAEKARDAILSRNFDQVRVNLPNGDMVGHTGDIEATVVACKAADEAVKIILDAIEQVGGIYVVTADHGNAEDMVKRDKSGKPVLKDGKVQILTSHTLEPVPIAIGGPGLSSGVRFRNDVPSGGLANVAATVINLHGFEAPSDYEQTLIEVVDK

SEQ ID NO: 9044 - protein, 556 aa, Fagus grandifolia
MGSSWKLADHPKLPKGKTVAMIVLDGWGEAKPDQYNCIHVAETPTMDSLKQGNPDTWRLVRAHGTAVGLPTEDDMGNSEVGHNALGAGRIFAQGAKLVDQALASGKIYGGEGFKYISQSFETGTLHLIGLLSDGGVHSRLDQLQLLLKGASEHGAKRIRVHILTDGRDVLDGSSVGFVETLEQDLAKLREKGVDAQVASGGGRMYVTMDRYENDWEVVKRGWDAQVLGEAPHKFRNPVEAVKKLREVPKSNDQYLPPFVIVDENGKPVGPIVDGDAVVTINFRADRMVMIAKALEYENFDKFDRVRVPKIRYAGMLQYDGELLLPKHYLVSPPEIERTSGEYLVHNGIRTFACSETVKFGHVTFFWNGNRSGCFNAELEEYVEIPSDSGITFNVQPKMKALEIGEKARDAILSRKFDQVRVNIPNSDMVGHTGDIEATVVACKAADEAVKMILDAIEQVGGIYVVTADHGNAEDMVKRNKSGQPLLDKNGNIQILTSHTLQPVPIAIGGPGLAPGVRFRKDVPTGGLANVAATVMNLHGFEAPSDYETTLIEVVDK

SEQ ID NO: 9045 - protein, 560 aa, Arabidopsis lyrata
MGSSGDVNWKLADHPKLPKGKTIGLIVLDGWGESDPDQYNCIHKAPTPAMDSLKNGRPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLADLRSKGVDAQVASGGGRMYVTMDRYENDWSVVKRGWDAQVLGEAPHKFKSALEAVKTLRAEPGANDQYLPPFVIVDDSGKAVGPIVDGDAVVTFNFRADRMVMHAKALEYEDFDKFDRVRVPKIRYAGMLQYDGELKLPSRYLVSPPLIDRTSGEYLAHNGVRTFACSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPNDYEPSLIEVVDK

SEQ ID NO: 9046 - protein, 561 aa, Cleome gynandra
MGSSAVDVNWKLEDHPKLPKGKPIAVIVLDGWGESDPDQYNCIHKAPTPAMDSLKNGAPEHWRLIKAHGTAVGLPSEDDMGNSEVGHNALGAGRIFAQGAKLVDIALETGKIFDGEGFKYISESFDKGTLHLIGLLSDGGVHSRLDQLQLLLKGTADRGAKKIRVHILTDGRDVLDGSSVGFLETLENDLAKLRENGVDARIASGGGRMYVTMDRYENDWDVVKRGWDAQVLGEAPHKFKNAVEAVKKLREDTGCNDQYLPPFVIVDDSGKAVGPIVDGDAVVTFNFRADRMVMLAKALEYENFDIFDRVRFPKIRYAGMLQYDGELKLPSRYLVSPPEIDRTSGEYLVHNGIRTFACSETVKFGHVTFFWNGNRSGYFNNDLEEYVEIPSDSGISFNVKPKMKALEIAEKARDAILSGKFDQVRVNLPNGDMVGHTGDIEATVVACEAADVAVKMILDAIEQVGGIYVVTADHGNAEDMVKRDKHGKPLLSKDGNLQILTSHTLKPVPIAIGGPGLSAGVRFRKDLPTGGLANVAATVMNLHGFVAPSDYEPTLVEVAEN

SEQ ID NO: 9047 - protein, 558 aa, Valeriana officinalis
MGSTGFSWKLEDHPKLPKDKVVAVIVLDGWGEAKDNQYNCISVAETPTMDSLKKGAPERWRLVRAHGTAVGLPTEDDMGNSEVGHNALGAGRIFAQGAKLVDLALESGKIFEGEGFKYIKESFGTGTLHLVGLLSDGGVHSRIDQLQLLLKGASEHGAKRIRLHILTDGRDVLDGSSVGFVETIEQDLFELRAKGVDAQIASGGGRMYVTMDRYENDWEVVKRGWDAQVLGEAPYKFKSALEAVKELRAAPKANDQYLPPFVIVDENDKAVGPIVDGDAVVTINFRADRMVMAAKAFEYEDFDKFDRVRVPKIRYAGMLQYDGELKLPNKYLVEPPEIERTSGEYLTYNGVRTFACSETVKFGHVTFFWNGNRSGYFNPEMEEYVEVPSDSGITFNVKPIMKAVEIAEKARDAILSGKFQQVRVNLPNGDMVGHTGDIDATVVACKAADKAVKMILDAVEQVGGIYVVTADHGNAEDMVKRNKKGEPELKNGKIQILTSHTLEPVPIAIGGPGLLPGVRYRTDVPSGGLANVAATVMNLHGFVAPSDYETTLIEVVDT

SEQ ID NO: 9048 - protein, 560 aa, Eutrema parvulum
MGSSGDVNWKLEDHPKLPKRKTIGLIVLDGWGESEPDQYNCIHKAPTPAMDSLKNGRPDTWRLIKAHGTAVGLPSEDDMGNSEVGHNALGAGRIYAQGAKLVDLALASGKIYEDEGFKYISESFEKGTVHLIGLLSDGGVHSRLDQVQLLLKGFSERGAKRIRVHILTDGRDVLDGSSVGFVETLEGDLAELRSKGVDAQIASGGGRMYVTMDRYENDWTVVKRGWDAQVLGEAPHKFKNALEAVKTLRAEPGANDQYLPPFVIVDDSGKAVGPIVDGDAVVTFNFRADRMVMHAKALEYEDFDKFDRVRVPKIRYAGMLQYDGELKLPSHYLVSPPLIDRTSGEYLAHNGIRTFACSETVKFGHVTFFWNGNRSGYFNEKLEEYVEIPSDSGISFNVQPKMKALEIAEKARDAILSGKFDQVRVNLPNGDMVGHTGDIQATVVACEAADVAVRMILDAIEQVGGIYVVTADHGNAEDMVKRDKAGKPALDKEGNLQILTSHTLKPVPIAIGGPGLSAGVRFRQDLETPGLANVAATVMNLHGFVAPGDYEPSLIEVVDK

SEQ ID NO: 9049 - protein, 560 aa, Tropaeolum majus
MGCSGEMNWKLADHPKLPKDKIVAMVVLDGWGEAKPDQYNCIHVADTPVMDFLKKGAPDKWRLVKAHGTAVGLPTEDDMGNSEVGHNALGAGRIFAQGAKLVDLALASGKIYDDEGFKYISESFEKGTLHLIGLLSDGGVHSRNDQLQLLLKGASDRGAKRIRVHILTDGRDVLDGSSVGFAESLVNDLAKLREKGVDAQVASGGGRMYVTMDRYENDWSVVKRGWDAQVLGEAPHKFKNAVEAIKKLREEPNANDQYLPPFVIVDDNGKAVGPIVDGDAVVTFNFRADRMVMIAMALEYENFNKFDRVRFPKIRYAGMLQYDGELKLPSHYLVSPPEIERTSGEYLVYNGVRTFACSETVKFGHVTFFWNGNRSGYFKEDMEEYVEIPSDSGITFNVQPKMKALEIAEKARDAILSRKFHQVRVNLPNGDMVGHTGDIEATIVACKAADEAVKMIVDAIEQVGGIYVVTADHGNAEDMVKRDKSGKPLVDKNGNIQILTSHTLQPVPIAIGGPGLASGVRFRKDVATGGLANVAATVMNLHGFIAPDDYEPTLIEVVDN

SEQ ID NO: 9050 - protein, 62 aa, Lippia dulcis
MGSSGFSWKLKDHPKLPKGKTIAMVVLDGWGEAKANKYNCVHVAETPTWIHLKMGRLIDGDW

SEQ ID NO: 9051 - protein, 559 aa, Prunus persica
MGTSGFNWKLADHPKLPKGKTIGLIVLDGWGEANPDQYNCIHVAETPVMDSFKKGAPERWRLVRAHGTAVGLPTEDDMGNSEVGHNALGAGRIFAQGAKLVDSALETGKLYEGEGFKYIKESFPTNTLHLIGLLSDGGVHSRLDQLLLLVKGASERGAKRIRVHILTDGRDVLDGSSVGFAETLENYLAQLREKGVDAQIASGGGRMYVTMDRYENDWGVVKRGWDAQVLGEAPHKFKNAVEAIKTLRQEPNTSDQYLPPFVIVDENGKPVGPIVDGDAVVTFNFRADRMVMIAKALEYADFDKFDRVRFPKIRYAGMLQYDGELKLPSKYLVEPPEIDRTSGEYLTYNGVRTFACSETVKFGHVTFFWNGNRSGYFNPQMEEYVEIPSDSGITFNVQPKMKAVEIAEKARDAILSKKFEQVRVNLPNSDMVGHTGDIEATVVACKAADEAVKIIIDAIEQVGGIYVVTADHGNAEDMVKRNKKGQPLLDKNGNIQILTSHTLQPVPIAIGGPGLAPGVQFRKDVPNGGLANVAATVMNLHGFEAPADYETTLIEVVDN

SEQ ID NO: 9052 - protein, 560 aa, Tropaeolum majus
MGCSGEMNWKLADHPKLPKDKIVAMVVLDGWGEAKPDQYNCIHVADTPVMDFLKKGAPDKWRLVKAHGTAVGLPTEDDMGNSEVGHNALGAGRIFAQGAKLVDLALASGKIYDDEGFKYISESFEKGTLHLIGLLSDGGVHSRIDQLQLLLKGASDRGAKRIRVHILTDGRDVLDGSSVGFAESLVNDLAKLREKGVDAQVASGGGRMYVTMDRYENDWSVVKRGWDAQVLGEAPHKFKNVVEAIKKLREEPNANDQYLPPFVIVDDNGKAVGPIVDGDAVVTFNFRADRMVMIAMALEYENFNKFDRVRFPKIRYAGMLQYDGELKLPSHYLVSPPEIERTSGEYLVYNGVRTFACSETVKFGHVTFFWNGNRSGYFKEDMEEYVEIPSDSGITFNVQPKMKALEIAEKARDAILSRKFHQVRVNLPNGDMVGHTGDIEATIVACKAADEAVKMIVDAIEQVGGIYVVTADHGNAEDMVKRDKSGKPLVDKNGNIQILTSHTLQPVPIAIGGPGLASGVRFRKDVATGGLANVAATVMNLHGFIAPDDYEPTLIEVVDN

SEQ ID NO: 9053 - protein, 558 aa, Theobroma cacao
MRSSGQVSWRLEDHPKLPKGKTVAVVVLDGWGENKPDEFNCIHVAQTPTMDSLKQGAPEKWRLIRAHGTAVGLPTEDDMGNSEVGHNALGAGRIYAQGAKLVDLALASGKIYEGEGFKYISESFEKGTLHLIGLLSDGGVHSRLDQLQLLLKGASDHGAKRIRVHVLTDGRDVLDGSSIGFVETLENDLAKLREKGVDAQIASGGGRMYVTMDRYENDWNVVKRGWDAQVLGEAPHKFTNAVEAVKKLRENANDQYLPPFVIVDENKKAVGPIVDGDAVVTFNFRADRMVMLAKALEYEDFDKFDRVRFPKIRYAGMLQYDGELKLPSCYLVSPPEIERTSGEYLVHNGIRTFACSETVKFGHVTFFWNGNRSGYFKPEMEEYVEIPSDIGITFNVQPKMKALEIGEKARDAILSGKFDQVRVNIPNSDMVGHTGDIQATVVACKAADEAVKMILDAIEQVGGIYVVTADHGNAEDMVKRSKSGQPLYDKNGNLQILTSHTCQPVPIAIGGPGVAPGVRFRKDVPDGGLANVAATVMNLHGLVAPNDYEPTLIEVVDN

SEQ ID NO: 9054 - protein, 560 aa, Manihot esculenta
MGSSGEFTWKLADHPKLPKGKTIAMVVLDGWGEAKPDQYNCIHVADTPTMDSFKKTAPEKWRLIRAHGTAVGLPTEDDMGNSEVGHNALGAGRIYAQGAKLVDLALASGKIFDGEGFKYIKECFATGTLHLIGLLSDGGVHSRLDQLQLLLKGAAEHGAKRIRVHVLTDGRDVIDGTSVGFVEALENDLANLRGKGVDAQIASGGGRMYVTMDRYENDWNVVKRGWDAQVLGEAPHKFKNAVEAVKKLREEPKANDQYLPPFVIVDESGKPVGPIVDGDAVVTFNFRADRMVMLAKALEYENFDKFDRVRFPKIRYAGMLQYDGELKLPSHYLVSPPEIERTSGEYLVHNGVRTFACSETVKFGHVTFFWNGNRSGYFNAEMEEYVEIPSDVGITFNVQPKMKAIEIAEKARDAILSLKFHQVRVNLPNSDMVGHTGDIDATVVACKAADDAVKMIIDAIEQVGGIYVVTADHGNAEDMVKRDKSGKPLLDKSGNIQILTSHTLQPVPIAIGGPGLAAGVRFRNDVPSGGLANVAATVMNLHGFEAPSDYETTLIEVVDN

SEQ ID NO: 9055 - protein, 562 aa, Cleome spinosa
MGSSTGDVNNWKLEDHPKLPKGKPIAVIVLDGWGESDPDQYNCIHKAPTPAMDSLKNGAPDRWRLIKAHGGAVGLPSEDDMGNSEVGHNALGAGRIFAQGAKLVDTALASGKIFDGEGFKFISESFDKGTLHLIGLLSDGGVHSRLDQLQLLLKGSVERGAKRIRVHILTDGRDVIDGTSVGFVETLENDLVKLRENGVDARIASGGGRMYVTMDRYENDWSVVKRGWDAQVLGEAPHKFKSAVEAVKRLREDTGCNDQYLPPFVIVDDSGKAVGPIVDGDAVVTFNYRADRMVMLAKALEYENFDIFDRVRFPKIRYAGMLQYDGELKLPSRYLVSPPEIDRTSGEYLVHNGIRTFACSETVKFGHVTFFWNGNRSGYFDKNLEEYVEIPSDSGISFNVKPKMKAVEIAEKARDAILSGKFDQVRVNLPNGDMVGHTGDIEATVVACETADVAVKMILDAIEQVGGIYVVTADHGNAEDMVKRDKAGKPLLAKDGSLQILTSHTLKPVPIAIGGPGLSAGVRFRKDVPTGGLANVAATVMNLHGFVAPSDYEPTLIEVADN

SEQ ID NO: 9056 - protein, 557 aa, Silene vulgaris
MGSSWKLADHPKLPKDKIIAMIVLDGWGEANPNQYNCIHVAETPTMDSLKQGAPDKWRLIRAHGKAVGLPTEDDMGNSEVGHNALGAGRIFAQGAKLVDLALASGKIFDGAGFNYIKESFETNTLHLIGLLSDGGVHSRLDQLQLLLKGASERGAKKIRVHILTDGRDVLDGSSIGFAETLEKDLSDLREKGIDAQIASGGGRMYVTMDRYENDWEVVKRGWDAQVLGEAPYKFKNGVEAIKTLRSQQSKADDQYLPPFVIVDDNGKAVGPIVDGDAVVTMNFRADRMVMMAKALEYKDFDKFDRVRVPKIRYAGMLEYDGELKLPSHYLVSPPEIDRTSGEYLTYNGVRTFACSETVKFGHVTFFWNGNRSGYFNSEMEEYVEIPSDSGITFNVQPKMKAVEIAEKARDAILSRKFQQVRVNLPNSDMVGHTGDIEATVVACKAADEAVKIMIDAIEQVGGIYVVTADHGNAEDMVKRDKKGQPQLDKAGKIQILTSHTLEPVPIAIGGPGLASGVRFRKDVPTGGLANVAATVMNLHGFEAPSDYEPTLIEVVDN

SEQ ID NO: 9057 - protein, 558 aa, Catharanthus roseus
MGSSGFSWKLNDHPKLPKGKIIAMIVLDGWGEAKPNEYNCIHVAETPTMDSFKKGAPEKWRLVKAHGKAVGLPTDDDMGNSEVGHNALGAGRIYAQGAKLVDLALESGKIYEDEGFNYIKECFETGTLHLIGLLSDGGVHSRLDQLQLLLKGASERGAKRIRVHALTDGRDVLDGSSVGFMETLENDLAKLREKGIDAQVASGGGRMYVTMDRYENDWEVVKRGWDAQVLGEAPHKFRNGVEAVKKLREAPQSNDQYLPPFVIVDENGKPVGPIVDGDAVVTFNFRADRMVMLAKALEYEDFDKFDRVRVPKIRYAGMLQYDGELKLPSHYLVSPPLIERTSGEYLVHNGVRTFACSETVKFGHVTFFWNGNRSGYFNQEMEEYVEIPSDSGITFNVQPKMKALEIAEKARDAILSRKFHQVRVNLPNGDMVGHTGDIQATVVACKAADEAVKMIIDAIEQVGGIYVVTADHGNAEDMVKRNKKGEPLLDKNGNIQILTSHTLEPVPIAIGGAGLEPGVRFRQDLPGGGLANVAATVMNLHGFEAPNDYEPTLIEVVD

SEQ ID NO: 9058 - protein, 559 aa, Mimulus guttatus
MGSSGFSWKLKDHPKLAKGKTIAMIVLDGWGEAKPNQYNCIHVAETPTMDSLKNGAPDKWRLVKAHGKAVGLPTDDDMGNSEVGHNALGAGRIYAQGAKLVDSALDTGKIYDGEGFNYIKASFESGTLHLIGLLSDGGVHSRLNQLQLLLKGASERGAKRIRVHVLTDGRDVLDGTSVAYVETLEEDLAKLRENGVDAQIASGGGRMYVTMDRYENDWEVVKRGWDAQVLGEAPYKFKSAVEAVKKLREIPNTSDQYLPPFVIVDDSGKSVGPIVDGDAVVTFNFRADRMSMVAQALEYEKFDKFDRVRFPKIRYAGMLQYDGELKLPNHYLVSPPEMERTSGEYLVHNGVRTFACSETVKFGHVTFFWNGNRSGYFNADMEEYVEIPSDSGITFNVKPKMKALQIGEKARDAILSGKFDQVRVNLPNSDMVGHTGDIDATVVACKAADEAVKMILDAIEQVGGIYVVTADHGNAEDMVKRNKKGEPLLDKNGNIQILTSHTLEPVPIAIGGPGLAAGVKFRKDVPNGGLANVAATVMNLHGFVAPDDYETTLIEVVDV

SEQ ID NO: 9059 - protein, 556 aa, Arachis hypogaea
MPSGNWLITQSCQRELKPVAVVVLDGWGEANADQYNCIHTAETPTMDSLKKGAPERWRLVRAHGTAVGLPTEDDMGNSEVGHNALGAGRIFAQGAKLVDLALESGKIYEGEGFKYIQESFANGTLHLIGLLSDGGVHSRLDQLQLLLKGVSERGVKRVRVHILTDGRDVLDGSSVGFVETLENDLAKLREKGIDARIASGGGRMHVTMDRYENDWNVVKRGWDAQVLGEAPHKFKSALEAVKKLRAEPKANDQYLPPFVIVDDNGKAVGPIVDGDAVVTFNFRADRMVMIAKSLEYEDFDKFDRVRFPKIRYAGMLQYDGELKLPSHYLVSPPEIDRTSGEFLVHNGVRTFACSETVKFGHVTFFWNGNRSGYFNRQLEEYVEIPSDIGITFNVQPKMKALEIAEKARDAILSRKFDQIRVNLPNGDMVGHTGDIEATVVACKAADEAVKMILDAIEQVGGIYVVTADHGNAEDMVKRDKSGKPLLDKEGKIQILTSHTLQPVPIAIGGPGLAPGVRFRNDVPDGGLANVAATVMNLHGFVAPSDYETTLIEVVDK

SEQ ID NO: 9060 - protein, 559 aa, Cicer arietinum
MGSSGFSWKLPDHPKLPKGKPIAVIVLDGWGEAKENEYNCIHIAETPTMDSLKKGAPEHWRLVRAHGKAVGLPTEDDMGNSEVGHNALGAGRIFAQGAKLVDLALESGKIFDGEGFNYIKESFETGTVHLIGLLSDGGVHSRLDQVQLLLKGLSERGVKRVRLHILTDGRDVLDGSSVGFVETLENDLANLREKGIDARIASGGGRMYVTMDRYENDWSVVKRGWDAQVLGEAPYKFTNAVEAVKKLRAEPKANDQYLPPFVIVDESGKSVGPIVDGDAVVTFNFRADRMTMLAKALENENFDKFDRVRFPKIRYAGMLEYDGELKLPRHYLVSPPEIDRTSGEYLVHNGVRTFACSETVKFGHVTFFWNGNRSGYFNSELEEYVEIPSDSGITFNEQPKMKALEIAEKTRDAILSRKFDQVRINLPNGDMVGHTGDIEATIVACKAADEAVKMVLDAIEQVGGIYVVTADHGNAEDMVKRDKSGKPQLDKNGQVQILTSHTLEPVPIAIGGPGLAPGVRFRTDLPDGGLANVAATVMNLHGFEAPSDYEPSLIEVVDN

SEQ ID NO: 9061 - protein, 555 aa, Cajanus cajan
MGSTWKLADHPKLPKGKQVALIVLDGWGEAKPDEYNCIHNAETPCMDSLKKGAPERWRLVKAHGTAVGLPSDDDMGNSEVGHNALGAGRIFAQGAKLVDLALASGKIFEGEGFKYIKESFETGTLHLIGLLSDGGVHSRLDQLQLLLKGVGERGVKRVRVHILTDGRDVLDGSSVGFVETLENDLAQLREKGIDAKIASGGGRMNVTMDRYENDWNVVKRGWDAQVLGEAPHKFTNAVEAVKKLRAEPKANDQYLPPFVIVDENGKPVGPIVDGDAVVTFNFRADRMVMIAKSLEYENFDKFDRVRFPKIRYAGMLEYDGELKLPSHYLVSPPEIDRTSGEYLVHNGIRTFACSETVKFGHVTFFWNGNRSGYFNKELEQYVEIPSDSGITFNEQPKMKALQIGEKARDAILSGKFDQVRVNLPNGDMVGHTGDIEATVVACKAADEAVKMIIDAIEKVGGIYVVTADHGNAEDMVKRDKSGKPLLKDGKIQILTSHTLEPVPIAIGGPGLIPGARFRNDVPTGGLANVAATVINLHGFEAPSDYETTLIEVVDN

SEQ ID NO: 9062 - protein, 557 aa, Eucalyptus grandis
MGSSEFTWKLPDHPRLPKGRTVAVVVLDGWGEAEPDPYNCIHVADTPALDSLRKGAPDKWRLIKAHGTAVGLPTDDDMGNSEVGHNALGAGRIYAQGAKLVDLALASGKIYEGEGFKYIKECFENGTLHLIGLLSDGGVHSRLDQLQLLVKGAAEHGAKRIRVHILTDGRDVLDGSSVGFVETLENDLAKLREKGVDAHIASGGGRMYVTMDRYENDWNVVKRGWDAQVLGEAPYKFRSAVEAVKKLRAEPNANDQYLPPFVIVDENGKAVGPIVDGDAVVTFNFRADRMVMLAKALEYENFDKFDRVRFPKVHYAGMLQYDGELKLPSHYLVSPPEIERTSGEYLVHNGIRTFACSETVKFGHVTFFWNGNRSGYFNPELEEYVEIPSDTGIPFNVRPKMKAVEIAEKARDAILSRKFDQVRVNLPNGDMVGHTGDMEATIIGCKAADEAVKIILDAVEQVGGIYVVTADHGNAEDMVKRDKSGQPLVDKSGNIQILTSHTLRPVPIAIGGPGLAPGVRFRRDLAEAGLANVAATVINLHGFEAPSDYEPTLIEVV

SEQ ID NO: 9063 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRAKGVDAQVASGGGRMYVTMDRYENDWSVVKRGWDAQVLGEAPHKFKSALEAVKTLRAEPGANDQYLPSFVIVDDNGKAVGPIVDGDAVVTFNFRADRMVMHAKALEYKDFDKFDRVRVPDIRYAGMLQYDGELKLPSRYLVSPPLIDRTSGEYLAHNGVRTFACSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 9064 - protein, 559 aa, Cichorium intybus
MGSTGFSWKLADHPKLPKGKLVAMIVLDGWGEASPDKFNCIHVAETPTMDSLKNGAPDKWRLVRAHGTAVGLPTEDDMGNSEVGHNALGAGRIYAQGAKLVDAALESGKIYEDEGFNYIKESFANNTLHLIGLMSDGGVHSRLDQVQLLLKGASERGAKKIRVHVLTDGRDVLDGSSVGFAETLENELSELRKKGIDAQVASGGGRMYVTMDRYENDWEVVKRGWDAQVLGEAPHKFNNVVEAVKTLREVPGSNDQYLPPFVIVDESGNPVGPIVDGDAVVTFNFRADRMTMLAQALEYEKFDKFDRVRVPKIRYAGMLQYDGELKLPNHYLVSPPLIDRTSGEYLVHNGVRTFACSETVKFGHVTFFWNGNRSGYFNAELEEYVEIPSDSGITFNVQPKMKALEIGEKARDAILSGRFDQVRVNIPNGDMVGHTGDVEATVVACKAADEAVKMILDAVEQVGGIYVVTADHGNAEDMVKRNKKGEPALDKDGNVQILTSHTLQPVPIAIGGPGLTEGVKFRKDVPSGGLANVAATVMNLHGFVAPDDYETTLIEVVDC

SEQ ID NO: 9065 - protein, 560 aa, Euonymus alatus
MGSAGEVNWKLADHPKLPKDKIVAMVVLDGWGEANPDQYNCIHVADTPTMDSLRKGAPEKWRLVRAHGKAVGLPTEDDMGNSEVGHNALGAGRIFAQGAKLVDLALASGKIYEGAGFNYIKECFETGTLHLIGLLSDGGVHSRLDQLQLLLKGAAQHGAKRIRVHILTDGRDVLDGSSVGFVETLEKDIEELRAKGVDAYIASGGGRMYVTMDRYENDWNVVKRGWDAQVLGEAPHKFRNAVEAVKKLREDPKANDQYLPPFVIVDENGKPVGPINDGDAVVTFNFRADRMTMLAKALEYEDFDKFDRVRFPKIHYAGMLQYDGELKLPSHYLVSPPEIDRTSGEYLVHNGVRTFACSETVKFGHVTFFWNGNRSGCFNPEMEEYVEIPSDIGITFNVQPKMKAKEIAEKARDAILSRKFHQVRVNLPNGDMVGHTGDIQATVVGCKVTDDAVKVILDAIEQVGGIYVVTADHGNAEDMVKRNKSGQPLLDKNGNIQVLTSHTLQPVPIAIGGPGLAPGVRYRKDLPDGGLANVAATVMNLHGFEAPGDYEPTLIEVVDS

SEQ ID NO: 9066 - protein, 560 aa, Tripterygium wilfordii
MGSAGEVNWKLADHPKLPKDKVVAMVVLDGWGEADPDQYNCIHVADTPTMDSLKKGAPEKWRLVRAHGKAVGLPTEDDMGNSEVGHNALGAGRIFAQGAKLVDLALASGKIFEGEGFNYIKECFETGTLHLIGLLSDGGVHSRLDQLQLLLKGAAKHGAKRIRVHILTDGRDVLDGSSVGFVETLEKELAELRAKGVDAQIASGGGRMYVTMDRYENDWNVVKRGWDAQVLGEAPYKFRNAVEAVKKLREEPKANDQYLPPFVIVDENGKPVGPINDGDAVVTINYRADRMVMLAKALEYEDFDKFDRVRFPKINYAGMLQYDGELKLPNHYLVSPPEIDRTSGEYLVHNGVRTFACSETVKFGHVTFFWNGNRSGCFNPEMEEYVEIPSDVGITFNVQPEMKAKEIAEKARDAILSRKFHQVRVNLPNGDMVGHTGDIHATVVGCKVTDDAVKVILDAIEQVGGIYVVTADHGNAEDMAKRNKSGQPILDKNGNIQVLTSHTLQPVPIAIGGPGLAPGVRFRKDLPNGGLANVAATVMNLHGFEAPGEYEPTLIEVVDN

SEQ ID NO: 9067 - protein, 560 aa, Eutrema halophilum
MGSSGDVNWKLEDHPKLPKGKTIGLIVLDGWGESEPDQYNCIHKAPTPAMDSLKNGKPDTWRLIKAHGTAVGLPSEDDMGNSEVGHNALGAGRIYAQGAKLVDLALESGKIYEDEGFKYISESFEKGTVHLIGLLSDGGVHSRLDQVQLLLKGFAERGAKRIRVHVLTDGRDVLDGSSVGFVETLEADLADLRSKGVDAQIASGGGRMNVTMDRYENDWNVVKRGWDAQVLGEAPHKFKSGLEAIKTLRAEPGANDQYLPPFVIVDDSGKAVGPIVDGDAVVTFNFRADRMVMHAKALEYEDFDKFDRVRVPKIRYAGMLQYDGELKLPSHYLVSPPLIDRTSGEYLAHNGIRTFACSETVKFGHVTFFWNGNRSGYFNEKLEKYVEIPSDSGISFNVQPKMKALEIAEKARDAILSGKFDQVRVNLPNGDMVGHTGDIKATVVACEAADVAVRIILDAIEQVGGIYVVTADHGNAEDMVKRDKAGKPALDKEGNLQILTSHTLKPVPIAIGGPGLSAGVKFRQDLETPGLANVAATVMNLHGFVAPGDYEPSLIEVVDK

SEQ ID NO: 9068 - protein, 560 aa, Euonymus alatus
MGSAGEVNWKLADHPKLPKDKIVAMVVLDGWGEANADQYNCIHVADTPTMDSLKKGAPENWRLIRAHGHSVGLPTEDDMGNSEVGHNALGAGRIFAQGAKLVDLALASGKIYEGDGFNYIKECFETGTLHLIGLLSDGGVHSRLDQLQLLLKGAAQHGAKRIRVHILTDGRDVLDGSSVGFVETLEKELAELRAKGVDAQTASGGGRMYVTMDRYENDWDVVKRGWDAQVLGEAPFKFRSAVEAVKKLREEPKASDQYLPPFVIVDENGKPVGPINDGDSVVTFNFRADRMTMLAKALEYEDFDIFDRVRFPKIHYAGMLQYDGELKLPSHYLVSPPEIDRTSGEYLVHNGVRTFACSETVKFGHVTFFWNGNRSGCFNPEMEEYVEIPSDVGITFNVQPKMKAKEIAEKARDAILSRKFQQVRVNLPNGDMVGHTGDIEATVVGCKVTDDAVKVILDAIEQVGGIYVVTADHGNAEDMVKRNKSGQPLLDKKGKIQVLTSHTLQPVPIAIGGPGLAPGVRYRKDLPNGGLANVAATVMNLHGFEAPSDYEPTLIEVVDN

SEQ ID NO: 9069 - protein, 557 aa, Flaveria ramosissima
MGSTGFSWKLADHPKLPKGKLVAMVVLDGWGEASPDKFNCIHVAETPTMDSLKNGAPDKWRLVRAHGTAVGLPTEDDMGNSEVGHNALGAGRIFAQGAKLVDLALASGKIFEDEGFNYIKESFATNTLHLIGLMSDGGVHSRLDQLQLLLRGASQNGAKRIRVHVLTDGRDVLDGSSVGFAETLEAELSDLRGKGIDAQVASGGGRMYVTMDRYENDWEVVKRGWDAQVLGEAPHKFKNVVEAIKTLREAPGANDQYLPPFVIVDDSGKAVGPIVDGDAVVTFNFRADRMTMLAQALEYEKFDKFDRVRVPKIRYAGMLQYDGELKLPSHYLVSPPLIDRTSGEYLVYNGVRTFACSETVKFGHVTFFWNGNRSGYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGEVQILTSHTLQPVPIAIGGPGLAAGVRFRKDVPSGGLANVAATVMNLHGFVAPDDYETTLIEVVD

SEQ ID NO: 9070 - protein, 559 aa, Nuphar advena
MGSPAFSWKLADHPKLPKGKTIALIVLDGWGESKPDQYNCIHVAETPTMDSLKQGAPEKWRLIRAHGMAVGLPTEDDMGNSEVGHNALGAGRIFAQGAKLVDYALASGKIYEGEGFKYIKECFDIGTLHLIGLLSDGGVHSRLDQLQLLLKGASENGAKRIRVHVLTDGRDVLDGSSVGFVETLDSDLAKLREKGVDAQIASGGGRMYVTMDRYENDWGVVKRGWDAQVLGEAPFKFRNAVEAVKKLREGPKASDQYLPPFVIVDENGKAVGPIVDGDAVVTFNFRADRMVMVAKAFEYEDFDKFDRVRFPKVRYAGMLQYDGELKLPNYYLVSPPEIERTSGEYLVHNDVRTFACSETVKFGHVTFFWNGNRSGYFNAELEEYVEIPSDSGITFNVQPKMKALEIAEKARDAILSGKFHQVRVNLPNGDMVGHTGDIEATVVACKAADQAVKMMLDAVEQVGGIYVITADHGNAEDMVKRNKSGQPSLDKSGNIQILTSHTLAPVPIAIGGPGLKEGVRFRSDLPDGGLANVAATVMNLHGFKAPSDYEPTLIEVIDN

SEQ ID NO: 9071 - protein, 557 aa, Ambrosia trifida
MGSTGVSLKLADHPKLPKGKLVAMIVLDGWGEASPDKFNCIHVAETPTMDSLKNGAPDKWRLVRAHGTAVGLPTEDDMGNSEVGHNALGAGRIFAQGAKLVDSALASGKIYEDEGFNYIKESFATNTLHLIGLMSDGGVHSRLDQLQLLLRGASQHGAKRIRVHVLTDGRDVLDGSSVGFAETLEAELSDLRSKGIDAQVASGGGRMYVTMDRYENDWEVVKRGWDAQVLGEAPHKFKNVVEAIKTLREAPGANDQYLPPFVIVDDSGKAVGPVVDGDAVVTFNFRADRMTMLAQALEYEKFDKFDRVRVPKIRYAGMLQYDGELKLPSHYLVSPPLIERTSGEYLVNNGVRTFACSETVKFGHVTFFWNGNRSGYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGEVQILTSHTLQPVPIAIGGPGLAAGVKFRKDVPSGGLANVAATVMNLHGFVAPDDYETTLIEVVD

SEQ ID NO: 9072 - protein, 559 aa, Amsonia hubrichtii
MGSSGVSWKLNDHPKLPKGKIIAMIVLDGWGEAKPNQYNCIHVAETPTMDSFKKGAPEKWRLVRAHGKAVGLPTEDDMGNSEVGHNALGAGRIYAQGAKLVDLALESGKIYEDEGFNYIKECFPNGTLHLIGLLSDGGVHSRLDQLQLLLKGASERGAKRIRVHALTDGRDVLDGSSVGFMETLENDLAKLREKGIDAQVASGGGRMYVTMDRYENDWEVVKRGWDAQVLGEAPHKFRNGVEAIKKLRETPNSNDQYLPPFVIVDENGKPVGPIVDGDAVVTFNFRADRMVMLAKALEYADFDKFDRVRVPKIRYAGMLQYDGELKLPSHYLVSPPLIERTSGEYLVHNGVRTFACSETVKFGHVTFFWNGNRSGYFNQEMEEYVEIPSDSGITFNVQPKMKALEIGEKARDAILGRKFHQVRVNIPNGDMVGHTGDIEATVVACKAADEAVKMIIDAIEQVGGIYVVTADHGNAEDMVKRNKKGEPLLDKNGKIQILTSHTLEPVPIAIGGPGLAPGVRFRQDLPGGGLANVAATVMNLHGFEAPSDYEPTLIEVDDK

SEQ ID NO: 9073 - protein, 560 aa, Ricinus communis
MGSSGEFTWKLADHPKLPKGKTIAMVVLDGWGEAKPDQYNCIHVAETPTMDSFKKTAPERWRLIKAHGTAVGLPTEDDMGNSEVGHNALGAGRIYAQGAKLVDLALASGKIYEGEGFKYVKECFDKGTLHLIGLLSDGGVHSRLDQLQLLLKGAAEHGAKRIRVHVLTDGRDVIDGTSVGFAETLEKDLENLREKGVDAQVASGGGRMYVTMDRYENDWNVVKRGWDAQVLGEAPYKFKSAVEAIKKLREEPKANDQYLPPFVIVDENGKPVGPIVDGDAVVTINFRADRMVMLAKALEYENFDTFDRVRFPKIHYAGMLQYDGELKLPSHYLVSPPEIERTSGEYLVHNGVHTFACSETVKFGHVTFFWNGNRSGYFNPEMEEYVEIPSDVGITFNVQPKMKAIEIAEKARDAILSGKFQQVRVNIPNGDMVGHTGDVEATVVACKAADEAVKMIIDAIEQVGGIYVVTADHGNAEDMVKRDKSGKPMADKSGKIQILTSHTLQPVPIAIGGPGLTPGVRFRSDIPTGGLANVAATVMNLHGFEAPSDYEPTLIEAVDN

SEQ ID NO: 9074 - protein, 558 aa, Cephalotaxus harringtonia
MGSTGWKLADHPKLPKGKQLAVIVLDGWGEEKPDQYNCIHVADTPTMDSLKQGAPEKWMLVKAHGPAVGLPTEDDMGNSEVGHNALGAGRIFAQGAKLVDLALESGKIYDGEGFKYIKECFETGTLHFVGLLSDGGVHSRLDQLQLLLKGSAKNGAKRIRVHILTDGRDCLDGSSIGFVETLEKDLAELRKQGIDAQIASGGGRMYVTMDRYENDWGVVKRGWDAQVLGEAPYKFRSAVEAVKKLREDLKVSDQYLPPFVIVDENEKAVGPILDGDAVVTFNFRADRMVMIAKALEYENFNMFDRVRYPKIHYAGMLQYDGELKLPSHYLVTPPEIDRTSGEYFVHNGIRTFACSETVKFGHVTFFWNGNRSGYFNKDLEEYVEIPSDSGITFNEKPKMKALEIAEKARDAILSGKFDQVRVNLPNGDMVGHTGDIEATVVACKVADEAVKVILDAVEQAGGIYLVTADHGNAEDMVKRNTKTGKPQLDKDGKIQILTSHTLSPVPIAIGGPGLKDGVRFRNDLKQPGLTNVAATMMNLLGFEAPSQYEPTLIEVVDN

SEQ ID NO: 9075 - protein, 560 aa, Euonymus alatus
MGSAGEVNWKLADHPKLPKDKIVAMVVLDGWGEANPDQYNCIHVADTPTMDSLRKGAPEKWRLVRAHGKAVGLPTEDDMGNSEVGHNALGAGRIFAQGAKLVDLALASGKIYEGEGFNYIKECFETGTLHLIGLLSDGGVHSRLDQLQLLLKGAAQHGAMRIRVHILTDGRDVLDGSSVGFVETLEKDIEELRAKGVDAYIASGGGRMYVTMDRYENDWNVVKRGWDAQVLGEAPHKFRNAVEAVKKLREDPKANDQYLPPFVIVDENGKPVGPINDGDAVVTFNFRADRMTMLAKALEYEDFDKFDRVRFPKIHYAGMLQYDGELKLPSHYLVSPPEIDRTSGEYLVHNGVRTFACSETVKFGHVTFFWNGNRSGCFNPEMEEYVEIPSDIGITFNVQPKMKAKEIAEKARDAILSRKFHQVRVNLPNGDMVGHTGDIQATVVGCKVTDDAVKVILDAIEQVGGIYVVTADHGNAEDMVKRNKSGQPQLDKKGKIQVLTSHTLQPVPIAIGGPGLAPGVRYRKDLPNGGLANVAATVMNLHGFEAPSDYEPTLIEVIDN

SEQ ID NO: 9076 - protein, 556 aa, Fagopyrum esculentum
TDFSWKLPDHPKLPKGKTIAMIVLDGWGEAALDDYNCIHKAGTTTMDSLKQGAPEKWRLIKAHGTAVGLPSEDDMGNSEVGHNALGAGRVFAQGAKLVDNALATGKIYDGEGFKYIKESFESGTLHLIGLLSDGGVHSRLDQVQLLLKGAAEHGAKRIRVHFLTDGRDVLDGSSVGFVETLEADLAKLREQGVDARVASGGGRMYVTMDRYENDWEVVKRGWDAQVLGEAPYKFTSAVEAVKTLRQEPGSNDQYLKPFVCVDESGKAVGPIVDGDAVVTFNFRADRMTMLAKALEYEDFNNFDRVRFPKIRYAGMLQYDGELKLPAKYLVSPPEIERTSGEYLVHNGVRTFACSETVKFGHVTFFWNGNRSGYFNAQMEEYVEIPSDSGISFNVQPKMKAVEIAEKARDAILSGKFDQVRVNIPNGDMVGHTGDIEATVVACKAADEGVKIILDAIEQVGGIFVVTADHGNAEDMVKRDKKGKPLLDKNGKLQILTSHTLQPVPIAIGGPGLAPGTRFRTDVPTGGLANVAATVMNLHGLVAPDDYETTLIEVVEN

SEQ ID NO: 9077 - protein, 557 aa, Flaveria ramosissima
MGSTGFSWKLADHPKLPKGKLVAMVVLDGWGEASPDKFNCIHVAETPTMDSLKNGAPDKWRLVRAHGTAVGLPTEDDMGNSEVGHNALGAGRIFAQGAKLVDLALASGKIFEDEGFNYIKECFATNTLHLIGLMSDGGVHSRLDQLQLLLRGASQHGAKRIRVHVLTDGRDVLDGSSVGFAEILEAELSELRSKGIDAQVASGGGRMYVTMDRYENDWEVVKRGWDAQVLGEAPHKFKNAVEAIKTLREAPGANDQYLPPFVIVDDSGKAVGPIVDGDAVVTFNFRADRMTMLAQALEYEKFDKFDRVRVPKIRYAGMLQYDGELKLPSHYLVSPPLIDRTSGEYLVHNGVRTFACSETVKFGHVTFFWNGNRSGYFNSELEEYVEIPSDTGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGKVQILTSHTLQPVPIAIGGPGLAEGVRFRKDVPSGGLANVAATVMNLHGFVAPDDYETTLIEVVD

SEQ ID NO: 9078 - protein, 552 aa, Silene vulgaris
MEVSRSSKTWKDKIIAMIVLDGWGEANANQYNCIHVADTPTMDSLKHGAPDKWRLIRAHGKAVGLPTEDDMGNSEVGHNALGAGRIFAQGAKLVDLALASGKIYDGEGFNYIKECFETNTLHLIGLLSDGGVHSRLDQLQLLLKGTAERGAKRIRVHILTDGRDVLDGSSVGFVETLEKDLSELRSKGIDAQIASGGGRMYVTMDRYENDWEVVKRGWDAQVLGEAPYKFKSAVEAVKTLRAEPKANDQYLPPFVIVDDNDKAVGPIVDGDAVVTINFRADRMTMIAKALEYENFDKFDRVRVPKIRYAGMLQYDGELKLPSHYLVSPPEIDRTSGEYLTYNGVHTFACSETVKFGHVTFFWNGNRSGYFNSEMEEYVEIPSDSGITFNVKPKMKAVEIAEKARDAILSRKFQQVRVNLPNGDMVGHTGDIEATVVACKAADEAVKIILDAIEQVGGIYVVTADHGNAEDMVKRDKKGQPQLDKAGNIQILTSHTLEPVPIAIGGPGLAQGVRFRKDVPTGGLANVAATVMNLHGFEAPSDYEPTLIEVVDN

SEQ ID NO: 9079 - protein, 557 aa, Helianthus annuus
MGSTGFSWKLADHPKLPKGKLVAMIVLDGWGEASPDKFNCIHVAETPTMDSLKNGAPDKWRLVRAHGTAVGLPTEDDMGNSEVGHNALGAGRIFAQGAKLVDLALASGKIYEDEGFNYIKECFATNTLHLIGLMSDGGVHSRLDQLQLLLRGASQHGAKRIRVHVLTDGRDVLDGSSVGFAETLEAELSDLRSKGIDAQVASGGGRMYVTMDRYENDWEVVKRGWDAQVLGEAPHKFKNVVEAIKTLREAPGANDQYLPPFVIVDDSGKAVGPVVDGDAVVTFNFRADRMTMLAQALEYEKFDKFDRVRFPKIRYAGMLQYDGELKLPNHYLVSPPLIERTSGEYLVKNGVRTFACSETVKFGHVTFFWNGNRSGYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGEVQILTSHTLQPVPIAIGGPGLAAGVKFRKDVPSGGLANVAATVMNLHGFVAPDDYETTLIEVVD

SEQ ID NO: 9080 - protein, 560 aa, Thellungiella halophila
MGSSGDVNWKLEDHPKLPKGKTIGLIVLDGWGESEPDQYNCIHKAPTPAMDSLKNGKPDTWRLIKAHGTAVGLPSEDDMGNSEVGHNALGAGRIYAQGAKLVDLALESGKIYEDEGFKYISESFEKGTVHLIGLLSDGGVHSRLDQVQLLLKGFAERGAKRIRVHVLTDGRDVLDGSSVGFVETLEADLADLRSKGVDAQIASGGGRMNVTMDRYENDWNVVKRGWDAQVLGEAPHKFKSGLEAIKTLRAEPGANDQYLPPFVIVDDSGKAVGPIVDGDAVVTFNFRADRMVMHAKALEYEDFDKFDRVRGPKIRYAGMLQYDGELKLPSHYLVSPPLIDRTSGEYLAHNGIRTFACSETVKFGHVTFFWNGNRSGYFNEKLEKYVEIPSDSGISFNVQPKMKALEIAEKARDAILSGKFDQVRVNLPNGDMVGHTGDIKATVVACEAADVAVRIILDAIEQVGGIYVVTADHGNAEDMVKRDKAGKPALDKEGNLQILTSHTLKPVPIAIGGPGLSAGVKFRQDLETPGLANVAATVMNLHGFVAPGDYEPSLIEVVDK

SEQ ID NO: 9081 - protein, 559 aa, Vinca minor
MGSSGFSWKLNDHPKLPKDKIIGLIVLDGWGEAHPNQYNCISVAETPTMDSFKKGAPERWRLVRAHGKAVGLPTEDDMGNSEVGHNALGAGRIYAQGAKLVDLALESGKIYEDEGFNYIKECFGTGTLHLIGLLSDGGVHSRLDQLQLLLKGASERGAKRIRVHALTDGRDVLDGSSVGFMETLENDLVKLREKGIDAQVASGGGRMYVTMDRYENDWDVIKRGWDAQVLGEAPHKFKNPVEAVKKLREEPKSNDQYLPPFVIVDDNGKPVGPIVDGDAVVTFNFRADRMVMLAKALEYADFDKFDRVRVPKIRYAGMLQYDGELKLPNHYLVSPPLIERTSGEYLVNNGVRTFACSETVKFGHVTFFWNGNRSGYFNQEMEEYVEIPSDSGITFNVKPKMKALQIAEKARDAILSRKFQQVRVNLPNSDMVGHTGDIEATVVACKAADEAVKMIIDAIEQVGGIYVVTADHGNAEDMVKRNKKGEPLLDKNGKIQILTSHTLEPVPLAIGGPGLAPGVRFREDVPNGGLANVAATVMNLHGLEAPSDYETTLIEVVDK

SEQ ID NO: 9082 - protein, 559 aa, Gossypium hirsutum
MGSSGQQVSWKLADHPTLPKGKTLALIVLDGWGEDKPDEYNCIHVAQTPTMDSLKQGAPEKWRLIRAHGKAVGLPTEDDMGNSEVGHNALGAGRIFAQGAKLVDIALASGKIYEGEGFKYISECFEKGTLHLIGLLSDGGVHSRLDQLQLLLKGASERGAKRIRVHILTDGRDVLDGSSVGFVETLESDLAKLRENGVDAQIASGGGRMYVTMDRYENDWDVVKRGWDAQVRGEAPHKFTNAVEAVKKLRENANDQYLPPFVIVDENEKAVGPIEDGDAVVTFNFRADRMVMLAKALEYQDFDKFDRVKVPKIRYAGMLQYDGELKLPGRYLVSPPEIDRTSGEYLVHNGVRTFACSETVKFGHVTFFWNGNRSGYFNPEMEEYVEIPSDVGITFNVQPKMKALEIGEKARDAILSRKFDQVRVNIPNGDMVGHTGDIQATVVACKAADEAVKMIIDAIEQVGGIYVVTADHGNAEDMVKRNKSGQPLYDKSGKLQILTSHTCQPVPIAIGGPGLAAGVRFRNDVPDGGLANVAATVMNLHGYVAPNDYEPTLIEVVSN

SEQ ID NO: 9083 - protein, 559 aa, Gossypium raimondii
MGSSGQQVSWKLADHPTLPKGKTLALIVLDGWGEDKPDEYNCIHVAQTPTMDSLKQGAPEKWRLIRAHGKAVGLPTEDDMGNSEVGHNALGAGRIFAQGAKLVDIALASGKIYEGEGFKYISECFEKGTLHLIGLLSDGGVHSRLDQLQLLLKGASERGAKRIRVHILTDGRDVLDGSSVGFVETLESDLAKLRENGVDAQIASGGGRMYVTMDRYENDWDVVKRGWDAQVRGEAPHKFANAVEAVKKLRENANDQYLPPFVIVDENEKAVGPIEDGDAVVTFNFRADRMVMLAKALEYQDFDKFDRVKVPKIRYAGMLQYDGELKLPGRYLVSPPEIDRTSGEYLVHNGVRTFACSETVKFGHVTFFWNGNRSGYFNPEMEEYVEIPSDVGITFNVQPKMKALEIGEKARDAILSRKFDQVRVNIPNGDMVGHTGDIQATVVACKAADEAVKMIIDAIEQVGGIYVVTADHGNAEDMVKRNKSGQPLYDKSGKLQILTSHTCQPVPIAIGGPGLAAGVRFRNDVPDGGLANVAATVMNLHGYVAPNDYEPTLIEVVNN

SEQ ID NO: 9084 - protein, 559 aa, Gossypium hirsutum
MGSSGQQVSWKLADHPTLPKGKTLALIVLDGWGEYKPDEYNCIHVAQTPTMDSLKQGAPEKWRLIRAHGKAVGLPTEDDMGNSEVGHNALGAGRIFAQGAKLVDIALASGKIYEGEGFKYISECFEKGTLHLIGLLSDGGVHSRLDQLQLLLKGASERGAKRIRVHILTDGRDVLDGSSVGFVETLESDLAKLRENGVDAQIASGGGRMYVTMDRYENDWDVVKRGWDAQVRGEAPHKFTNAVEAVKKLRENANDQYLPPFVIVDENEKAVGPIEDGDAVVTFNFRADRMVMLAKALEYQDFDKFDRVKVPKIRYAGMLQYDGELKLPGRYLVSPPEIDRTSGEYLVHNGVRTFACSETVKFGHVTFFWNGNRSGYFNPEMEEYVEIPSDVGITFNVQPKMKALEIGEKARDAILSRKFDQVRVNIPNGDMVGHTGDIQATVVACKAADEAVKMIIDAIEQVGGIYVVTADHGNAEDMVKRNKSGQPLYDKSGKLQILTSHTCQPVPIAIGGPGLAAGVRFRNDVPDGGLANVAATVMNLHGYVAPNDYEPTLIEVVNN

SEQ ID NO: 9085 - protein, 557 aa, Helianthus annuus
MGSTGFSWKLADHPKLPKGKLLAMIVLDGWGEASPDKFNCIHVAETPTMDSLKNGAPDKWRLVRAHGTAVGLPTEDDMGNSEVGHNALGAGRIFAQGAKLVDLALASGKIYEDEGFNYIKECFATNTLHLIGLMSDGGVHSRLDQLQLLLRGASQHGAKRIRVHVLTDGRDVLDGSSVGFAETLEAELSDLRSKGIDAQVASGGGRMYVTMDRYENDWEVVKRGWDAQVLGEAPHKFKNVVEAIKTLREAPGANDQYLPPFVIVDDSGKAVGPVVDGDAVVTFNFRADRMTMLAQALEYEKFDKFDRVRFPKIRYAGMLQYDGELKLPNHYLVSPPLIERTSGEYLVKNGVRTFACSETVKFGHVTFFWNGNRSGYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGEVQILTSHTLQPVPIAIGGPGLAAGVKFRKDVPSGGLANVAATVMNLHGFVAPDDYETTLIEVVD

SEQ ID NO: 9086 - protein, 557 aa, Flaveria ramosissima
MGSTGFSWKLADHPKLPKGKLVAMVVLDGWGEASPDKFNCIHVAETPTMDSLKNGAPDKWRLVRAHGTAVGLPTEDDMGNSEVGHNALGAGRIFAQGAKLVDLALASGKIFEDEGFNYIKECFATNTLHLIGLMSDGGVHSRLDQLQLLLRGASQHGAKRIRVHVLTDGRDVLDGSSVGFAEILEAELSELRSKGIDAQVASGGGRMYVTMDRYENDWEVVKRGWDAQVLGEAPHKFKNVVEAIKTLREAPGANDQYLPPFVIVDDSGKAVGPIVDGDAVVTFNFRADRMTMLAQALEYEKFDKFDRVRVPKIRYAGMLQYDGELKLPSHYLVSPPLIDRTSGEYLVHNGVRTFACSETVKFGHVTFFWNGNRSGYFNSELEEYVEIPSDTGITFNVQPKMKALEIGEKARDAILSGKFDQVRVNIPNGDMVGHTGDVEATVVACKAADEAVKMILDAVEQVGGIYVVTADHGNAEDMVKRNKKGEPLLKDGEVQILTSHTLQPVPIAIGGPGLAAGVRFRKDVPSGGLANVAATVMNLHGFVAPDDYETTLIEVVD

SEQ ID NO: 9087 - protein, 558 aa, Lactuca sativa
MGSTGFSWKLADHPKLPKGKLVAMIVLDGWGEASPDKFNCIHVAETPTMDSLKNGAPDKWRLVRAHGTAVGLPTEDDMGNSEVGHNALGAGRIYAQGAKLVDAALESGKIYEDEGFNYIKESFANNTLHLIGLMSDGGVHSRLDQVQLLLKGASERGAKKIRLHVLTDGRDVLDGSSIGFAETLEKELSDLRKKGIDAQVASGGGRMYVTMDRYENDWEVVKRGWDAQVLGEAPHKFKNVVEAVKTLRQVPGSNDQYLPPFVIVDESGSPVGPIVDGDAVVTFNFRADRMTMLAQALEYEKFDKFDRVRVPKIRYAGMLQYDGELKLPNYYLVSPPLIDRTSGEYLVHNGVRTFACSETVKFGHVTFFWNGNRSGYFNAELEEYVEIPSDSGITFNVQPKMKALEIGEKARDAILSGRFDQVRVNIPNGDMVGHTGDVEATVVACKAADEAVKMILDAVEQVGGIFVVTADHGNAEDMVKRNKKGEPALDKEGNVQILTSHTLQPVPIAIGGPGLAEGVKFRKDVPSGGLANVAATVMNLHGFVAPDDYETTLIEVVD

SEQ ID NO: 9088 - protein, 558 aa, Sequoia sempervirens
MASMDWKLADHSKLGKGKPLAVIILDGWGEEKPDQYNCIHVAETPTMDSLKKGAPEKWTLVKAHGPAVGLPTEDDMGNSEVGHNALGAGRIFAQGAKLVDYALESGKLYNGEGFKYIKECFETGTLHFIGLLSDGGVHSRLDQLQLLLKGSARNGAKRIRVHILTDGRDCLDGSSVGFVETLEKDLAELCKEGVDAQIASGGGRMYVTMDRYENDWGVVKRGWDAQVLGEAPYKFKSAVEAVKKLREEPKASDQYLPPFVIVDENNKAVGPILDGDAVVTINFRADRMVMVAKAFEYENFDMFDRVRYPKVHYAGMLQYDGELKLPSHYLVNPPDIDRTSGEYLVHNGVRTFVCSETVKFGHVTFFWNGNRSGYFNKDLEEYVEVPSDSGITFNVKPKMKALEIAEKARDAILSGKFDQVRVNLPNGDMVGHTGDIEATVVACKAADEAVKMILDAVEQVGGIYLVTADHGNAEDMVKRNTKTGKPQLDKNGNIQILTSHTLSPVPIAIGGPGLKEGVRFRNDLKQPGLANVAATMINLMGFEAPSDYEPTLIEVVEN

SEQ ID NO: 9089 - protein, 559 aa, Pinus pinaster
MSSTNFSFKLADHPKLPKGKQLAVVVLDGWGEEKPDQYNCIHVAETPAMDSLKKGAPEKWTLIKAHGPAVGLPTEDDMGNSEVGHNALGAGRIFAQGAKLVDYALASGKIYQGEGFTYIKECFENGTLHLIGLLSDGGVHSRLDQLQLLLKGVPQYGAKRIRVHILTDGRDCLDGSSIGYVETLENDLAELRKQGVDALIASGGGRMYVTMDRYENDWGVVKRGWDAQVLGKAPYKFRNAVEAVKKLREAPKASDQYLPPFVIVDENDKAVGPILDGDAVVTINFRADRMTMVAKAFEYENFSAFDRVRYPKIRYAGMLQYDGELKLPAHYLVSPPDIDRTSGEYLVHNGIRTFACSETVKFGHVTFFWNGNRSGYFNEELEEYVEIPSDSGITFNVQPKMKALEIAERTRDAILSGRYDQVRVNLPNGDMVGHTGDIEATVVACKAADEAVKIILDAIEQVGGIYLVTADHGNAEDMVKRNKTGQPAKDKDGKIQILTSHTCSPVPIAIGGPGLTKGVRFRTDLKQPGLANVASTIINLLGFEAPSDYEPTLIEVASN

SEQ ID NO: 9090 - protein, 557 aa, Helianthus annuus
MGSTGFSWKLADHPKLPKGKLVAMIVLDGWGEASPDKYNCIHVAETPTMDSLKNGAPDKWRLVRAHGTAVGLPTEDDMGNSEVGHNALGAGRIYAQGAKLVDLALASGKIYEDEGFNYIKESFATNTLHLIGLMSDGGVHSRLDQLQLLLKGASQRGAKRIRVHVLTDGRDVLDGSSVGFAEILEAELSDLRSKGIDAQVASGGGRMYVTMDRYENDWEVVKRGWDAQVLGEAPHKFKNVVEAIKTLRSAPGANDQYLPPFVIVDDSGKSVGPIVDGDAVVTFNFRADRMTMLAQALEYEKFDKFDRVRVPKIRYAGMLQYDGELKLPSHYLVSPPLIERTSGEYLVHNGVRTFACSETVKFGHVTFFWNGNRSGYFNAELEEYVEIPSDSGITFNVQPKMKALEIGEKTRDAILSGRFDQVRVNIPNGDMVGHTGDVEATVVACKAADEAVKMIIDAVEQVGGIYVVTADHGNAEDMVKRNKKGEPILKDGEVQILTSHTLQPVPIAIGGPGLAAGVKFRKDVPSGGLANVAATVMNLHGFVAPDDYETTLIEVVD

SEQ ID NO: 9091 - protein, 557 aa, Helianthus annuus
MGSTGFSWKLADHPKLPKGKLVAMIVLDGWGEASPDKYNCIHVAETPTMDSLKNGAPDKWRLVRAHGTAVGLPTEDDMGNSEVGHNALGAGRIYAQGAKLVDLALASGKIYEDEGFNYIKESFATNTLHLIGLMSDGGVHSRLDQLQLLLKGASQRGAKRIRVHVLTDGRDVLDGSSVGFAEILEAELSDLRSKGIDAQVASGGGRMYVTMDRYENDWEVVKRGWDAQVLGEAPHKFKNVVEAIKTLRSAPGANDQYLPPFVIVDDSGKSVGPIVDGDAVVTFNFRADRMTMLAQALEYEKFDKFDRVRVPKIRYAGMLQYDGELKLPSHYLVSPPLIERTSGEYLVHNGVRTFACSETVKFGHVTFFWNGNRSGYFNAELEEYVEIPSDSGITFNVQPKMKALEIGEKTRDAILSGRFDQVRVNIPNGDMVGHTGDVEATVVACKAADEAVKMIIDAVEQVGGIYVVTADHGNAEDMVKRNKKGEPILKDGEVQILTSHTLQPVPIAIGGPGLAAGVKFRKDVPSGGLANVAATVMNLHGFVAPEDYETTLIEVVD

SEQ ID NO: 9092 - protein, 559 aa, Nicotiana tabacum
MGSSGDAWKLKDHPKLPKGKTVAVIVLDGWGEAKPNEFNAIHVAETPVMDSLKNGAPEKWRLIKAHGNAVGLPTEDDMGNSEVGHNALGAGRIFAQGAKLVDLALASGKIYEGEGFKYVKECFEKGTLHLIGLLSDGGVHSRLDQVQLLLKGAAEHGAKRIRVHALTDGRDVLDGSSVGFMETLENSLAQLREKGIDAQVASGGGRMYVTMDRYENDWDVVKRGWDAQVLGEAPHKFKDPVEAVKKLRQEPNANDQYLAPFVIVDDNGKPVAAILDGDAVVTFNFRADRMVMLAKALEYENFDKFDRVRVPKIRYAGMLQYDGELQLPSHYLVSPPEIDRTSGEYLVRNGVRTFACSETVKFGHVTFFWNGNRSGYFNEKLEEYVEIPSDSGITFNVKPKMKALEIAERTRDAILSGKFDQVRVNLPNGDMVGHTGDIKATIEACKSADEAVKMILEAIEQVGGIYLVTADHGNAEDMVKRNKKGEPALDKNGNIQILTSHTCEPVPIAIGGPGLAPGVRFRQDLPTGGLANVAATFMNLHGYEAPSDYEPSLIEVVDN

SEQ ID NO: 9093 - protein, 558 aa, Taraxacum officinale
MGSTGFSWKLADHPKLPKGKLVAMIVLDGWGEASPDKYNCIHVAETPTMDSLKNGAPDHWRLVRAHGTAVGLPTEDDMGNSEVGHNALGAGRIYAQGAKLVDAALESGKIYEDEGFNYIKESFPNNTLHLIGLMSDGGVHSRLDQVQLLLKGASERGAKKIRLHVLTDGRDVLDGSSVGFAETLEKELSDLRKKGIDAQVASGGGRMYVTMDRYENDWEVVKRGWDAQVLGEAPHKFKNVVEAVKTLRQAPGSNDQYLPPFVIVDESGTPVGPIVDGDAVVTFNFRADRMTMLAQALEYEKFDKFDRVRVPKIRYAGMLQYDGELKLPNHYLVSPPLIDRTSGEYLVHNGVRTFACSETVKFGHVTFFWNGNRSGYFNAELEEYVEIPSDSGITFNVQPKMKALEIGEKARDAILSGRFDQVRVNIPNGDMVGHTGDVEATVVACKAADEAVKMILDAVKQVGGIYVVTADHGNAEDMVKRNKKGEPALDKEGNVQILTSHTLQPVPIAIGGPGLTAGVKFRKDVPSGGLANVAATVMNLHGFVAPDDYETTLIEVVE

SEQ ID NO: 9094 - protein, 556 aa, Podocarpus macrophillus
MGLTWKLEDHPKLPKGKQLAVVVLDGWGEEKPDQYNCIHVAPTPTMDSLKKGAPERWRLVKAHGPAVGLPTEDDMGNSEVGHNALGAGRILAQGAKLVDIALESGKIYDGEGFRYVKECFETGTLHLIGLLSDGGVHSRLDQLQLLLKGSAKMGAKRIRVHILTDGRDCLDGSSVSFVETLENDLAELCKQGVDARIASGGGRMYVTMDRYENDWGVVKRGWDAQVLGEAPHKFRSALEAVKKLREAPKASDQYLPPFVIVDENEKAVGPIVDGDAVVTINYRADRMVMVAKAFEYENFSAFDRVRFPKIHYAGMLQYDGELKLPSHFLVSPPDIDRTSGEYFVHNGIRTFACSETVKFGHVTFFWNGNRSGYFDADLEEYVEIPSDSGITFNVKPKMKALEIAEKARDAILSRKFDQVRVNLPNGDMVGHTGDIEATIVGCKVADEAVKMILDAVEQAGGIYLVTADHGNAEDMVKRNKTGQPQLDKDGKLQILTSHTCSPVPIAIGGPGLKEGVRFRNDLQQPGLANVAATMMNLLGFEAPSDYEQTLIEVVDN

SEQ ID NO: 9095 - protein, 560 aa, Picea glauca
MGSTDFSFKLADHPKIPKGKQLAVIILDGWGEEKPDQYNCIYVAETPTMDSLKKGAPEKWTLIKAHGPAVGLPTEDDMGNSEVGHNALGAGRIFAQGAKLVDYALASGKIYEGAGFKYIKESFENGTLHLIGLLSDGGVHSRLDQLQLLLKGAAQNGAKRIRVHILTDGRDCLDGSSIGYVETLENDLVELQKQGVDAQIASGGGRMYVTMDRYENDWGVVKRGWDAQVLGKAPHKFRSALEAVKKLREDPKASDQYLPPFVIVDENEKAVGPILDGDAVVTINFRADRMTMVAKAFEYENFSAFDRVRYPKIRYAGMLQYDGELKLPSHYLVSPPDIDRTSGEYLVHNGIRTFACSETVKFGHVTFFWNGNRSGYFNEELETYVEIPSDSGITFNVKPKMKALEIAEKTRDAILSGRYDQVRVNLPNGDMVGHTGDIEATVVACKAADEAVKIILDAIEQVGGIYLVTADHGNAEDMVKRNTKTGQPAKDKDGKIQILTSHTLSPVPIAIGGPGLKEGLRFRSDLQQPGLANVASTIINLLGFEAPSDYEPTLIEVANN

SEQ ID NO: 9096 - protein, 560 aa, Picea glauca
MGSTDFSFKLADHPKIPKGKQLAVIILDGWGEEKPDQYNCIYVAETPTMDSLKKGAPEKWTLIKAHGPAVGLPTEDDMGNSEVGHNALGAGRIFAQGAKLVDYALASGKIYEGAGFKYIKESFENGTLHLIGLLSDGGVHSRLDQLQLLLKGAAQNGAKRIRVHILTDGRDCLDGSSIGYVETLENDLVELQKQGVDAQIASGGGRMYVTMDRYENDWGVVKRGWDAQVLGKAPHKFRSALEAVKKLREDPKASDQYLPPFVIVDENEKAVGPILDGDAVVTINFRADRMTMVAKAFEYENFSAFDRVRYPKIRYAGMLQYDGELKLPSHYLVSPPDIDRTSGEYLVHNGIRTFACSETVKFGHVTFFWNGNRSGYFNEELETYVEIPSDSGITFNVKPKMKALEIAEKTRDAILSGRYDQVRVNLPNGDMVGHTGDIEATVVACKAADEAVKIILDAIEQVGGIYLVTADHGNAEDMVKRNSKTGQPAKDKDGKIQILTSHTLSPVPIAIGGPGLKEGLRFRSDLQQPGLANVASTIINLLGFEAPSDYEPTLIEVANN

SEQ ID NO: 9097 - protein, 558 aa, Taxus baccata
MGSIDWKLADHPKLPKGKQLAVIILDGWGEEKPDQYNCIHVADTPTMDSLKQGAPEKWTLVKAHGPAVGLPTEDDMGNSEVGHNALGAGRIFAQGAKLVDRALESGKIYDGEGFKYIKECFETGTLHFIGLLSDGGVHSRLDQLQLLLKGSAKNGAKRIRVHILTDGRDCLDGSSIGFVETLEKDLEELRKQGIDARIASGGGRMNVTMDRYENDWGVVKRGWDAHVLGEAPYKFKGAVEAVKKLREGPKASDQYLPPFVIVDENDKPVGPILDGDAVVTFNFRADRMVMIAKALEYENFSMFDRVRYPKIHYAGMLQYDGELKLPSHYLVVPPDIDRTSGEFLVHNGVRTFACSETVKFGHVTFFWNGNRSGYFNKDLEEYVEIPSDSGITFNEKPKMKALEIAEKARDAILSGKFDQVRVNLPNGDMVGHTGDIEATVVACKSADEAVKMILDAVEQAGGIYLVTADHGNAEDMVKRNTKTGKPQLDKDGKIQILTSHTLSPVPIAIGGPGLKEGVRFRNDLKQPGLANVAATMMNLLGFEAPSDYEPTLIEVVDN

SEQ ID NO: 9098 - protein, 559 aa, Solanum lycopersicum
MGSSGDAWKLKDHPKLPKGKTVAVIVLDGWGEAKPNEYNAISVAETPVMDSLKKGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRIRVHALTDGRDVLDGSSVGFMETLENDLAKLRGQGVDARVASGGGRMYVTMDRYENDWDVVKRGWDAQVLGEAPHHFKDPVEAIKKLRQEPNANDQYLAPFVIVDDNGKPVGPILDGDAVVTFNFRADRMVMLAKALEYENFDKFDRVRVPKIHYAGMLQYDGELKLPSKYLVSPPEIDRTSGEYLVRNGIRTFACSETVKFGHVTFFWNGNRSGYFDEKLEEYVEIPSDSGITFNVKPKMKALEIAERAREAILSHKFDQVRVNLPNSDMVGHTGDIKATIEACKAADDGVKMILDAIEQVGGIFLVTADHGNAEDMVKRNKKGEPLLDKNGNIQILTSHTLEPVPIAIGGPGLVPGVRFRTDLPTGGLANVASTFMNLHGYEAPSDYEPTLIEVVDN

SEQ ID NO: 9099 - protein, 496 aa, Carthamus tinctorius
MGSTGFSWKLADHPKLPKGKLVAMIVLDGWGEASPDKYNCIHVAETPTMDSLKNGAPEKWRLVRAHGTAVGLPTEDDMGNSEVGHNALGAGRIFAQGAKLVDLALASGKIYEDEGFNYIKESFANNTLHLIGLMSDGGVHSRLDQLQLLLRGASERGAKKIRVHVLTDGRDVLDGSSIGFAETLEAELSDLRSKGIDAQVASGGGRMYVTMDRYENDWEVVKRGWDAQVLGEAPHKFKNVVEAVKKLREAPGANDQYLPPFVIADESGKPVGPIVDGDAVVTFNFRADRMTMLAQALEYEKFDKFDRVRVPKIRYAGMLQYDGELKLPNHYLVSPPLIERTSGEYLVHNGVRTFACSETVKFGHVTFFWNGNRSGYFNSELEEYVEIPSDSGITFNEQPKMKALEIGEKTRDAILSGKFDQVRVNIPNGDMVGHTGDVEATVVACKAADEAVKMILDAVEQVGGIYVVTADHGNAEDMVKRNKKGEPILKDGKFRS

SEQ ID NO: 9100 - protein, 559 aa, Eutrema halophilum
MATSSAWKLDDHPKLPKGKTIALIVLDGWGESAPDQYNCIHNAPTPAMDSLKNGAPDTWTLIKAHGTAVGLPSEDDMGNSEVGHNALGAGRIYAQGAKLCDIALASGKIFDGEGFKYVSESFEKSTLHFVGLLSDGGVHSRLDQLQLLIKGSAERGAKRIRVHILTDGRDVLDGSSVGFVETLEADLAELRENGVDAQIASGGGRMYVTLDRYENDWEVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLQYDGELKLPSRYLVSPPEIDRTSGEYLAHNGVRTFACSETVKFGHVTFFWNGNRSGYFNEKLEQYVEIPSDSGISFNVQPKMKALEIGEKARDAILSGKFDQVRVNLPNGDMVGHTGDIEATVVACEAADKAVKMILDAIEQVKGIYVVTADHGNAEDMVKRDKSGKPALDKEGKLQILTSHTLKPVPIAIGGPGLSEGVRFRKDLETPGLANVAATVMNLHGFVAPSDYEPTLIEVVDKN

SEQ ID NO: 9101 - protein, 533 aa, Chelidonium majus
LDGWGEADEDKYNCIHVAQTPTMDSLKKGAPEHWRLVRAHGKAVGLPTEDDMGNSEVGHNALGAGRIFAQGAKLVDLALASGKLYDGEGFKYIKESFDNGTLHLIGLLSDGGVHSRLDQVQLLLKGVSERGAKRIRLHILTDGRDVLDGSSVGFVETLENDLVELRKKGIDAQIASGGGRMYVTMDRYENDWSVVKRGWDAQVLGEAPYKFKSAVEAVKTLRAEPKANDQYLPPFVIVDDSGKAVGPIVDGDAVVTFNFRADRMTMLAKALEYEDFKNFDRVRFPKIRYAGMLQYDGELLLPKKYLVSPPEIERTSGEYLVHNGVRTFACSETVKFGHVTFFWNGNRSGYFKEDMEEYVEIPSDSGITFNEQPLMKALEIGEKARDAILSGKWDQVRVNIPNGDMVGHTGDIEATVVACKAADEAVKMILDAIEQVGGIYVVTADHGNAEDMVKRNKKGEPLLDKEGKIQILTSHTLQPVPIAIGGPGLAPGVRFRKDVPEGGLANVAATVMNLHGYVAPSDYETTLIEVVDN

SEQ ID NO: 9102 - protein, 557 aa, Cirsium arvense
MGSTGFSWKLADHPKLPKGKLVAMIVLDGWGEASPDKYNCIHVAETPTMDSLKNGAPEKWRLVRAHGTAVGLPTEDDMGNSEVGHNALGAGRIFAQGAKLVDLALASGKIFEDEGFNYIKESFANNTLHLIGLMSDGGVHSRLDQLQLLLRGASERGAKKIRVHVLTDGRDVLDGSSIGFAESLEAELSDLRSKGIDAQVASGGGRMYVTMDRYENDWEVVKRGWDAQVLGEAPHKFKNVVEAVKKLREAPGANDQYLPPFVIADESGKPVGPIVDGDAVVTFNFRADRMTMLAQALEYEKFDKFDRVRVPKIRYAGMLQYDGELKLPNHYLVSPPLIERTSGEYLVHNGVRTFACSETVKFGHVTFFWNGNRSGYFNSELEEYVEIPSDSGITFNEQPKMKALEIGEKTRDAILSGKFDQVRVNIPNGDMVGHTGDVEATVVACKAADEAVKMILDAVEQVGGIYVVTADHGNAEDMVKRNKKGEPILKDGKVQILTSHTLQPVPIAIGGPGLTAGARFRKDVPSGGLANVAATVMNLHGFVAPDDYETTLIEVVD

SEQ ID NO: 9103 - protein, 557 aa, Flaveria ramosissima
MGSTGFSWKLADHPKLPKGKLVAMIVLDGWGEASPDKFNCIHVAETPTMDSLKNGAPDKWRLVRAHGTAVGLPTDDDMGNSEVGHNALGAGRIYAQGAKLVDLALASGKIFEDEGFNYIKESFATNTLHLIGLMSDGGVHSRLDQLQLLLRGASQHGAKRIRVHVLTDGRDVLDGSSVGFAQILEAELSDLRSKGIDAQVASGGGRMYVTMDRYENDWEVVKRGWDAQVLGEAPHKFKNVVEAIKTLREAPGANDQYLPPFVIVDDSGKPVGPIVDGDAVVTFNFRADRMTMLAQALEYENFDKFDRVRVPKIRYAGMLQYDGELKLPSHYLVSPPLIERTSGEYLVHNGVRTFACSETVKFGHVTFFWNGNRSGYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPILKDGEVQILTSHTLQPVPIAIGGPGLAPSVKFRKDVPSGGLANVAATVMNLHGFVAPDDYETTLIEVVD

SEQ ID NO: 9104 - protein, 556 aa, Lotus japonicus
MGSQWKLNDHPKLPKGKQIAMVVLDGWGEAKPNEYNCIHTAETPTMDSLKNGAPERWRLVKAHGKAVGLPTDDDMGNSEVGHNALGAGRIYAQGAKLVDIALESGSIYEGEGFKYIKECFETGTLHLLGLLSDGGVHSRLDQLQLLLKGVSERGVKRIRCHILTDGRDVLDGSSVAFVETLEDDLAKLREKGIDARIASGGGRMNVTMDRYENDWSVVKRGWDAQVLGEASHKFTSALEAVKTLRAEPKANDQYLPPFVIIDESGKPVGPIVDGDAVVTLNFRADRMVMIAKALEYENFDKFDRVRVPKIHYAGMLEYDGELKLPRHYLVSPPLIERTSGEYLVNNGIRIFACSETVKFGHVTFFWNGNRSGYFNPAMEEYVEIPSDSGITFNVKPKMKAVEIAEKARDAILSKKFDQVRVNLPNSDMVGHTGDIEATVVACKAADEAVKMILDAIEQVGGIYVVTADHGNAEDMVKRDKSGNPQLDKNGKIQILTSHTLEPVPLAIGGPGLSAGVRFRSDVPTGGLANVAATVINLHGFEAPSDYETTLIEVVDK

SEQ ID NO: 9105 - protein, 360 aa, Ambrosia trifida
MIVLDGWGEASPDKFNCIHVAETPTMDSLKNGAPDKWRLVRAHGTAVGLPTEDDMGNSEVGHNALGAGRIFAQGAKLVDSALASGKIYEDEGFNYIKESFATNTLHLIGLMSDGGVHSRLDQLQLLLRGASQHGAKRIRVHVLTDGRDVLDGSSVGFAETLEAELSDLRSKGIDAQVASGGGRMYVTMDRYENDWEVVKRGWDAQVLGEAPHKFKNVVEAIKTLREAPGANDQYLPPFVIVDDSGKAVGPVVDGDAVVTFNFRADRMTMLAQALEYEKFDKFDRVRVPKIRYAGMLQYDGELKLPSHYLVSPPLIERTSGEYLVNNGVRTFACSETVKFGHVTFFWNGNRSGYFNSELEE

SEQ ID NO: 9106 - protein, 111 aa, Flaveria ramosissima
MGSTGFSWKLADHPKLQKGKLVAMIVLDGWGEASPDRFNCIHVAETPTMDSLKNGAPDKWRLVRAHGTAVGLPTDDDMGNSEVGHNALGAGRIYAQGAKLVDLALASGKNI

SEQ ID NO: 9107 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 9108 - protein, 560 aa, Brassica napus
MGSSGDVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISESFEKGTVHLIGLLSDGGVHSRLDQVQLLLKGFAERGAKRIRVHILTDGRDVLDGSSVGFVETLESELAELRSKGVDAQVASGGGRMYVTMDRYENDWTVVKRGWDAQVLGEAPHKFKNALEAVKKLRAEPKANDQYLPPFVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 9109 - protein, 557 aa, Lactuca sativa
MGSKEVSWKLADHPKLPKGKLVAVVVLDGWGDASPGKYNCIHVAETPTMDSLKNTAPDKWRLVRAHGTAVGLPTEDDMGNSEVGHNALGAGRIYAQGAKLVDLALASGKIYDDEGFKYIKESFANNTLHLIGLMSDGGVHSRLDQLQLLLKGASERGAKKIRVHVLTDGRDVLDGTSVTHAETLEKDLSELRAKGIDAQIASGGGRMYVTMDRYENDWQVVKRGWDAQVLGEAPHKFKNAVEAIKKLREAPNANDQYLPPFVIVDDGGKAVGPIVDGDAVVTVNFRADRMTMLAQALEYEKFDKFDRVRFPKIRYAGMLQYDGELKLPSHYLVSPPLIERTSGEYLVNNGIRTFACSETVKFGHVTFFWNGNRSGCFNSEKEEYVEIPSDSGITFNEKPKMKAFEIGEKARDAILSGKFDQVRVNIPNGDMVGHTGDVDATIVACKAADEAVKTILDAVEKVGGIYVVTADHGNAEDMVKRDKKGEPIVGKDGKVQILTSHTLQPVPVAIGGPGLASGVKFRKDVPNGGLANVAATVMNLHGFVAPDDYETTLIEVA

SEQ ID NO: 9110 - protein, 559 aa, Solanum tuberosum
MGSSGDAWKLKDHPKLPKGKTVAVIVLDGWGEAKPNEYNAISVAETPVMDSLKQGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRIRVHALTDGRDVLDGSSVGFMETLENDLAKLREQGVDARVASGGGRMYVTMDRYENDWDVVKRGWDAQVLGEAPHHFKDPVEAIKKLRQEPNASDQYLAPFVIVDDNGKPVGPILDGDAVVTFNFRADRMVMLAKALEYEDFDKFDRVRVPKIHYAGMLQYDGELKLPNKYLVSPPEIDRTSGEYLVRNGVRTFACSETVKFGHVTFFWNGNRSGYFDEKLEEYVEIPSDSGITFNVKPKMKALEIAERTRDAILSHKFDQVRVNIPNSDMVGHTGDIKATIEACKAADDGVKMILEAIEQVGGIFLVTADHGNAEDMVKRNKKGEPLLDKNGNIQILTSHTLEPVPIAIGGPGLLPGVRFRTDLPTGGLANVAATFMNLHGFEAPSDYEPTLIEVVDN

SEQ ID NO: 9111 - protein, 559 aa, Zostera marina
MASSGLSWELEAHPTLPKGKTVAVVVLDGWGEATPDQYNCVHVAETPTMDSLKNGHPDTWRLVRAHGHAVGLPTEDDMGNSEVGHNALGAGRIFAQGAKLVDLALESGKIYDDEGFNYIKDCFAENTLHLIGLLSDGGVHSRLDQLQLLLKGSSERGAKRIRVHILTDGRDVLDGSSIGFVETLESTLSTLREKGIDAQIASGGGRMYVTMDRYENDWEVVKRGWDAQVLGEAPYQFKNAVEAVKNLREETKCSDQYLPPFVIVDDNGKAVGPIVDGDAVVTFNFRADRMTMIAKSLEYKDFDKFDRVRVPKIKYCGMLQYDGELLLPSHYLVSPPEIDRTSGEYLVHNGVKTFACSETVKFGHVTFFWNGNRSGYFDSSMEEYVEIPSDVGITFNVKPKMKALEIAEKARDIILSGKFHQVRVNLPNSDMVGHTGDIEATVVACKTSDKGVKMILDAVEQVGGIYLVTADHGNAEDMVKRNKAGNPALDKSGNIQVLTSHTLQPVPIAIGGPGLHSGVRFKRDVPNGGLANVAATVMNLHGLVAPSDYEETLIEVVGN

SEQ ID NO: 9112 - protein, 560 aa, Brassica napus
MGSSGNVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISEAFEKGTVHLIGLLSDGGVHSRLDQVQLLLKGFAERGAKRIRVHILTDGRDVLDGSSVGFVETLESELAELRSKGVDAQVASGGGRMYVTMDRYENDWTVVKRGWDAQVLGEAPHKFKNALEAVKKLRAEPKANDQYLPPFVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 9113 - protein, 559 aa, Manihot esculenta
MGSSGQFTWKLADHPKLPKEKIIAMVVLDGWGEANPDEYNCIHVAETPTMDSFKKTAPEKWRLIRAHGTAVGLPTEDDMGNSEVGHNALGAGRIFAQGAKLVDLALASGKIFEGEGFKYIKESFATNTLHLIGLLSDGGVHSRLDQLQLLLKGAAERGAKRIRVHVLTDGRDVIDGTSVGFVETLDKDLAILREKGVDAQIASGGGRMHVTMDRYENDWNVVKRGWDAQVLGEAPHKFRNALEAVKKLREEPKANDQYLPPFVIVDENGKPVGPIVDGDAVVTFNFRADRMVMIAKALEYEKFDKFDRVRFPKIRYAGMLEYDGELKLPSHYLVSPPEIEKTSGEYLVHNGVRTFACSETVKFGHVTFFWNGNRSGCFNPEMEEYVEIPSDVGITFNVKPKMKALEIAEKARDAILSRKFHQVRVNLPNGDMVGHTGDIDATVVACKAADDAVKMIIDAIEQVGGIYVVTADHGNAEDMVKRDKSGKPAVDKSGKIQILTSHTLQPVPIAIGGPGLAAGVRFRNDVPSGGLANVAATVINLHGFEAPGDYEPTLIEVVD

SEQ ID NO: 9114 - protein, 560 aa, Pseudotsuga menziesii
MGSTDFSFKLADHPKLPKGKQLAVIILDGWGEEKPDQYNCIHVAETPTMDSLKTGAPEKWTLIKAHGPAVGLPTEDDMGNSEVGHNALGAGRIFAQGAKLVDYALASGKIYEGEGFKYIKECFENGTLHLIGLLSDGGVHSRLDQLQLLLKGSAQNGAKRIRVHILTDGRDCLDGSSFGFVETLENDLAELRKQGVDALIASGGGRMYVTMDRYENDWGVVKRGWDAQVLGKAPHKFKSALEAVKKLREDHKVNDQYLPPFVIVDENEKAVGPILDGDAVVTINFRADRMTMVAKAFEYENFSAFDRVRYPKIRYAGMLQYDGELKLPSHYLVNPPDIDRTSGEYLVHNGIRTFACSETVKFGHVTFFWNGNRSGYFSEELEEYVEIPSDSGITFNVKPKMKALEIAEKTRDAILSGRFDQVRVNLPNGDMVGHTGDIDATIVACKSADEAVKIILDAIEQVGGIYLVTADHGNAEDMVKRNTKTGQPAKDKDGNIQILTSHTLSPVPIAIGGPGLAEGVRFRSDLKQPGLANVASTIINLLGFEAPNDYEPTLIEVTNH

SEQ ID NO: 9115 - protein, 280 aa, Pinus taeda
MSSTNFSFKLADHPKLPKGKQLAVVVLDGWGEEKPDQYNCIHVAETPAMDSLKKGAPEKWTLIKAHGPAVGLPTEDDMGNSEVGHNALGAGRIFAQGAKLVDYALASGKIYQGEGFTYIKECFENGTLHLIGLLSDGGVHSRLDQLQLLLKGVPQHGAKRIRVHILTDGRDCLDGSSIGYVETLENDLAELRKQGVDALIASGGGRMYVTMDRYENDWGVVKRGWDAQVLGKAPYKFRNAVEAVKKLREAPIVVINIYLHLSLSMKMTRPLDLFLMEMQW

SEQ ID NO: 9116 - protein, 557 aa, Ambrosia trifida
MGSTGFSWKLADHPKLPKGKLLAMIVLDGWGEASPDKFNCIHVADTPTMDSLKNGAPDKWRLVRAHGTAVGLPTEDDMGNSEVGHNALGAGRIYAQGAKLVDLALASGKIYEDEGFNYIKESFATNTLHLIGLMSDGGVHSRLDQLQLLLKGASQHGAKRIRVHVLTDGRDVLDGSSVGFAEILEAELSDLRSKGIDAQVASGGGRMYVTMDRYENDWEVVKRGWDAQVLGEAPHKFKNVVEAIKTLREAPGANDQYLPPFVIVDDSGKSVGPIVDGDAVVTFNFRADRMTMLAQALEYENFDKFDRVRVPKIRYAGMLQYDGELKLPSHYLVSPPLIERTSGEYLVHNGVRTFACSETVKFGHVTFFWNGNRSGYFNSELEEYVEIPSDSGITFNVQPKMKALEIGEKARDAILSGRFDQVRVNIPNGDMVGHTGDVEATVVACKAADEAVKTIIDAVEQVGGIYVVTADHGNAEDMVKRNKKGEPILKDGEVQILTSHTLQPVPIAIGGPGLAAVVKFRKDVPSGGLANVAATVMNLHGFVAPDDYEPTLIEVVD

SEQ ID NO: 9117 - protein, 557 aa, Arabidopsis lyrata
MATSSAWKLDDHPKLPKGKTIALIVLDGWGESAPDQYNCIHNAPTPAMDSLKHGAPDTWTLIKAHGTAVGLPSEDDMGNSEVGHNALGAGRIFAQGAKLCDQALASGKIFQGEGFKYVSESFETNTLHLVGLLSDGGVHSRLDQLQLLIKGSAERGAKRIRVHILTDGRDVLDGSSVGFVETLEADLVTLRENGVDAQIASGGGRMYVTLDRYENDWEVVKRGWDAQVLGEAPHKFKNAVEAVKTLRKEPGANDQYLPPFVIVDDSGKPVGPIVDGDAVVTFNFRADRMVMHAKALEYEDFDKFDRVRFPKIRYAGMLQYDGELKLPSRYLVSPPEIDRTSGEYLAHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLSKGVRFRKDLETPGLANVAATVMNLHGFVAPSDYEPTLIEVVE

SEQ ID NO: 9118 - protein, 557 aa, Arnica chamissonis
MGSTGFSWKLADHPKLPKGKLVAMIVLDGWGEASPDKFNCIHVAETPTMDSLKNGAPDKWRLVRAHGTAVGLPTEDDMGNSEVGHNALGAGRIFAQGAKLVDHALASGKIYEDEGFNYIKESFATNTLHLIGLMSDGGVHSRLDQVQLLLRGASQHGAKRIRVHVLTDGRDVLDGSSVGFAEILEAELSDLRGKGIDAQVASGGGRMYVTMDRYENDWEVVKRGWDAQVLGEAPHKFKNVVEAIKTLREAPGANDQYLPSFVIVDDSGKPVGPIVDGDAVVTFNFRADRMTMLAQALEYEKFDKFDRVRVPKIRYAGMLQYDGELKLPNHYLVSPPLIERTSGEYLVHNGVRTFACSETVKFGHVTFFWNGNRSGYFNSELEEYVEIPSDSGITFNVQPKMKALEIGEKTRDAILSGKFDQVRVNIPNGDMVGHTGDVEATVVACKAADEAVKMILDAVEQVGGIFVVTADHGNAEDMVKRNKKGEPLLKDGQVQILTSHTLQPVPIAIGGPGLAAGVKFRKDVPSGGLANVAATVMNLHGFVAPDDYETTLIEVVD

SEQ ID NO: 9119 - protein, 554 aa, Citrus clementina
MDNWKLKEHPQLSRNNIVAVVVLDGWGEYKPDKYNCIHVADTPTMDSFKKSAPERWRLVRAHGSAVGLPTEDDMGNSEVGHNALGAGRIFAQGAKLVDLALASGKIYQDEGFNYIKPSFETGTLHLIGLLSDGGVHSRLDQLQLLLKGASERGAKRIRLHILTDGRDVLDGSSVGFVETIEKDLAELRGKGVDAQIASGGGRMYVTMDRYENDWDVVKRGWDAQVLGEAPHKFKSAVEAVKKLREQPNANDQYLPPFVIVDENGKAVGPIVDGDAVVTFNFRADRMVMLAKALEYEDFDKFDRVRFPKIRYAGMLQYDGELKLPSHYLVSPPEIDRTSGEYLVHNGVRTFACSETVKFGHVTFFWNGNRSGYFDSNLEEYVEIPSDSGITFNVQPKMKALEIAERAKKAILSRRFHQVRVNLPNSDMVGHTGDIEATVVACKAADEAVKIIIDAIEKVGGIYLVTADHGNAEDMVKRNKSGEPLLKDGNIQVLTSHTLKPVPIAIGGPGLPDNVKFRADLPNGGLANVAATFINLHGYEAPSDYEPSLIEVTDD

SEQ ID NO: 9120 - protein, 559 aa, Brassica juncea
MASNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVETLEADLVKLRENGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEEYVEVPSDSGISFNVQPKMKALEIAEKARDAILSGKFDQVRVNLPNSDMVGHTGDIEATVVACEAADVAVKMILDAIEQVKGIYVVTADHGNAEDMVKRDKAGKPALDKEGKLQILTSHTLKPVPIAIGGPGLSEGVRFRKDLETPGLANVAATVMNLHGFVAPADYEPTLIEVVEKN

SEQ ID NO: 9121 - protein, 559 aa, Eutrema parvulum
MANSSAWKLDDHPKLPKGKTIALIVLDGWGESAPDQYNCIHNAPTPAMDSLKNGAPDTWTLIKAHGTAVGLPSEDDMGNSEVGHNALGAGRIYAQGAKLCDIALASGKIFDGEGFKYISESFEKSTLHFVGLLSDGGVHSRLDQLQLLIKGSVERGAKRIRVHILTDGRDVLDGSSVGFVETLEADLANLRENGVDAQIASGGGRMYVTLDRYENDWEVVKRGWDAQVLGEAPHKFKNAVEAVKTLRKEPGANDQYLPPFVIVDDAGKAVGPIVDGDAVVTFNYRADRMVMHAKALEYEDFDKFDRVRFPKIRYAGMLQYDGELKLPSHYLVSPPEIDRTSGEYLAHNGVRTFACSETVKFGHVTFFWNGNRSGYFNEKLEQYVEIPSDSGISFNVQPKMKALEIGEKARDAILSGKFDQVRVNLPNGDMVGHTGDIEATVVACEAADLAVKMILDAIEQVKGIYVVTADHGNAEDMVKRDKSGKPALDKEGKLQILTSHTLKPVPIAIGGPGLPEGVKFRKDLEIPGLANVAATVMNLHGFVAPSDYEPTLIEVVEKN

SEQ ID NO: 9122 - protein, 559 aa, Gossypium hirsutum
MGSSGQQVSWKLADHPTLPKGKTLALIVLDGWGEYKPDEYNCIHVAQTPTMDSLKQGAPEKWRLIRAHGKAVGLPTEDDMGNSEVGHNALGAGRIFAQGAKLVDIALASGKIYEGEGFKYISECFEKGTLHLIGLLSDGGVHSRLDQLQLLLKGASERGAKRIRVHILTDGRDVLDGSSVAFVETLESDLAKLRENGVDARIASGGGRMYVTMDRYENDWDVVKRGWDAQVRGEAPHKFANAVEAVKKLRENANDQYLPPFVIVDENEKAVGPIEDGDAVVTFNFRADRMVMLAKALEHQDFDKFDRVKVPKIHYAGMLQYDGELKLPGHYLVSPPEIDRTSGEYLVHNGVRTFACSETVKFGHVTFFWNGNRSGYFNPEMEEYAEIPSDVGITFNVQPKMKALEIGEKARDAILSRKFDQVRVNIPNGDMVGHTGDIQATVVACKAADEAVKMIIDAIEQVGGIYVVTADHGNAEDMVKRNKSGQPLYDKSGKLQILTSHTCQPVPIAIGGPGLAAGVRFRNDVPDGGLANVAATVMNLHGYVAPNDYEPTLIEVVNN

SEQ ID NO: 9123 - protein, 559 aa, Euphorbia peplus
MGSSGGVTWKLADHPKLPKGKTIAMVVLDGWGEAKPDEYNCIHVAETPTMDSFKKTAPEKWRLIRAHGPAVGLPTDDDMGNSEVGHNALGAGRIYAQGAKLVDQALASGKIYEDVGFNYIKESFANGTLHLIGLLSDGGVHSRLDQLQLLVKGAAEHGAKRIRVHVLTDGRDVIDGTSVGFVETLVKDLANLREKGVDAQIASGGGRMYVTMDRYENDWSVVKRGWDAQVLGEAPYKFKDAVEAVKTLRQEPKSNDQYLPPFVIVDDSGKAVGPIVDGDAVVTFNFRADRMTMLAKALEYENFDKFDRVRVPKIRYAGMLQYDGELKLPSYYLVSPPLIERTSGEYLTHNGVHTFACSETVKFGHVTFFWNGNRSGYFNEQMEEYVEIPSDVGITFNVQPKMKAIAIAEKAREAILSGKFHQVRVNIPNSDMVGHTGDVEATVVACKAADEAVKIIVDAIQQVGGIFVITADHGNAEDMVKRDKSGKPAKDKNGNVQILTSHTLEPVPIAIGGPGLASGVRFRNDVPDGGLANVAATVMNLHGFVAPDDYEKTLIEVVD

SEQ ID NO: 9124 - protein, 559 aa, Solanum phureja
MGSSGDAWKLKDHPKLPKGKTVAVIVLDGWGEAKPNEYNAISVAETPVMDSLKQGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRICVHALTDGRDVLDGSSVGFMETLENDLAKLREQGVDARVASGGGRMYVTMDRYENDWDVVKRGWDAQILGEAPHHFKDPVEAIKKLRQEPNATDQYLAPFVIVDDNGKPVGPILDGDAVVTFNFRADRMVMLAKALEYEDFDKFDRVRVPKIHYAGMLQYDGELKLPNKYLVSPPEIDRTSGEYLVRNGVRTFACSETVKFGHVTFFWNGNRSGYFDEKLEEYVEIPSDSGITFNVKPKMKALEIAERTRDAILSHKFDQVRVNIPNSDMVGHTGDIKATIEACKAADDGVKMILEAIEQVGGIFLVTADHGNAEDMVKRNKKGEPLLDKNGNIQILTSHTLEPVPIAIGGPGLLPGVRFRTDLPTGGLANVAATFMNLHGFEAPSDYEPTLIEVVDN

SEQ ID NO: 9125 - protein, 560 aa, Brassica rapa
MGSSGDVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISEAFEKGTVHLIGLLSDGGVHSRLDQVQLLLKGFAERGAKRIRVHILTDGRDVLDGSSVSFVETLESELAELRSKGVDAQVASGGGRMYVTMDRYENDWTVVKRGWDAQVLGEAPHKFKNALEAVKKLRSEPKANDQYLPPFVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 9126 - protein, 560 aa, Brassica napus
MGSSGNVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISEAFEKGTVHLIGLLSDGGVHSRLDQVQLLLKGFAERGAKRIRVHILTDGRDVLDGSSVSFVETLESELAELRSKGVDAQVASGGGRMYVTMDRYENDWTVVKRGWDAQVLGEAPHKFKNALEAVKKLRSEPKANDQYLPPFVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 9127 - protein, 554 aa, Unknown
  Sequence found in Organisms: Citrus sinensis, Citrus sinensis
MDNWKLKEHPQLSRNNIVAVVVLDGWGEFKPDKYNCIHVADTPTMDSFKKSAPGRWRLLRAHGSAVGLPTEDDMGNSEVGHNALGAGRIFAQGAKLVDLALASGKIYQDEGFNYIKPSFETGTLHLIGLLSDGGVHSRLDQLQLLLKGASERGAKRIRLHILTDGRDVLDGSSVGFVETIEKDLAELRGKGVDAQIASGGGRMYVTMDRYENDWDVVKRGWDAQVLGEAPHKFKSAVEAVKKLREQPNANDQYLPPFVIVDENGKAVGPIVDGDAVVTFNFRADRMVMLAKALEYEDFDKFDRVRFPKIRYAGMLQYDGELKLPSHYLVSPPEIDRTSGEYLVHNGVRTFACSETVKFGHVTFFWNGNRSGYFDSNLEEYVEIPSDSGITFNVQPKMKALEIAERAKKAILSRRFHQVRVNLPNSDMVGHTGDIEATVVACKAADEAVKIIIDAIEKVGGIYLVTADHGNAEDMVKRNKSGEPLLKDGNIQVLTSHTLKPVPIAIGGPGLPDDVKFRTDLPNGGLANVAATFINLHGYEAPSDYEPSLIEVTDD

SEQ ID NO: 9128 - protein, 557 aa, Brassica napus
MASNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVETLEADLAKLRENGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLETPGLANVAATVMNLHGFVAPADYEPTLIEVVE

SEQ ID NO: 9129 - protein, 180 aa, Cedrus atlantica
MGNTDFSWKLADHPKLPKGKQLAVIILDGWGEEKPDQYNCIHVAETPTMDSLKTGAPEKWTLIKAHGPAVGLPTEDDMGNSEVGHNALGAGRIFAQGAKLVDYALASGKIYEGEGFKYIKECFENGTLHLIGLLSDGGVHSRLDQLQLLLKGAAQNGAKRIRVHILTDGRDVLDGSSLGF

SEQ ID NO: 9130 - protein, 557 aa, Brassica rapa
MASNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVEILEADLAKLRENGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLETPGLANVAATVMNLHGFVAPADYEPTLIEVVE

SEQ ID NO: 9131 - protein, 547 aa, Centaurea maculosa
ADHPKLPKGKLVAMIVLDGWGEASPDKYNCIHVAETPTMDSLKNGAPEKWRLVRAHGTAVGLPTEDDMGNSEVGHNALGAGRIFAQGAKLVDLALASGKIYEDEGFNYIKESFANNTLHLIGLMSDGGVHSRLDQLQLLLRGASERGAKKIRVHVLTDGRDVLDGSSIGFAETLEAELSDLRSKGIDAQVASGGGRMYVTMDRYENDWEVVKRGWDAQVLGEAPHKFKNVVEAVKKLREAPGANDQYLPPFVIADESGKPVGPIVDGDAVVTFNFRADRMTMLAQALEYEKFDKFDRVRVPKIRYAGMLQYDGELKLPNHYLVSPPLIERTSGEYLVHNGVRTFACSETVKFGHVTFFWNGNRSGYFNSELEEYVEIPSDSGITFNEQPKMKALEIGEKTRDAILSGKFDQVRVNIPNGDMVGHTGDVEATVVACKAADEAVKMILDAVEQVGGIYVVTADHGNAEDMVKRNKKGEPILKDGKVQILTSHTLQPVPIAIGGPGLTSGARFRKDVPSGGLANVAATVMNLHGFVAPDDYETTLIEVVD

SEQ ID NO: 9132 - protein, 557 aa, Brassica napus
MASNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVETLEADLAKLRDNGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLEIPGLANVAATVMNLHGFVAPADYEPTLIEVVE

SEQ ID NO: 9133 - protein, 532 aa, Tropaeolum majus
DGWGEANPDKYNCIHVAETPVMDSLKNGAPDKWRLIKAHGTAVGLPTEDDMGNSEVGHNALGAGRIYAQGAKLVDIALASEKIYDEDGFKYISESFESGTLHLISLLSDGGVHSRIDQLQLLLKGASERGAKRIRVHILTDGRDVLDGSSVGFAETLESDLAKLRENGIDAQVASGGGRMYVTMDRYENDWSVVKRGWDAQVLGEAPYKFKSAVEAIKTLRQEPKANDQYLPPFVIVDDSGKAVGPIVDGDAVVTMNFRADRMVMLAKALEYENFNNFDRVRFPKIRYAGMLQYDGELKLPSRYLVSPPLIERTSGEYLVHNGVRTFACSETVKFGHVTFFWNGNRSGYFKEDMEEYVEIPSDSGITFNVKPKMKALEIAEKARDAILSRKFQQVRVNLPNSDMVGHTGDIEATVVACKAADEAVKMIIDAIEQVSGIYVVTADHGNAEDMVKRDKAGKPAMDKSGNIQILTSHTLQPVPVAIGGPGLASGVRFRKDVPTGGLANVAATVMNLHGYIAPDDYETTLIEVVDA

SEQ ID NO: 9134 - protein, 557 aa, Raphanus sativus
MATNWKLDDHPKLPKGKTVAMIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVETLEADLAKLRENGVDAQIASGGGRMYVTLDRYENDWGVVKRGWDAQVLGEAPHKFKNAVEAVKTLRKEPGANDQYLPPFVIVDEAGKAVGPILDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIEATVVACEAADVAVKMILDAIEQVKGIYVVTADHGNAEDMVKRDKAGKPALDKEGNLQILTSHTLKPVPIAIGGPGLSEGVRFRKDLETPGLANVAATVMNLHGFVAPADYEPTLIEVVEKN

SEQ ID NO: 9135 - protein, 558 aa, Sciadopitys verticillata
MGSTDFSWKLADSPKFPKGKQLAVIVLDGWGEEKPDQYNCIHVAETPTMDSLKKGAPEKWTLIKAHGPAVGLPTEDDMGNSEVGHNALGAGRIFAQGAKLVDQAIESGKIYDGEGFKYIKECFENGTLHLIGLLSDGGVHSRIDQLQLLLKGSAKNGAKRIRVHILTDGRDCLDGSSVGFVETLENDLAELCKQGVDARIASGGGRMYVTMDRYENDWGVVKRGWDAQVLGEAPHKFRSAVEAVKKLRQAPKASDQYLPPFVIVDENEKAVGPILDGDAVVTINFRADRMTMVAKAFEYENFSAFDRVRYPKIHYAGMLQYDGELKLPSHYLVNPPDIDRTSGEYFVHNGIRTFACSETVKFGHVTFFWNGNRSGYFNEDLEEYVEIPSDSGITFNAKPKMKALEIAEKTRDAILSRKFDQVRINLPNGDMVGHTGDIEATVVACKAADEAVKIVLDAVEQVGGIYLVTADHGNAEEMVKRNTKTGQPQLDKDGKIQVLTSHTCSPVPIAIGGPGLKEGVRFRTDLKQPGLTNVAATMMNLLGFEAPSDYEPTLIEVV

SEQ ID NO: 9136 - protein, 581 aa, Secale cereale
SSATPLSEKFFLFRKPHEEKSKGDGDHELDAPRPPHAPKREGRWPSSCSTDGAEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 9137 - protein, 560 aa, Abies balsamea
MGSTDTSLKLADHPKLPKGKQLAVIILDGWGEEKPDQYNCIHVAETPTMDSLKTGAPEKWTLIKAHGPAVGLPTEDDMGNSEVGHNALGAGRIFAQGAKLVDYALASGKIYSGEGFNYIKECFVNGTLHLIGLLSDGGVHSRLDQLQLLLKGAAQNGAKRIRVHILTDGRDCLDGSSFGYVETLESDLAELRKQGVDALIASGGGRMYVTMDRYENDWSVVKRGWDAQVLGQAPHKFRNALEAVKKLREDPKINDQYLPPFVIVDENDKAVGPILDGDAVVTINFRADRMTMVAKAFEYEDFSAFDRVRYPKIRYAGMLQYDGELKLPAHYLVSPPDIDRTSGEYLVHNGIRTFACSETVKFGHVTFFWNGNRSGYFNKDLEEYVEIPSDSGITFNVKPKMKALEIAEKTRDAILSGRFDQVRVNLPNGDMVGHTGDIDATIIGCKSADEAVKIILDAIEQVGGIYLVTADHGNAEDMVKRNSKTGQPEKGKDGKIQILTSHTCNPVPIAIGGPGLTQGVRFRTDLKQPGLANVASTIINLLGFEAPSDYEPTLIEVANN

SEQ ID NO: 9138 - protein, 145 aa, Brassica juncea
MATNWKLDDHPKLPKGKTIALIVLDGWGESAPDEYNCVHTAPTPTMDSLKNGRPDTWTLIKAHGTAVDSPAKMTWETVRLVTTLLVLVVSSLRVLSFATLLLLPAKSLTVKVSNTSLNLSRRTLCTSLDFSVTVESTLVSTSSNC

SEQ ID NO: 9139 - protein, 391 aa, Centaurea maculosa
  misc_feature (258)..(258): Xaa can be any naturally occurring amino acid
LADHPKLPKGKLVAMIVLDGWGEASPDKYNCIHVAETPTMDSLKNGAPEKWRLVRAHGTAVGLPTEDDMGNSEVGHNALGAGRIFAQGAKLVDLALASGKIYEDEGFNYIKESFANNTLHLIGLMSDGGVHSRLDQLQLLLRGASERGAKKIRVHVLTDGRDVLDGSSIGFAETLEAELSDLRSKGIDAQVASGGGRMYVTMDRYENDWEVVKRGWDAQVLGEAPHKFKNVVEAVKKLREAPGANDQYLPPFVIADEXGKPVGPIVDGDAVVTFNFRADRMTMLAQALEYEKFDKFDRVRVPKIRYAGMLQYDGELKLPNHYLVSPPLIERTSGEYLVHNGVRTFACSETVKFGHVTFFWNGNRSGYFNSELEDMLKFQVIVELPSTNNQR

SEQ ID NO: 9140 - protein, 194 aa, Flaveria ramosissima
MSHFSGTETVLDYFNSELEEYVEIPSDSGITFNVQPKMKALEIGEKARDAILSGKFDQVRVNIPNGDMVGHTGDVEATVVACKAADEAVKMILDAVEQVGGIYVVTADHGNAEDMVKRNKKGEPILKDGEVQILTSHTLQPVPIAIGGPGLAPGVKFRKDVPSGGLANVAATVMNLHGFVAPDDYETTLIEVVD

SEQ ID NO: 9141 - protein, 557 aa, Brassica juncea
MATNWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVETLEADLAKLRENGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLETPGLANVAATVMNLHGFVAPADYEPTLIEVVEKN

SEQ ID NO: 9142 - protein, 554 aa, Centaurea maculosa
MATNWKLADHPKLPKGKIIAVVVLDGWGEASPDKFNCIHVAETPTMDSFKKSAPDRWRLVKAHGTAVGLPTDDDMGNSEVGHNALGAGRIYAQGAKLVDLALASGKIYEDEGFNYIKESFANNTLHLIGLLSDGGVHSRLDQLQLLLKGASERGAKRIRVHVLTDGRDVVDGTSVGFAETLEKDLAELRGKGIDAQVASGGGRMYVTMDRYENDWEVVKRGWDAQVLGEAPHKFKNAVEAIKKLREAPNANDQYLPPFVIVDESGKPVGPIMDGDAVVTFNFRADRMTMLAQALENEKFDKFDRVRFPKIRYAGMLQYDGELKLPSHYLVSPPLIERTSGEYLVHNGIRTFACSETVKFGHVTFFWNGNRSGYFNSDLEEYVEIPSDSGITFNVQPKMKALEIGKKARDAILSRKFDQVRVNIPNGDMVGHTGDIEATVVACKAADEAVKMIIDAVTEVGGIYVVTADHGNAEDMVKRNKKGEPLVGKDGKVQIQTSHTLQPVPVAIGGPGLAGGVKFRKDVPNGGLANVAATVMNLHGFVAPDDYETTLIEVV

SEQ ID NO: 9143 - protein, 557 aa, Brassica napus
MATNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVEILEADLAKLRENGVDAQIASGGGRMYVTLDRYENDWGVVKRGWDAQVLGEAPHKFKNAVEAVKTLRKEPGANDQYLPPFVIVDDAGKAVGPIVDGDAVVTFNFRADRMVMHAKALEYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLEIPGLANVAATVMNLHGFVAPADYEPTLIEVVE

SEQ ID NO: 9144 - protein, 554 aa, Cirsium arvense
MATNWKLADHPKLPKGKIIAVVVLDGWGEASPDKFNCIHVAETPTMDSFKKSAPDRWRLVKAHGTAVGLPTDDDMGNSEVGHNALGAGRIYAQGAKLVDLALASGKIYEDEGFNYIKESFANNTLHLIGLLSDGGVHSRLDQLQLLLKGASERGAKRIRVHVLTDGRDVVDGTSVGFAETLEKDLAELRGKGIDAQVASGGGRMYVTMDRYENDWEVVKRGWDAQVLGEAPHKFKNAVEAIKKLREAPNANDQYLPPFVIVDESGKPVGPIMDGDAVVTFNFRADRMTMLAQALENEKFDKFDRVRFPKIRYAGMLQYDGELKLPSHYLVSPPLIERTSGEYLVHNGIRTFACSETVKFGHVTFFWNGNRSGYFNSDLEEYVEIPSDSGITFNVQPKMKALEIGKKARDAILSRKFDQVRVNIPNGDMVGHTGDIEATVVACKAADEAVKMIIDAVSEVGGIYVVTADHGNAEDMVKRNKKGEPLVGKDGKVQIQTSHTLQPVPVAIGGPGLAGGVKFRKDVPNGGLANVAATVMNLHGFVAPDDYETTLIEVV

SEQ ID NO: 9145 - protein, 533 aa, Valeriana officinalis
GSTWKLADHPKLPKGKIVAMVVLDGWGEASPNKYNCIHVAETPTMDSLKKGAPDKWRLVRAHGTAVGLPTEDDMGNSEVGHNALGAGRIYAQGAKLVDLALASGKIYEGEGFKYIKECFESNTLHLIGLLSDGGVHSRLDQLQLLLKGVGERGAKKIRIHILTDGRDVLDGSSIGFVETLENELTKLREKGIDAKIASGGGRMYVTMDRYENDWSVVKRGWDAQVLGEAPHKFKCAIEAVKKLRAEPKANDQYLPPFVIVDESGKAVGPIMDGDAVVTFNFRADRMVMLAKALEYKDFDKFDRVRVPKINYAGMLQYDGELKLPSHYLVSPPEIERTSGEYLVHNGVRTFACSETVKFGHVTFFWNGNRSGYFNSEMEEYVEIPSDSGITFNVQPKMKALEIAEKARDAILSRKFHQVRVNLPNGDMVGHTGDIEATVVACKAADEAVKMILDAIEQVGGIYIVTADHGNAEDMVKRDKKGEPILDKSGNVQILTSHTLEPVPIAIGGPGLAKGVRFRKDVPDGGLANVAATA

SEQ ID NO: 9146 - protein, 561 aa, Gnetum gnemon
MGSAGNAAAWKLADHPKLPKGKLLAVVVLDGWGEQKPDPYNCIHVAETPAMDSLKKGAPEHWRLIKAHGPAVGLPTEDDMGNSEVGHNALGAGRIFAQGAKLVDLALESGKIYEGEGFKYIKGSYDSGTLHLIGLLSDGGVHSRLDQIQLLLKGSAKNGAKRIRVHVLTDGRDVLDGTSVHFAEVLEQDLVELRKQGVDAQIASGGGRMYVTMDRYENDWEVVKRGWDAQVLGEAPHKFKNAVEAIKTLRQETKASDQYLPPFVIVDDNGKPVGPILDGDAVVTVNFRADRMVMVAKAFEYKDFDKFDRVRVPNIRYAGMLQYDGELKLPSQYLVSPPDIDRTSGEYLVHNGIRTFACSETVKFGHVTFFWNGNRSGYFNKDLEEYVEVQSDVGITFNVKPKMKALEIAKKARDAILSGKFDQVRVNIPNGDMVGHTGDVEATIVGCKVADDAVKIILDAVEQVGGIYLVTADHGNAEEMVKRDKKGQPALDKAGNVQILTSHTCNPIPIAIGGPGLAKGVRFRNDLKVPGLANVAATMMNLLGFEAPSIYEPPLIEVVDN

SEQ ID NO: 9147 - protein, 530 aa, Secale cereale
MGEASPTSTTASTVPRRPSWIRSKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLYAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 9148 - protein, 521 aa, Plantago ovata
NCIHVAETPLWIHSRMVLLRSGGLVRAHGKAVGLPTEDDMGNSEVGHNALGAGRIFAQGAKLVDIALETGKIYDGEGFNYIKESFANGTLHLIGLLSDGGVHSRLDQVQLLLKGASERGAKRIRLHVLTDGRDVLDGSSIGFIEILENDLAKLREKGVDAQIASGGGRMNVTMDRYENDWNVIKRGWDAQVLGEAPHKFKSALEAVKTLRAAPGANDQYLPPFVIVDDSEKAVGPIVDGDAVVTFNFRADRMVMMAKALEYAEFDKFDRVRVPKIRYAGMLQYDGELKLPNRYLVSPPEIDRTSGEYLVKNGVRTFACSETVKFGHVTFFWNGNRSGYFNKDLEEYVEIPSDSGISFNVQPKMKALEIAEKARDAILSGKFDQVRVNIPNSDMVGHTGDIDATIVACKAADIGVKMIIDAIEQIGGIYVVTADHGNAEDMVKRNKKGEPLLDKNGQIQILTSHTLEPVPIAIGGPGLAPGVRFRKDVPDGGLANVAATVMNLHGFEAPSDYETTLIEVADN

SEQ ID NO: 9149 - protein, 596 aa, Secale cereale
NQHVRKKDKGEWPDHELTLPDHPTLPTGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLICKGASERGAKRIRLHILTDGRDVLDGSSVGFVETIEKDLAQLREQGVDARIASGGGRMYVTMDRYENDWSVVKRGWDAQVLGEAPYKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHAPAPADYETTSSKSSTSKKNTVLSEAKIAVANFVAIVLGWVEWSHR

SEQ ID NO: 9150 - protein, 264 aa, Triticum aestivum
MALMPVELCYATVASPVAAPSARRAPRRRAVVRCAASAPAPMGEKTEYRDGPLERAFMGLFARKMEKFAGRKKKPGPGGEEEKKAVWEWDYESFVDVSRRVMVGRSRAQQQEAVREVLLSMLPPGAPEQFKKLFPPTRWACEFNAALTVPFFHWLVGPSEVIEVEVDGVKQRSGVLIKKCRYLENSGCVGMCVNMCKIPTQSFFTDEFGLPLTMNPNFEDMSCEMIYGQVPPPLEEDPVSKQPCYPSLCSISTPSAAICPKIQN

SEQ ID NO: 9151 - protein, 277 aa, Panicum virgatum
  misc_feature (86)..(86): Xaa can be any naturally occurring amino acid
  misc_feature (90)..(91): Xaa can be any naturally occurring amino acid
  misc_feature (95)..(95): Xaa can be any naturally occurring amino acid
  misc_feature (106)..(106): Xaa can be any naturally occurring amino acid
  misc_feature (272)..(272): Xaa can be any naturally occurring amino acid
MEAARPMELCFAARAGTLTPTPAGRAPARLKKRRAGAGTTVRCAATAPAPMGEKTEYRDGPLERAFMGLFARKMEKYATGGGGGKXKQQXXAGTXKEKAVWEWDYXSFVDVSRRVMVGRTRAQQQEAVREVLLSMLPPGAPEQFRKLFPPTRWACEFNAALTVPFFHWLVGPSEVIEVEVNGVKQKSGVLIKKCRYLENSGCVGMWVNMCKIPTQDFFTNEFGLPLTMNPNFEDMSCEMIYGQVPPPLEEDPASKQPCYPNLCSMSTPSAPXCPKLQ

SEQ ID NO: 9152 - protein, 264 aa, Secale cereale
MTLMPLELCYATVASPVAAPSARWAPRRRAVVRCAASAPAPMGEKTEYRDGPLERAFMGLFARKMEKFAGRKKKPGPGGEEEKKAVWEWDYESFVDVSRRVMVGRSRAQQQEAVREVLLSMLPPGAPEQFRKLFPPTRWACEFNAALTVPFFHWLVGPSEVIEVEVDGVKQRSGVLIKKCRYLENSGCVGMCVNMCKIPTQSFFTDEFGLPLTMNPNFEDMSCEMIYGQVPPPLEEDPVSKQPCYPSLCSISTPSAAICPKIQN

SEQ ID NO: 9153 - protein, 265 aa, Setaria italica
MELCFAARAVTPAPAGRAPARPRKRRAGAVRCAATAPAPMGEKTEYRDGPLERAFMGLFARKMEKYATKKKQQQQQQTELEKKKKAVWEWDYESFVDVSRRVMVGRTRAQQQEAVREVLLSMLPPGAPEQFRKLFPPTRWACEFNAALTVPFFHWLVGPSEVIEVEVDGVKQKSGVLIKKCRYLENSGCVGMCVNMCKIPTQDFFTNEFGLPLTMNPNFEDMSCEMIYGQVPPPLEEDPVSKQPCYPNLCSMSTPSAPVCPKLQT

SEQ ID NO: 9154 - protein, 264 aa, Hordeum vulgare
MALMPVELCYATLASPVAAPSGRRVPRRRAVVRCAATAPAPMGEKTEYRDGPLERAFMGLFARKMEKFAGRKKKPGPGGEEEKKAVWEWDYESFVDVSRRVMVGRSRAQQQEAVREVLLSMLPPGAPEQFKKLFPPTRWACEFNAALTVPFFHWLVGPSEVIEVEVDGVKQRSGVLIKKCRYLENSGCVGMCVNMCKIPTQSFFTDEFGLPLTMNPNFEDMSCEMIYGQVPPPLEEDPVSKQPCYPSLCSISTPSAAICPKIQN

SEQ ID NO: 9155 - protein, 258 aa, Avena sativa
MALMPVELCFAARASPATRTLPRRRATVRCAATAPAPMGEKTEYRDGPLERAFMGLFARKMEKYAGRKKKPGGEVEKKAVWDWDYESFVDVSRRVMVGRSRAQQQEAVREVLLSMLPPGAPEQFKKLFPPTRWACEFNAALTVPFFHWLVGPSEVVEVEVDGVKQRSGVLIKKCRYLENSGCVGMCVNMCKIPTQSFFTDEFGLPLTMNPNFEDMSCEMIYGQVPPPLEEDPVSKQPCYPSLCSISTPAAAICPKLQN

SEQ ID NO: 9156 - protein, 340 aa, Triticum aestivum
MGMEGCCNKKVMEEEALVKKITGLAAAIGELPSLSPSPAVNALFTELVTSCIPASTVDVDALGPEAQEMRARLIRLCADAEGHLEAHYSDLLAAHDNPLDHLTLFPYFNNYIKLSQLEHGLLARHVPGPAPARVAFLGSGPLPLSSLVLAARHLPDASFDNYDISGEANERASRLVRNDADAGARMAFRTADVADVTTELAGYDVVFLAALVGMAAEEKARLVEHLGRHMAPGAALVVRSAHGARGFLYPVVNPEEIRRGGFEVLTVHHPEDEVINSVIIARKAAAPAAVAADGDVPVNNGGMPAQCAVAVSRPCLGCACELGTRAHQKMKEMAMEEMEA

SEQ ID NO: 9157 - protein, 340 aa, Leymus cinereus x Leymus triticoides
MGMEGCCNNKVMEEEALVKKITGLAAAIGDLPSLSPSPEVNALFTELVVSCIPPSTVDVDALGPEAQEMRARLIRLCADAEGHLEAHYSDLLAAHDNPLDHLTLFPYFNNYIKLSQLEHGLLARHVPGPAPARVAFLGSGPLPLSSLVLAARHLPAASFDNYDISGEANERASRLVRADADAGARMAFRTADVADVTTELAGYDVVFLAALVGMAAEEKARLVEHLGRHMAPGAALVVRSAHGARGFLYPVVDPEEIRRGGFEVLTVHHPEDEVINSVIIARKAAAPPAVAADGDVPVNNGSMPAQCAVAVSRPCLGCACELGARAHQKMKEMAMEEMEA

SEQ ID NO: 9158 - protein, 340 aa, Hordeum vulgare
MGMEGCCSNKKVMEEEALVKKITGLAAAIGELPSLSPSPEVNALFTELVTSCIPPSTVDVDALGPDAQEMRARLIRLCADAEGHLEAHYSDLLAAHDNPLDHLTLFPYFNNYIKLSQLEHGLLARHVPGPAPARVAFLGSGPLPLSSLVLAARHLPDASFDNYDISGEANERASRLVRADADAGARMAFRTADVADVTTELAGYDVVFLAALVGMAAEEKARLVEHLGRHMAPGAALVVRSAHGARGFLYPVVDPEEIRRGGFEVLTVHHPEDEVINSVIIARKAAAPPPVAADGDVPVNMPMPAQCAVAVSRPCLGCACELGARAHQKMKEIAMEEMEA

SEQ ID NO: 9159 - protein, 337 aa, Avena sativa
MGMEGCKVMEEEVLVKKITGLAAAIGELPSLSPSPEVNALFTELVVSCIPPSTVDVDLLGPEAQDMRARLIRLCADAEGHLEAHYSDLLATHDNPLDHLTVFPYFNNYIKLSQLEHGLLAKHIPGPPPSRVAFLGSGPLPLSSLVLAARHLPDASFDNYDISGSANERARRLVRADADAGARMAFVTADVADVTEELSGYDVVFLAALVGMAAEEKAALVAHLGRHMAPGAALVVRSAHGARGFLYPVVDPEEIRRGGFEVLTVHHPQDEVINSVIIARKEPAAPALAADADTPVNNGGLNAQCAVAVSRPCLGCTCEMEARAHQKMTEMAMEEMEA

SEQ ID NO: 9160 - protein, 258 aa, Pseudoroegneria spicata
MDYHQQQQHQFLMPPPASLPAQQQQLCAPMMDMDMDEQLCFVGRGGGGAATGRGAERKRRFTEEQIRSLESMFHAHHAKLEPREKAELARELGLQPRQVAIWFQNKRARWRSKQLEHDFAALRASYDALHSRVESLKQEKLALAAQLHELSERLRERDGGSGGAATATASSSSCNGGSRELDDDKRNVVAGCVDVEPPESCVLGGTACATPADVSVSVESECDDHLHYDGAVFPESFCATPELWEPWPWPPVEWNAVA

SEQ ID NO: 9161 - protein, 224 aa, Secale cereale
MEMDMDMDEQLCFVGRAAGAGPERKRRFTEEQIRSLESMFHAHHAKLEPREKAELARELGLQPRQVAIWFQNKRARWRSKQLEHDFAALRADYDALHSRVESLKQEKLALAAQLHELSERLRERDGGAATATASSSSCNGAGQELDDDKRNVVDVEPPRAACSAGRRAARLRTSRCRWSPSATTTSTTTGRPSRSPSAPRRSCGSRGRGRPSSGTPWPEAVEVD

SEQ ID NO: 9162 - protein, 253 aa, Leymus cinereus x Leymus triticoides
MDYHQQQQQQHRFLMPLPASLPAQQQQQLCAPMVDMDMDEQLCFMGRGGGAAGRGAERKRRFTEEQIRSLESMFHAHHAKLEPREKAELARELGLQPRQVAIWFQNKRARWRSKQLEHDFAALRANYDALHSRVESLKQEKLTLAAQLHELSERLREREGGGGSTTATASSSSCNGGGQELDDDKRNVDVEPPESCVLGGTTCATPADVSVSVESECDDHLNYDGAVFPESFCATPELWEPWPWPPVEWNAVA

SEQ ID NO: 9163 - protein, 266 aa, Hordeum vulgare
MDYHHHHHQQQQQFLMPPPASLPAAQQQQQQQQQMCAPMMDMEMEEQVCFVGRGGGGGGRGAERKRRFTEEQIRSLESMFHAHHAKLEPREKAELARELGLQPRQVAIWFQNKRARWRSKQLEQDFAALRASYDALHSRVESLKHDKLALAAQLQELSERLRERDGGSGGGGGGATIAAASSSSCNGGGRELDDDKRNGDVEQEPTESCVLVGTACATPADVSVSVESECDDHLRYDGAVFPESFCATPELWEPWPWPPVEWNAVA

SEQ ID NO: 9164 - protein, 156 aa, Triticum aestivum
MSKAFTKSLLLYNKILIRRLKSLITRAPPAPASATERLPPSHKHESSTAPLDALPAPGTTDDDNDNGGRAGGGTIVCEVEGGLLMSSSTFPYFMLVALEAGGLLRGLLLLLLYPLLRLLTDELAMKAMVMVTFAGLRRTRLAGWAWPSCPSCSCRT

SEQ ID NO: 9165 - protein, 666 aa, Brachypodium distachyon
MPPRRKGRGRGRGKPKPKSTAPEPVDETVETEVDAAEDAKPEEQSDEDSKGDSSESGAEDMDAEDAEEEAADSKAEEMDAEEAADAKANGAEVETKGEEMDAKAEAEAEGAESDSEGEADADADLEAEAEETDGENEEKAAGTGGESEEEAAETGGENEEEADGTDGEDGEEGAETGGENEDDGADSDPEGQGTDAEPDAVEESPPPSPLARSRRRKRATTPDPAPEAEDHEAEETPVPPRRRRRRKSGDRGNSPSPPPDHLRCRRSDGKKWRCQALALPTVSFCEYHYARASKGKKPPADGEVLAVALQRQKKNRRKGRRSLNLTPASPPKATKDLPNGLMTISPGSSGAAGSPITMKVGVDIPVPLRRCYRSKNAEPLPVGPVKVVPRAMGMAKAAAQNACHRCGLKKVARVVKCKNCNNQYFCNSCINKWYSGMSKKDIKMQCPVCRGSCDCEECTLGQSRGAMSKGSASDHSKLVRIKICNHQLYKLLPLNLNQEQLDELEIESKIQGTKISNIRVQVAEDDHSGSLYCNNCKLSMHQALRSCPRCPFKLCLSCCQKIREGNMSDSTPEDKFTQRLLQQESVQEDGSISCPSIELGGCGDSLLNLIYAPPSGQSEEFSSGDEQDAPGNHSGDKDAQPHSSPLAESNGSLARLSGGQQESMST

SEQ ID NO: 9166 - protein, 569 aa, Secale cereale
SGYPTMTMDEQNALCAAPFGDPAFNATIRRRGVRLADVACLPISPGWYGPAEDGGRRLIKSQCYSTEGTANFYMRPIEGLTVLVDMDTRKVVHISDRGAGIPIPAAKNTDYRRAANDNDDDADKFGYQTVRAPSMEPAPEGPGIQIEDGHTVRWAGWEFHLKADARAGLIVSSATVQDPATGARREVMYKGMASELFVPYMDPTEAWYFKTYMDAGEYGFGLQAMPLVPLNDCPRHARYMDGVFVAADGRPYVRENMICVFERYAGDIAWRHSESPITGMDIRESRPKVTLVARMAASVANYDYIVDWEFQTDGLIRIKVGLSGILMVKGTPYSHMNQVRQNEEMHGTLLSENVIGVIHDHYVTFRLDMDVDGADNSFVRVEMARQDTTPGESPRRSYLKATRHVASTEKDARVRLKLYEPAEFHVINPTKKTRVGNPVGYKVVPAGTAGSLLDPEDPPQKRGAFTNNQIWVTPYNKSEEWAGGLFVYQSKGEDTLATWSERDRPIDNKDLVLWYTLGFHHIPCQEDFPIMPTVSSSFDLKPVNFFESNPILKQRPTMEKDLPVCAATA

SEQ ID NO: 9167 - protein, 595 aa, Avena sativa
GRVPRAGRRPRSWDGHSSACPCFRVPDDDHGRAEGALRGAVREPGVQRQHPPPRRAHGGRGVPAHLAGVVRPRGGRRAPAHQEPVLLDRGHGQLLHAPHRGPHGADRHGHQGGGPPLRPRRRHPIPAAKNTDYRRAAAAEEEDDAGGAKTFGYQAVRAPSMEPAPEGPGFEVEDGHTVRWAGWEFHLKADARAGLIVSRAGVEDPSTGARREVMYKGMASELFVPYMDPTEAWYFKTYMDAGEYGFGLQAMPLVPLNDCPRHARYMDGVFVAADGRPYVRENMVCVFERYAGDIAWRHSESPITGMDIRESRPKVTLVARMAASVANYDYIMDWEFQMDGLIRIKVGLSGILMVKGTPYSHMNQVRRNEEMYGTLLSENVVGVIHDHYVTFRLDMDVDGADNSFVRVEMARQDTAPGESPRRSYLKATRHVASTENDAKVRMKLYEPAEFHVINPTKKTRVGNPVGYKVVAAGTAASLLDPEDPPQKRGAFTNNQIWVTPYNKSEEWAGGLFVYQSKGEDTLATWSERDRPIENKDIVLWYTLGFHHVPCQEDFPIMPTVSSSFDLKPVNFFESNPILRQRPTQVNDLPVCAATA

SEQ ID NO: 9168 - protein, 646 aa, Avena sativa
VAYPPFASAPSSLAVHELALDEPDKPVVRRWRKDDGNALPPRRAVAVVRFRGESHVLAVDLEAGTVTPLPAPASGYPTMTMDEQRALCAAPFGDAAFNASIRRRGVRLADVACLPISPGWYGPVEDGGRRLIKSQCFSTEGTANFYMRPIEGLTVLIDMDTREVVHLSDRGAGIPIPAAKNTDYRRAAAAEEEDDAGGAKTFGYQAVRAPSMEPAPEGPGFEVEDGHTVRWAGWEFHLKADARAGLIVSRAGVEDPSTGARREVMYKGMASELFVPYMDPTEAWYFKTYMDAGEYGFGLQAMPLVPLNDCPRHARYMDGVFVAADGRPYVRENMICVFERYAGDIAWRHSESPITGMDIRESRPKVTLVARMAASVANYDYIMDWEFQMDGLIRIKVGLSGILMVKGTPYSHMNQVRRNEEMYGTLLSENVVGVIHDHYVTFRLDMDVDGADNSFVRVEMARQDTAPGESPRRSYLKATRHVASTENDAKIRMKLYEPAEFHVINPTKKTRVGNPVGYKVVAAGTAASLLDPEDPPQKRGAFTNNQIWVTPYNKSEEWAGGLFVYQSKGEDTLATWSERDRPIENKDIVLWYTLGFHHVPCQEDFPIMPTVSSSFDLKPVNFFESNPILRQRPTQVNDLPVCAATA

SEQ ID NO: 9169 - protein, 270 aa, Secale cereale
ANYDYIVDWEFQTDGLIRIKVGLSGILMVKGTPYSHMNQVRQNEEMHGTLLSENVIGVIHDHYVTFRLDMDVDGADNSFVRVEMARQDTTPGESPRRSYLKATHHVASTEKDARVRLKLYEPAEFHVINPTKKTRVGNPVGYKVVPAGTAGSLLDPEDPPQKRGAFTNNQIWVTPYNKSEEWAGGLFVYQSKGEDTLATWSERDRPIDNKDLVLWYTLGFHHIPCQEDFPIMPTVSSSFDLKPVNFFESNPILKQRPTMEKDLPICAATA

SEQ ID NO: 9170 - protein, 729 aa, Brachypodium distachyon
MDHSTSLLRLTFFLLGASLLVLVVRSAFRLPIDASLFDDAAGSCTRFSPWACRQQPSKPSKPPSHDHNSDVPRHPLDPLTVTEINLAAALLRAHPPFSESPSSLIIHSLALDEPEKPLVRAWQKANKAGLNTPLPARRVVAVVRFHGESHVLSIDLGPNGAIEALPVPASGYPTMTMDEQVALCAAPFADPAFNASIARRGVRITDVACLPISSGWYGPDEEGRRVIKVQCFSMEGTANFYMRPIEGLTLVLDMDTREVVHISDRGAGIPVPDAKNTDYRVHAGTGDDAKKKKRGAAQQASMEELGFEVKGHKVKWGGWEMHVKADARAGMVVSMAEVQGREVMYKGMASELFVPYMDPTEAWYFKTYMDAGEYGFGLQAMPLVPLNDCPRNAAYLDGVFVAGDGKPYVKENIICVFERYAGDVAWRHSEGPISGMDIRESRAKVTLVARMAASVANYDYIMDWEFQMDGLIRIKVGLSGILMVKGTPYSHMNQVRRNEEMYGTLLSENVIGVIHDHYVTFRLDMDVDGADNSFVKVEMARHNTAPGESPRKSYLKATRHVASTEKDAQVRLKLYEPSEFHLVNPTKKTRVGNPVGYKIVPGGTAASLLAPDDPAQKRGAFTNNQIWVTPYNKSEEWAGGLFVYQSKGEDTLATWSERDRPIENKDLVVWYTLGFHHVPCQEDFPIMPTVSASFDLKPVNFFESNPILKQRPVKENDLPVCAAASAAAA

SEQ ID NO: 9171 - protein, 299 aa, Pennisetum glaucum
RDSESPITGMYIRESRPKVTLVARMVASVANYDYIMDWEFQMDGLVRIKVGLSGILMVKGTAYSHLNQAKENEDMHGTVLSENVIGVIHDHYVTFRLDMDVDGAGNSFVRVEMARQETGPGESPRRSYLKATRHVARTEKDAQVRLKLYQPEEFHVVNPTKKTRVGNPVGYKVVPAGTAASLLDPEDPPQKRGAFTDNQIWVTPYNKSEEWAGGLFVYQSKGEDTLATWSERDRPIENRDLVLWYTLGFHHIPCQEDFPIMPTVSSSFDLKPVNFFESNPILKQRPTQDHDLPVCAPAT

SEQ ID NO: 9172 - protein, 234 aa, Triticum aestivum
MNQVRRNEEMHGTLLSENVIGVIHDHYVTFRLDMDVDGADNSFVRVDMARQDTAPGESPRRSYLKATRHVASTEKDARVRLKLYEPAEFHVINPTKKTRVGNPVGYKVVPAGTAGSLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTMEKDLPVCAATA

SEQ ID NO: 9173 - protein, 338 aa, Oryza sativa
MDHSTSLLRLIFLALGAALVVLVVRSAFRLPGDIDTTTTSLFDDGNGGSCTRFSPWACRQGRGDPRSKPSKPRRPSHESDVPRHPLDPLTVREVNRVRELLRAHPLFASAPSSLFVHSLELDEPEKSVVKSWRKGADPLPPRRAVAVVRFRGESHVLGVDLSEGDGAVTPLPVPASGYPMMNMDEQTSLCFAPFKDEAFNASLLRRGVRASDVACLPISLGWYGPAEENRRLIKSQCFSTEGTANFYMRPIEGLTVLVDMDTAEVLHVSDRGAGIPIPAAANTDYRHGHSAPTPAEAQAQGRHGYQTVRVPSMEPPAGGPGSSWSTGTRCGGAGGSST

SEQ ID NO: 9174 - protein, 264 aa, Panicum virgatum
WEFQMDGLIRIKVGLSGILMVKGTAYSHLNQARDNEDMHGTLLSENVIGVIHDHFVTFRLDMDVDGADNSFVRVDMARQETSPGESPRRSYLKATRRVARTEKEAQVRLKLYEPAEFHVVNPTKKTRVGNPVGYKVVPAGTAATLLDPEDPPQKRGAFTNNQIWVTPYNKSEEWAGGLFVYQSKGEDTLASWADRDRPIENRDLVLWYTLGFHHIPCQEDFPIMPTVSSGFDLKPVNFFESNPILKQRPTMEEDLPVCAAATTA

SEQ ID NO: 9175 - protein, 280 aa, Saccharum officinarum
LVARMVASVANYDYIMDWEFQMDGLVRIKVGLSGILMVKGTAYSHLGQARENEDMHGTLLSENVIGVIHDHYVTFRLDMDVDGADNSFVRVEMARQETAPGESPRRSYLKATRHVARTEKDAQVRLKLYDPAEFHVVNPAKKTRVGNPVGYKVVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTKEDDLPICAATAA

SEQ ID NO: 9176 - protein, 692 aa, Amorphophallus konjac
HIAQPRPQAPGAAARNPFPTKPDQLRRTPRHPLDPLTIGEINTARAALLAHPPFSSSPGSVTVHSLVLEEPDKALVLAWRPGDPVPPRVASVIARFRGHTHLLTVELAPARVASHTEPDPDASSGYPAMTIEDMTSAVWAPLSDPAFNRTVLSRGVRLSDVACLPISSGWFGAAEERRRLIKVQCYSAEDTANFYMRPIEGLTVLLDMDTLRVVSISDRGRDIPIPKAAGTDYLYSASSASDADGSRTPAVNPISIEQPKGPSFTVEDGHMVRWAGWEFHLKPDPRAGVVLSRVAVADPDTGELRSVMYKGMTSELFVPYMDPTEAWYFKTYMDAGEYGFGLQAMPLVPLNDCPRNAYYMDGVFAAADGRPYVRENMVCVFESYAGDIAWRHAESPITGMGIREVRPKVTLVVRMAASVANYDYIVDWEFQMDGLIRIKVGLSGILMVKGTPYVNKNQVPTNEEMYGTLLSENVVGVIHDHFITFRLDMDVDGADNSFVKVGLARQGTAPGESPRTSYLKATRRVARTEKDAQVRLKLYDPAEFHVVNPGKTTRVGNPVGYKVVSAGTAASLLDPNDPPQRRGAFTNNQIWVTPYNKSEEWAGGLFVYQSKGEDTLAVWSERDRPIENKDIVLWYTLGFHHIPCQEDFPIMPTVTSSFDLKPVNFFESNPVLRMAPNFAKDLPSCRAGATPA

SEQ ID NO: 9177 - protein, 666 aa, Silene vulgaris
HVHDHTSDVPRHPLDPLTVQEMNRVRTILSSHPLFKNAKSYALHNVVVEEPSKTLVVKWKEGDSLPPRKASVVARVDGVKHVLSIDLGLGRVVRVDTGRLSGYPTMTIEDMRLATFAPLSSAEFNKTILDRGVDLADLACLPISSGWFGKKVEEKRRLIKVQCYTMKDTANFYMRPIEGLTVLVDLDTNEVIEITDHGKEIPIPKAANTDYRLSAQTNTHNKIKPVNPISIEQPRGPSFTVEGHMVKWANWEFHLKPDPRAGVIISRAMVRDPDSGELRSVMYKGMSSELFVPYMDPTDAWYFKTYMDAGEYGFGLQAMPLVPLNDCPRNAYYMDGVFAAGDGTPYVRSNMVCVFESYAGDIGWRHSESPITGLEIREARPKVTLVARMAASVANYDYIVDWEFQTDGLIRIKVGLSGILMVKGTPYMNMNQVPNQENLHGTLLSENVIGVIHDHYITFYLDMDIDDSDNSFVKVNLKRQDTSPGESPRKSYLKAVRNVAKTEKDAQIKLKLYDPHEFHVVNPNKKTRVGNPVGYKVVPAGTAASLLDPEDPPQKRGAFTNNQIWVTPYNKSEEWAGGTFVYQNEGEDNLASWSNRDRAIENKDIVLWYTLGFHHIPCQEDFPIMPTVSSSFDLKPVNFFESNPILGVPPNFEKDLPVCQAATASA

SEQ ID NO: 9178 - protein, 562 aa, Elaeis guineensis
MTVDDMTSSIWAPLADPAFNRSILARGVRLSDLACLPISLGWFGAREEGRRLIKVQCYSAEGTANFYMRPIEGLTVVLDMDKKEVVNISDVGRDIPIPKSAGTDYRYDLVAAQNGAPKIRPLNPISMEQPAGPSFVVEGGHVVKWAGWEFHLKADARAGLVVSAASAVDPETGEKRAVMYKGFTSELFVPYMDPTDAWYFKTYMDAGEYGFGLQAMPLVPLNDCPRNAYYMDAVFPAADGRPYVRSNMVCLFERYAGDIGWRHSESPITGMEIREVRPKVTLVARMAASVANYDYIVDWEFQTDGLIRVKVGLSGILMVKGTSYSHMNQVSPKQDMYGTLLSENVIGVIHDHYITFHLDMDVDGVENSFVKVDIARQETIPGESPRMSYLKATRHVAKTEKDAQIRLKLYAPKEFHIINPFKTTKVGNPVGYKVVPAGTAASLLDPNDPPQLRGAFTNNQIWVTPYNKSEEWAGGLFAYQSKGDDTLAVWSERDRPIENKDIVVWYTMGFHHVPCQEDFPIMPTVFSSFDLKPVNFFERNPILVAPPNMEKDLPVCTAAATA

SEQ ID NO: 9179 - protein, 731 aa, Citrus sinensis
MESRHYIRFLFFFVGIATLLAITWNNLPYAPPDATEDFDCTTYSSWCTSKNRFQSKPLKEPAKSTSHHHDHASDTPHHPLDPLTVKEINRVRTILTSHELFKNSFPYAFHSITLQEPKKSLVLNWNKGDSLLPRKASVVARVKNISYVLAVDLTTEEVTVHETDSSSGYPAMTIEDMTSSTWAPLADEEFNRTILERGVDLKDLACLPISLGWYGEKEENRRLIKVQCYSMKDTANFYMRPIEGLTILLDMDTKEVLEITDKGKNIPIPKAVNTDYRYSAQGLHQRMKLINPISLEQPEGPSFVIEDEHLVKWANWEFHLKPDPRAGLIVSQARVRDPDSGEIRNVMYKGFTSELFVPYMDPTDAWYFKTYMDAGEYGFGLQAMPLDPLNDCPRNAHYMDGVFPAADGTPYVRSNMICIFESYAGDIGWRHAESPITGMGIKEVRPKVTLVVRMAASVANYDYIVDWEFQTDGLIRIKVGLSGILMVKGTAYENMNQISNQAENLFGTLLSENVIGVIHDHFITFYLDMDIDGSDNSFVKVNIKRQETSPGESPRRSYLKAVRNVAKTEKDAQIKLKLYDPAEFHVINPTKKTRVGNPVGYKVVPGGTAASLLDREDPPQKRGAFTNNQIWVTPYNESEQWAGGLFVYQSKGEDTLAVWSDRDRSIENKDIVLWYTLGFHHIPCQEDFPIMPTVSSSFDLKPVNFFESNPILRIPPNVEKDLPVCKAAASA

SEQ ID NO: 9180 - protein, 454 aa, Citrus clementina
MCNKTENPKLRMCLVPFYTYHFSFYKNTKKKKKRYTPHHPLDPLTVKEINRVRTILTSHELFKNSFPYAFHSITLQEPKKSLVLNWNKGDSLLPRKASVVARVKNISYVLAVDLTTEEVTVHETDSSSGYPAMTIEDMTSSTWAPLADEEFNRTILERGVDLKDLACLPISLGWYGEKEENRRLIKVQCYSMKDTANFYMRPIEGLTILLDMDTKEVLEITDKGKNIPIPKAVNTDYRYSAQGLHQRMKLINPISLEQPEGPSFVIEDEHLVKWANWEFHLKPDPRAGAIVSQARVRDPDSGEIRNVMYKGFTSELFVPYMDPTDAWYFKTYMDAGEYGFGLQAMPLDPLNDCPRNAHYMDGVFPAADGRPYVRSNMICIFESYAGDIGWRHAESPITGMGIKEVRPKVTLVVRMAASVANYDYIVDWEFQTDGLIRIKASWTKWDSDGERHSL

SEQ ID NO: 9181 - protein, 195 aa, Citrus sinensis
MESRHYIRFLFFFVGIATLLAITWNNLPYAPPDATEDFDCTTYSSWCTSKNRFQSKPLKEPAKSTSHHHDHASDTPHHPLDPLTVKEINRVRTILTSHELFKNSFPYAFHSITLQEPKKSLVLNWNKGDSLLPRKASVVARVQKHIIRVSCRFNDRRGNRTRDRFIVRLSCHDYRRHDVVNMGPTCGRGVQPYDP

SEQ ID NO: 9182 - protein, 733 aa, Gossypium raimondii
MESKPFFRFLFFFIAIAFLFAWTHLHYAPSPGVTTLLDCASNSPWCTSSKNRFQSKQPTLTKTPRASTSQRRHHESAVPRHPLDPLTIQEFNKVRKILSSHALFKSSNNYALHSVVLEEPNKELVLKWKKGQPLFPRIASVIARANGVSHVLTVNLETDEVTVLNTAPPTGYPTMTVEDMTSATWAPLSNAKFNRTIIERGVNLKDVTCLPISLGWFGKKEENRRLIKVQCYSMEDTANFYMRPIEGLTVLLDMDTKEVVEVSDTGRSIPIPKATNTDYRFSEQKLQQDLNSINPISIEQPKGPSFVIEDEHLVKWANWEFHLKPDTRAGVMVSRAKVRDLESGVLRDVMYKGFTSELFVPYMDPTDAWYFKTYMDAGEYGFGLQAMPLDPLNDCPRNAYYMDGVFAAGDGVPYVRSNMVCVFERYTGDIGWRHAESPITGMEIKEVRPKVTLVVRMAASVANYDYIVDWEFQTDGLIRIKVGLSGILMVKGTAYENMNQVEGQENLFGTLLSENVIGVIHDHYITFYLDMDIDGSDNSFVNVNIKRQETSPGESPRKSYLKAVRNVAKTEKDAQIQLKLYDPSEFHVINPTKKTRVGNPVGYKVVPGGTAASLLDHEDPPQKRGAFTNNQIWVTPYNRSEQWAGGLFVYQSHGEDTLDVWSERDRPIENKDIVVWYTLGFHHIPCQEDFPIMPTVSSSFDLKPVNFFESNPILRAPPYFEKDLPVCRPAASA

SEQ ID NO: 9183 - protein, 733 aa, Gossypium hirsutum
MESKPFFRFLFFFIAIAFLFAWTHLHYAPSPGVTTLLDCASNSPWCTSSKNRLQSKQPTLTKTPRASTSQRRHHESAVPRHPLDPLTIQEFNKVRKILSSHALFKSSNNYALHSVVLEEPNKELVLKWKKGQPLFPRIASVIARANGVSHVLTVNLETDEVTVLNTAPPTGYPTMTMEDMTSATWAPLSNAKFNRTIIERGVNLKDVACLPISLGWFGKKEENRRLIKVQCYSMEDTANFYMRPIEGLTVLLDMDTKEVVEVSDTGRSIPIPKATNTDYRFSEQKLQQDLNSINPISIEQPKGPSFVIEDEHLVKWANWEFHLKPDTRAGVMVSRAKVRDLESGVLRDVMYKGFTSELFVPYMDPTDAWYFKTYMDAGEYGFGLQAMPLDPLNDCPRNAYYMDGVFAAGDGVPYVRSNMVCMFERYTGDIGWRHAESPITGMEIKEVRPKVTLVVRMAASVANYDYIVDWEFQTDGLIRIKVGLSGILMVKGTAYENMNQVEGQENLFGTLLSENVIGVIHDHYITFYLDMDIDGSDNSFVNVNIKRQETSPGESPRKSYLKAVRNVAKTEKDAQIQLKLYDPSEFHVINPTKKTRVGNPVGYKVVPGGTAASLLDHEDPPQKRGAFTNNQIWVTPYNRSEQWAGGLFVYQSHGEDTLDVWSERDRPIENKDIVVWYTLGFHHIPCQEDFPIMPTVSSSFDLKPVNFFESNPILRAPPYFEKDLPVCRPAASA

SEQ ID NO: 9184 - protein, 733 aa, Gossypium hirsutum
MESKPFFRFLFFFIAIAFLFAWTHLHYAPSPGVTTLLDCASNSPWCTSSKNRFQSKQPTLTKTPRASTSQRRHHESAVPRHPLDPLTIQEFNKVRKILSSHALFKSSNNYALHSVVLEEPNKELVLKWKKGQPLFPRIASVIARANGVSHVLTVNLETDEVTVLNTAPPTGYPTMTMEDMTSATWAPLSNAKFNRTIIERGVNLKDVACLPISLGWFGKKEENRRLIKVQCYSMEDTANFYMRPIEGLTVLLDMDTKEVVEVSDTGRSIPIPKATNTDYRFSEQKLQQDLNSINPISIEQPKGPSFVIEDEHLVKWANWEFHLKPDTRAGVVVSRAKVRDLESGVLRDVMYKGFTSELFVPYMDPTDAWYFKTYMDAGEYGFGLQAMPLDPLNDCPRNAYYMDGVFAAGDGVPYVRSNMVCMFERYTGDIGWRHAESPITGMEIKEVRPKVTLVVRMAASVANYDYIVDWEFQTDGLIRIKVGLSGILMVKGTAYENMNQVEGQENLFGTLLSENVIGVIHDHYITFYLDMDIDGSDNSFVNVNIKRQETSPGESPRKSYLKAVRNVAKTEKDAQIQLKLYDPSEFHVINPTKKTRVGNPVGYKVVPGGTAASLLDHEDPPQKRGAFTNNQIWVTPYNRSEQWAGGLFVYQSHGEDTLDVWSERDRPIENKDIVVWYTLGFHHIPCQEDFPIMPTVSSSFDLKPVNFFESNPILRAPPYFEKDLPVCRPAASA

SEQ ID NO: 9185 - protein, 859 aa, Theobroma cacao
MSGPLISENVIGVVHDHFITFHLDMDIDGANNSFVNVNLVKEESLPGESPRKSYLKVERKTAKTEKDAQIKLKLYDPSEFHMINPSRRSRLGNPTGYKLVPGGTAASLLDGDDPPQLRSAFTNNQIWVTPFNKSEQWAGGLLVYQSRGEDTLAVWSERNRPIESKDIVLWYTMGFHHIPCQEDFPVMPTVTSGFELKPVNFFESNPILRAAPAFEKDLIVRTILSSHPLFKSSKNYALHSVVLEEPDKDLVLRWTKGQPLFPRIASVIARANGESHVLTVNLETNEVNVLNTAPPTGYPMMTMEDMTSATWAPLSNPKFNRTIIEQGVNLDDVACLPISLGWFGENEENRRLIKVQCYSMKDTANFYMRPIEGLTVLLDLDTKEVVEISDTGRAIPVPKATNTDYRYSEQKMQQELNLINPISIEQPKGPSFVIEDEHLVKWANWEFHLKADPRAGVVVSGAKVWDPDSGVMRDVMYKGFTSELFVPYMDPTDAWYFKTYMDAGEYGFGLQAMPLDPLNDCPRNAYYMDGVFAAGDGVPYVRSNMICVFESYTGDIGWRHSESPITGMEIKEVRPKVTLVVRMAASVANYDYILDWEFQTDGLIRIKVGLSGILMVKGTTYENMKQVEGQEHLFGTLLSENVIGVIHDHYITFYLDMDIDGSDNSFVKVNIKKQDTSPGESPRKSYLKAVRNVAKTEKDAQVQLKLYDPSEFHVINPTKKTRVGNPVGYKVVPGGTAASLLDHEDPPQRRGAFTNNQIWVTPYNKSEQWAGGLFVYQSQGEDTLAVWSDRDRSIENKDIVLWYTLGFHHIPCQEDFPIMPTVSSSFDLKPVNFFESNPILRIPPNFEKDLPVCKPAGSA

SEQ ID NO: 9186 - protein, 734 aa, Manihot esculenta
MESRKFFRFLFILLCGALVLFFTWIHIPYAPPPSTTEFLDCATNSPWCTSRNRFLSKKPPTINILKKPPRQTRHHHESDVPHHPLDPLTIRELNKVRTILSSHHLFKSSPFALHSVVLEEPDKPLVLRWRKGDPMLSRKAAVVARVSGQSHVLTVDIDTSEVNVQETNPLSGYPTMTIEDMTSSTWAPLSNGDFNRTIIERGVDLKDLACLPISLGWYGAREENRRLIKVQCYSMEGTANFYMRPIEGLTVLLDLDTKQVVEIADKGKTIPIPKAANTDYRYSAQGVDQQKKLINPISIEQPKGPSFTVEDEHMVKWANWEFHLKPDPRAGVIISRARVQDPDTGEVRNVMYKGLTSELFVPYMDPTDAWYFKTYMDAGEYGFGLQAMPLDPLNDCPRNAYYMDGVFAAGDGSPYVRSNMICVFESYAGDIGWRHAESPITGMGIREVRPKVTLVVRMAASVANYDYIVDWEFQTDGLIRIKVGLSGILMVKGTSYVNMNQVPGQENLYGTLLSENVIGVIHDHFITFYLDMDIDGSDNSFVKVNLQRKQTSPGESPRRSYLKATRNVAKTEKDAQIQLKLYEPSEFHVINPTKKTRVGNPVGYKVVPGGTAASLLDHDDPPQKRGAFTNNQIWVTPYNRTEEWAGGLYVYQSQGEDTLAVWSERDRPIENKDIVVWYTLGFHHIPCQEDFPIMPTVSSSFDLKPVNFFESNPILRFPPNLEEDLPVCKPSDSA

SEQ ID NO: 9187 - protein, 324 aa, Mesembryanthemum crystallinum
GAPYIRSNMVCIFESYRGDIGWRHSESPITGMEIREVRPKVTLVVRMAASVANYDYIVDWEFQNDGLIKIKVGLSGILMVKGTPYMNTNQIPNQENMYGTLLSENVIGVIHDHYVTFYLDMDVDGSDNSFVKVNLQRQQTSQEESPRRSYLKTTRNVAKTEKDAQIKLKLYDPSEFHMVNPNKKTRVGNPVGYKVVPAGTAASLLDLEDPPQKRGAFTNNQIWVTPYNQSEEWAGGLFTYQSQGEDTLATWSERDRSIENKDIVLWYTLGFHHVPCQEDFPIMPTVSASFDLKPVNFFESNPILGIPPNFEKDLPVCQAAASSA

SEQ ID NO: 9188 - protein, 326 aa, Platanus occidentalis
AADGKPFVRSDMVCVFESYAGDIGWRHAESPITGMEIKEVRPKVTLVVRMAASVANYDYIVDWEFQTDGLIRIKVGLSGILMVKGTPYENMNQVTRQDSLYGTLLSENVIGVIHDHYVTFYLDMDIDGSQNSFVKVNLARQKTSPGQSPRKSYLKATRHIAKTEKDAQIKLKLYDPSEFHVINSVKKTRVGNPVGYKVVPAGTAASLLDPQDPPQMRGAFTNNQIWVTPYNRSEQWAGGLFVYQSQGEDTLAVWSDRNRPIENKDIVLWYTLGFHHIPCQEDFPIMPTVSSHFDLKPVNFFESNPILQMPPNFESDLPVCRADASA

SEQ ID NO: 9189 - protein, 730 aa, Ricinus communis
MESRNFIRFLLIFLSGSLLLLFTWINLPYTPPPLTSTTDFLDSCAANSRWCTRFQQPKNILKKPPKPTRHRHESDLPTHPLDPLTIQEFNKVRTILKSHDLFKSSPFSLHSVVLEEPEKTLVLKWRKGDPMLPRKAEVIARVNGQSHVLTVDINTSDVAVQETNPLSGYPTMTIEDMTTATWAPLSNADFNRTIIDRGVDLKDLACLPISLGWFGKNEENKRLIKVQCYSMKGTANFYMRPIEGLTVLLDMDTKEVVEISDKGKNIPIPKAANTDYRYSSVDVNQEKQLINPISIEQPKGPSFTVEDEHMVKWANWEFHLKPDPRAGVIISSARVKDPDSGEIRNVMYKGFTSELFVPYMDPTDAWYFKTYMDAGEYGFGLQAMPLDPLNDCPRNAYYMDGVFAAGDGTPYVRSNMVCIFESYAGDIGWRHAESPITGMEIREVRPKVTLVVRMAASVANYDYIVDWEFQTDGLIRIKVGLSGILMVKGTSYENMNQVTGQENLYGTLLAENVIGVIHDHYITFYLDMDIDGSDNSFVKVNIHRQQTSPGESPRRSYLKATRNVAKTEKDAQIKLKLYDPSEFHVINPTKKTRVGNPVGYKVVPGGTAASLLNHDDPPQKRGAFTNNQIWVTPYNRTEQWAGGLFVYQSHGEDTLAVWSDRDRPIENKDIVVWYTLGFHHIPCQEDFPIMPTVSSSFDLKPVNFFESNPILRIPPNVEKDLPVCRPFDTA

SEQ ID NO: 9190 - protein, 515 aa, Fagus grandifolia
MVHLQEPLPIQTNQPPTKTPPKPTRHHNHASDTPHHPLDPLTIQEVIEVRSILSSHALFKSSAYALHSIDLEEPEKPLVLKWKKGDPLFPRKASVVARVDGKSHVLTIDLSTRQVTVQETGSHTGYPTMTMEEMTAATLALLANAEFNRTIIQRGIDLKDLACLPISSGWYGKSEENRRLIKILCYSMKEDTPNSYMRPIEGLTVLLDVDTKQVLEIFDKGKSIPIPKAANTDYRYSAQECLQVMNKPNPISIEQPKAPSFTIEDEHLVKWANWEFHVKPDARAGVIISRAKFQDPDTGELRNVMYKGFTSELFVPYMDPTDDWYFKTYMDAGEYGFGLQAMPLDPLNDCPRNAYYMDGVFVAADGTPYVRSHMICVFESYAGDIGWRHSESPITELEIREARPKVTLVVRMVASVANYDYIVDWEFQTDGLIRAKVGLSGILMVKGTTYDHINQIPKEENLYGTLLSENVIGVIHDHYIIFYLDMDVDGSDNSLLRLTLRRSRPHLMSHREKAT

SEQ ID NO: 9191 - protein, 731 aa, Quercus alba
MEARNLLRFLVLFLSIALVLIFTWVHLPSTPPNPTELLDCTTNSPWCISKNRFQPKQPNLLKKSPKPTRRHNHASDKPHHPLDPLTIQELNELRSILTSHALFKSSSYALHSIELEEPEKPLVLKWKKGDPLLPRKATVVARVDGKSHVLTVHLGTREVTVHETSSHSGYPTMTIEDMTTATLAPLANADFNRTIIQRGVDLTDLACLPISTGWYGESEETRRLIKVQCYSMKGTANFYMRPIEGLTVLVDLDTKQVVEISDKGKNIPIPKSANTDYRYSAQELHQVINLFNPISIEQPKGPSFTIEDEHLVKWANWEFHLKPDARAGVIVSRAKVRDPDTGELRNVMYKGFTSELFVPYMDPTDAWYFKTYMDAGEYGFGLQAMALDPLNDCPRNAYYMDGVFVAADGTPYVRSNMICVFEKYAGDIGWRHSESPITGMEIREARPKVTLVVRMAASVANYDYIVDWEFQTDGLIRIKVGLSGILMVKGTTYDNINQIPNQENLYGTLLSENVIGVIHDHYITFYLDMDIDGSDNSFVNVNIKKQQTSPGESPRRSYLKAIRNVAKTEKDAQIKLKLYDPSEFHVINPSKKTRVGNPVGYKVVPGGTAASMLDLDDPPQKRGAFTNNQIWVTPYNQSEQWAGGLFVYQSQGEDTLATWSERDRPIENKDIVLWYTLGFHHIPCQEDFPIMPTVSSSFDLKPVNFFESNPILRIPPNLEKDLPVCEPADSV

SEQ ID NO: 9192 - protein, 331 aa, Sarracenia psittacina
GWSFPAADGSPYVRSDMICVFERYAGDIGWRHSESPITGLEIREVRPKVTLVVRMAASVANYDYIVDWEFQTDGLIRVKVGLSGILMVKGSPYVNMDQVNQQETLYGTLLSENVIGVIHDHYVTFYLDMDVDGADNSFVKVNLRREQTSSGESPRKSYLKAERSVAKTEKDAQVKFKLYEPSEFHVINQAKKTRVGNPVGYKVVPGGTAASLLDVDDPPQKRGAFTNNQIWVTPYNQSEQWAGGLFVYQSQGEDTLAVWSERNREIENKDIVVWYTLGFHHVPCQEDFPIMPTVSSSFDLKPVNFFESNPILRTPPNAEKDLPNCKAAASV

SEQ ID NO: 9193 - protein, 540 aa, Fagus grandifolia
METRISLRFLLLFLSIALVLLFTWVHLPYAPPNTTELLDCTTNSPWCTSKNRFQSKLTNLLKKPPKPTRHHNHASDTPHHPLDPLTIQEVNEVRSILSSHALFKSSAYALHSIDLEEPEKPLVLKWKKGDPLFPRKASVVARVDGKSHVLTIDLSTRQVTVQETGSHTGYPTMTMEDMTAATLAPLANAEFNRTIIQRGIDLKDLACLPISSGWYGKSEENRRLIKIQCYSMKDTANFYMRPIEGLTVLLDLDTKQVLEIFDKGKSIPIPKAANTDYRYSAQEFHQVMNKLNPISIEQPKGPSFTIEDEHLVKWANWEFHVKPDARAGMIISRAKFQDPDTGELRNVMYKGFTSELFVPYMDPTDDWYFKTYMDAGEYGFGLQAMPLDPLNDCPRNAYYMDGVFVAADGTPYVRSNMICVFESYAGDIGWRHSESPITELEIREARPKVTLVVRMVASVANYDYIVDWEFQTDGLIRAKVGLSGILMVKGTTYDHINQIPKEENLYGTLLSENVIGVIHDHYIIFYLDMDVDGSDNSLLR

SEQ ID NO: 9194 - protein, 292 aa, Amaranthus tuberculatus
EIREARPKVTLVVRMAASVANYDYIVDWEFQTDGLINIKVGLSGILMVKGTPYTNTNQIPNQEDLYGTLLSENVIGVIHDHYITFYLDMDIDGSDNSFVKVNLQRQQTPPGESPRSSYLKATKSVAKTEKEAQIKLKLYDPYEFHMVNPNKKTRVGNPVGYKVVPAGTAASLLDLDDPPQKRGAFTNNQIWVTPYNRSEEWAGGLFVYQSKGEDTLATWSERDRDIENKDIVLWYTLGFHHIPCQEDFPIMPTVSSSFSLKPVNFFEKNPILGISPNFEKDLPVCQASSSTS

SEQ ID NO: 9195 - protein, 1321 aa, Aquilegia formosa
MEATTTLPFLLFLFLGLLLILFTSSRYPSLNTHLKFIRIQAKEPSPTSHLDHLTEIPQHPLDPLTLQEITKVQTILSSYSPFTSSFPTIHTVCLHEPDKSLVWNWNKGDPLPPRQAFVIAYLDGKSNVLVVDIGSSQVVSHVLNPYSGYPILIPEDMESAIKIPFRDARFNKSIMDRGVNLSDVICGPLAAGWYGPNEEGRRLVKVECFSHQGTVNFYMRPIEGLIVMVDVDKKEVVHFTDYGHGIPIAESTNTDYRYSAVQNKPLNMNPINPISMEQPKGPSFKVDGHMVKWANWEFHLKPHPRAGVVISQAMVRDSESGKLRRVMYRGFPSELFVPYMDPSDAWYFKTYMDAGEYGMGLSALPLVPLNDCPRNAYYMDAVFGASDGKPYVRSNMICIFERYAGDIAWRHSESSFSNMEVREARAKITLVVRMAASVGNYDYIIDWEFQMDGLIRVKVILSGMLMVKGTPYQTLDQAPDGQNMSGTLVSENLIGVVHDHFIAFHLDMDIDGSDNSFVNVHLKKQETSPGESPRKSYLKVERQVAKTEKDAQIKFKLYDPSEYHVVNPNKKSRVGNPVGYKVVPGGNAASLLDLHDPPQIRGAFTNNQIWVTPYNRSEEWAGGLLVFQGKGEDTLAVWSERDRPIENKDIVLWYTLGFHHIPCQEDFPIMPSVSSSFDLKPVNFFESNPILRVAPNVQEDLPVFLEEPDKELVLNWKKGDPLLPRQASVIVLLKGKSHVLIIDLDSGQVINHVTSSSNGYPVMTIEDMSSSTWAPLSDATFNRTIVDRGINLADLACLPISTGWFGKKEENRRLIKVQCYSLQGTANFYMRPIEGLTVLLDMDTKKVVGISDMGRDIPIPKAENTDYRYSKVNKYSKVRLMKPISIEQPKGPSFEIEDGHLVKWVNWEFHLKPDPRAGVIISRAMVRDPDTGELRNVMYKGMTSELFVPYMDPTDAWYFKTYMDAGEYGFGLQAMPLDPLNDCPRNAYYMDGVFPTADGIPYVRSNMICVFERYAGDIGWRHAESPITGMEIREVRPKVTLVVRMAASVANYDYIVDWEFQTDGLIRIKVGLSGILMVKGTPYVNMNQVPEEEKLYGTLLSENVIGVIHDHYVTFYLDMDVDGSNNSFVKVNLVREETSPGESPRRSYLKANRHVAKTEKDAQIKFKLYDPSELHVINPSKLTRIGNPVGYKVVPAGTAASILDPKDPPQMRGAFTNNQVWVTPYNRNEQWAGGLFVYQSHGEDTLAVWSEKNRPIENKDIVLWYTLGFHHVPCQEDFPIMPTVSSSFDLKPVNFFESNPILNIPPNFEKDLPVCRAAASA

SEQ ID NO: 9196 - protein, 719 aa, Artemisia annua
MDARILIRFLVFTCIIALLLLLTFTNLPYPLPFTTNANCSVDSPRCNTIKKPPKPKQPINNLHTSDVPHHPLDPLTLSELNKVREILLSNTLFRNTGKYALHSVVLEEPDKSVVLRWKYGDELPARKASVIARVNGVTHVLCVDIGTGEVTPVDVGEHSGYPTMTIEDMTSATWAPLGNLEFNRTIMARGIDVKDLACLPISLGWFGKKEENRRLIKVQCYSMEGTVNFYMRPIEGLTVVLDMDTKEVIEINDNGKNIPIPKAAGTDYRFSVQNAKINLINPISIEQPKGPSFVVDGHLVKWANWEFHLKPDPRAGVVISRAMVQDPNSGEMRNVMYKGFTSELFVPYMDPTDAWYFKTYMDAGEYGFGLQAMPLDPLNDCPRNAYYMDGVFAAGDGIPYVRSNMVCVFESYAGDIGWRHSESPITGMEIREVRPKVTLVVRMAASVANYDYIVDWEFQTDGLIRVKVGLSGILMVKGTPYINMNQVNEVENLHGTLLSENVIGVIHDHYITFYLDMDVDGPDNSFVKVNIKRETTTPEESPRLSYLKAVRNVAKTEKDAQVKLKLYDPSEYHMVNPSKKTRVGNPVGYKLVPGGTAASLLDLNDPPQKRGAFTNNQIWVTPYNKSEEWAGGLFTYQSQGDDTLAVWSERDRAIENKDIVMWYTLGFHHVPCQEDFPIMPTVSSSFDLKPVNFYESNPILNIPPNMEKDLPVCNAAASA

SEQ ID NO: 9197 - protein, 740 aa, Tropaeolum majus
MESKKLLRFLFLFLIVGIVLIFTWYVDLHAPPSTTELLECDGYSPWCSTSKNRLQSKQNKTVKNLLKNPNKLTRLRDHLTDTPHHPLDPLTVQEINKVRSILSSYALIESAKSYALHSIVLEEPEKHLVQKWKKKDPLLTRKAAVITRVDGDSHVLVVDLTTGEVTVQDSGPHSGYPMMTIEDMTSATWAPLSSAEFNRTIVSRGVDLTDLACLPLTTGWYGEEEENRRLIKVQCYTMKDTANFYMRPIEGLTVLLDMDTKEVVGISDRGKTIPVPKATNTEYRYLSIQKLNRVMDLVNPISIEQPRGPSFVVEDDHMVKWANWEFHLKPDPRAGVVISRAKVRDPDSGEMRDVMYKGFTSELFVPYMDPTDAWYFKTYMDAGEYGFGLTAMPLDPLNDCPRNAHYMDGVFAAADGKPYVRSNMICVFESYTGDIGWRHSESPITGMEIREVRPKVNLVVRMAASVANYDYIVDWEFQTDGLIRVKVGLSGILMVKGSPYENMNQVPNQENLYGTLLSENVIGVIHDHYVTFHLDMDIDGSDDNSFVKVNIQRQETSPGESSPRRSYLKAVRNVAKTEKDAQIKLKLYDPSEFHVINPNKKTRVGNPVGYKIVPAATAASLLDPQDPPQKRGAFTNNQIWVTPYNRSEQWAGGLFVYQSKGEDTLAEWSNRDRAIENKDIVVWYTLGFHHVPCQEDFPIMPTVSASFDIKPVNFFESNPILRVPPNLEKNLPVCKPAASA

SEQ ID NO: 9198 - protein, 460 aa, Tropaeolum majus
TEYRYLSIQKLNRVMDLVNPISIEQPRGPSFVVEDDHMVKWANWEFHLKPDPRAGVVISRAKVRDPDSGEMRDVMYKGFTSELFVPYMDPTDAWYFKTYMDAGEYGFGLTAMPLDPLNDCPRNAHYMDGVFAAADGKPYVRSNMICVFESYTGDIGWRHSESPITGMEIREVRPKVNLVVRMAASVANYDYIVDWEFQTDGLIRVKVGLSGILMVKGSPYENMNQVPNQENLYGTLLSENVIGVIHDHYVTFHLDMDIDGSDDNSFVKVNIQRQETSPGESSPRRSYLKAVRNVAKTEKDAQIKLKLYDPSEFHVINPNKKTRVGNPVGYKIVPAATAASLLDPQDPPQKRGAFTNNQIWVTPYNRSEQWAGGLFVYQSKGEDTLAEWSNRDRAIENKDIVVWYTLGFHHVPCQEDFPIMPTVSASFDIKPVNFFESNPILRVPPNLEKNLPVCKPAASA

SEQ ID NO: 9199 - protein, 154 aa, Oryza sativa
MALVTVHARLAAAASSASPPLRSAASCTRLRALSTVTGTRLSIRHQQRRRWRRPRRAAAIAASLDLNEDNVRLAIDEAKAELGQLFDTSVGITGQVDLAELDGPFVKLRLKGKFWHTRATVLARIGNYLKNRIPEILEVEIEDEKQLDDSPAAF

SEQ ID NO: 9200 - protein, 133 aa, Secale cereale
SLCSTPPRIRLQPLRTSTGHIFRSPRCRRRPCRARAASITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 9201 - protein, 198 aa, Panicum virgatum
FLWRKNATFAISRHYKRFDVFEEAEANKAAGKYDNASIDYQIEFYRNEGLSHYSPAKFPITSDVPEGCVIIREHIPITNLFTCLWFNEVDRFTSRDQISFSTVRDKIRARVGWMPEMFLDCERRNFVVQAYHRELLEQMIASGRRPPSTTDAPPSRKLRPGSRKAPPSKKPSVKRKKEKKSSSRRRVPKPVAAGMGAM

SEQ ID NO: 9202 - protein, 172 aa, Leymus cinereus x Leymus triticoides
NKAAGKYDNASIDEQIDFYRNEGLTHYSPAKLPITSDVPEGCVIIREHVPISNLFTCLWFNEVDRFTARDQISFSTVRDKIRAKVGWMPQMFLDCERRNFVVQAYHRELLEQMIASGRNTPPIAVEPSRKIRPGSSRRAPPSKKPVVKRKKEKKSSSRRRILKPVTWAMDAV

SEQ ID NO: 9203 - protein, 356 aa, Pennisetum glaucum
TKPQWTFIDSLISKDLFLCSRGKKPGQGTGFDIKDDDLIEMEQCRELVVASAIFGNYDMIQHPRNISDFAKANACFYMFVDEETEAYVKNTSSLYNNNKIGLWRLVVVRNLPYEDPRRTGKIPKLLLHRLFPNVRFSVWIDAKLELVADPYLLLERFLWRKNATFAISRHYKRFDVFEEAEANKAAGKYDNASIDYQIEFYRNEGLSHYSPAKFPITSDVPEGCVIIREHIPITNLFTCLWFNEVDRFTSRDQISFSTVRDKIRARVGWMPQMFLDCERRNFVVQAYHRELLEQMIASGRRPPSTTDAPPSRKLRPGSRKAPPSKKPSVKRKKEKKSSSRRRVPKPPPVAGGMGAM

SEQ ID NO: 9204 - protein, 355 aa, Saccharum officinarum
RNDSFNINESMTVHCGFVRGKKPGQGTGFDIKDDDLLEMEQCRELVVASAIFGNYDMIQHPRNISEFSKANACFYMFVDEETEAYVKNSSSLYNNNKVGLWRLVVVRNLPYEDPRRTGKIPKLLLHRLFPNVRFSVWIDAKLELVADPYLLLERFLWRKNTTFAISRHYKRFDVFEEAEANKAAGKYDNASIDYQIEFYRNEGLTHYSPAKLPITSDVPEGCVIIREHIPITNLFTCLWFNEVDRFTSRDQISFSTVRDKIRARVGWMPEMFLDCERRNFVVQAYHRELLEQMIASGRMPPSAVEATDAPPSRKVRAGSRKAPPSKKPSVKRKKEKKSSSRRRLPKPVAGGLGAM

SEQ ID NO: 9205 - protein, 233 aa, Secale cereale
PYVVVTDPPDGSRNIEVSIPTGTIFGIYDRLVELDQLPVEEKAQLNSLQSGSRLVAAGYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMDDMLELESYGDVQQKVNPGYDV

SEQ ID NO: 9206 - protein, 267 aa, Panicum virgatum
  misc_feature (2)..(2): Xaa can be any naturally occurring amino acid
IXNDIILSSVKSSGKVAVLASEENDQPIWISDDGPYVVVTDPLDGSRNIEVSIPTGTIFGIYNRLVELDHLPLEERAQLNSLQSGTRLVAAGYVLYSSATILCISFGAGIHAFTLDWSTGEFILTHPSLQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILSIQPVKLHQRLPLFLGSMEDMLELESYGDVQQKVNPGYEV

SEQ ID NO: 9207 - protein, 401 aa, Oryza sativa
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 9208 - protein, 334 aa, Tropaeolum majus
RPGEFAGKGGIDVGDDLLVLLCHIQYACKRIAALVASPFSSSTLGKQKGINGGDGESGRDKPKPLDIVSDEIILTSLRNSGKVAVMASEENDIPVWLNDDGPYVVVTDPLDGSRNIDASIPTGTIFGIYKRLAEVDHLPTEEKALLNSLQSGSRLVAAGYVLYSSATILSVSFGSGTHAFTLDHSTGDFVLTHRSIQIPRRGQIYSVNDARYFDWPEGLRKYIDTVRQGKGQYPKKYSARYICSLVADFHRTMLYGGVAMNPRDHLRLVYEANPLSFLAEQGGGRGSDGKTRILSIQPVKLHQRLPLFLGSVEDVVELESYGDVQQKVNPGYDV

SEQ ID NO: 9209 - protein, 399 aa, Setaria italica
MPLSSSLSSFLVLRHHPPRSLPPTSNRPPLHLRLLLPPFARRRAFVCQPLAAAATDDMAAAAAAASPPTLLEHMGQAGAAADLTVLVAHIQSACKRIASLVASPGNAELSRAKAAGGGGVAADRDAPKPLDELSNDIILSSLKSSGKVAVLASEENDLPIWISDDGPYVVVTDPLDGSRNIEVSIPTGTIFGIYNRLVELDHLPLEERAQLNSLQSGTRLVAAGYVLYSSATILCISFGAGTHAFTLDWSTGEFILTHPSLQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILLIQPIKLHQRLPLFLGSMEDMLELESYGDVQQKVNPGYEV

SEQ ID NO: 9210 - protein, 398 aa, Zea mays
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 9211 - protein, 396 aa, Sorghum bicolor
MPLSSLSLLRHHPPRPLPPTSNRQPPPPQPRLLLPPFTGRRAFVCQPLAAATDDMAAAAAAASPPTLLEHMGQAGTAADLTVLVAHIQSACKRIAALVASPGNAELSRSNKAGRGTVAAGRDAPKPLDELSNDIILSSLQSSGKVAVLASEENDLPIWISNDGPYVVVTDPLDGSRNIEVSIPTGTIFGIYNRLVELDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILNIQPVKLHQRLPLFLGSIDDMLELESYGDVQQKVNPGYEV

SEQ ID NO: 9212 - protein, 110 aa, Fagus grandifolia
TVRQGKGRYAKKYSARYICSLVADLHRTLMYGGVAMNPRDHLRLVYEANPLSFLVEQAGGRGSDGKSRILSIQPVKLHQRLPLFLGSLDDMEELESYGDVQQKVNPGYEV

SEQ ID NO: 9213 - protein, 415 aa, Malus domestica
MPLPTTIITITPPPTSCPAPIFPPNRPHFPPRNLFTTKAILHNHRPTMANLSGFGFSIGSRLVASSGTSGSVADDEVRTLIEYASGEGGATVGDDLVLLFHHLQYACKRIAALVASPFNSSLGKHKGLAGGGASAAGSGRDAPKPLDIVSNEIILSSLKNSGKVAVMASEEDDTPIWITDDGPFVVVTDPLDGSRNIDASIPTGTIFGIYKRLPELDHLPKEEKALLNSLQKGTNLVAAGYVLYSSATIFCTSFGSGTHAFTLDHSTGDFILTHPSLKIPPQGQIYSVNDARYFDWPNGLRQYIDTVRQGKGRYPKKYSARYICSLVADFHRTLLYGGVTMNPRDHLRLVYEANPLSFLVEQAGGKGSDGKSRILSIQPVKLHQRLPLFLGSLEDMEELESYGDVQQKVNPGYEV

SEQ ID NO: 9214 - protein, 403 aa, Ricinus communis
MQSSTIPIYSASLYPLKFHSLPPEFNLFPSKSSVPLGSCCYSRPKMASLGGFSVKSQMSTSASVDDNGFCTLIDYMGKGGIDVGDDLVVLFSHIQYASKKIAALVASPFNSALGKQSSIASGASGSDRDAPKPLDIVSNEIILASLRNSGKVAVMASEEDDAPIWINDDGPFVVVTDPLDGSRNIDASIPTGTIFGVYKRLVELDHLPQDEKAMLNSLQSGARLVAAGYVLYSSATILCSTFGSGTHAFTLDRSTGDFILTHPGIKIPSRGQIYSVNDARYFDWPEGLRQYIDTVRQGKGRYPKKYSARYICSLVADFHRTLMYGGVAMNPRDHLRLVYEANPLSFLAEQAGGRGSDGKHRILSMQPVKLHQRLPLFLGSPEDIEELESYGDVQQKVNPGYEV

SEQ ID NO: 9215 - protein, 94 aa, Castanea mollissima
GARLVASGYVLYSSATILCTSFGSGTHAFTLDHSTGDFILTHPSIKIPPRGQIYSVNDARYFDWPEGLRRYIDTVRQGKVDTPRSTRPVIFVLW

SEQ ID NO: 9216 - protein, 75 aa, Humulus lupulus
MNPRDHLRLVYEANPLSFLVEQAGGRGSDGKHRILSIQPVKLHQRLPLFLGSPEDIEELESYGDVQQKVNPGYEV

SEQ ID NO: 9217 - protein, 409 aa, Quercus alba
MQTPTIPLNPSSTFPPKSHHTQLKLLPKLHLLPQSLFYRPPKMASLGGFGFGVRSQVVGGGASSSSSSGVDTNGLCTLTEYVGKEGLNVGDDMVVLLHHIQYACKRIAALVASPFNSSLGKQNTLAGTGIGSGRDAPKPLDIVSNEIILSSLRSSGKVAVMASEEDDAPIWLTDDGPFVVVTDPLDGSRNIDASIPTGTIFGIYNRLVEVDHLPKEEKALLNSLQAGARLVAAGYVLYSSATILCTSFGSGTHAFTLDHSTGDFILTHPSIKIPPRGQIYSVNDARYFDWPEGLRRYIDTVRQGKGRYPKKYSARYICSLVADLHRTLMYGGVAMNPRDHLRLVYEANPLSFLVEQAGGRGSDGKSRILSIQPVKLHQRLPLFLGSLEDMEELESYGDVQQRVNPGYEV

SEQ ID NO: 9218 - protein, 402 aa, Populus trichocarpa
MQSSTIPTFPTSPFPPKTLLFSSKTQSFPSKSSLLAQSCHLFRPKMASLSGFIVRSQTGTSSSGEKGFSTLNEYMGKGGIDVRDELVVLYDHIQYACKRIAALVASPFNSSLSKQSNFAGGDSGSGRDAPKPLDIVSNEIILSSLKNSGKVAVMASEEDDAPVWINDDGPFVVVTDPLDGSRNIDASIPTGTIFGIYRRLVELDHLPQEEKATLNSLQSGAKLVAAGYVLYSSATILCTSFGSGTHAFTLDHSTGDFIQTHIDIKIPPRGQIYSVNDARYFDWPEGLRQYIDTVRQGKGRYPKKYSARYICSLVADFHRTLLYGGVAMNPRNHLRLVYEANPLSFLVEQAGGRGSDGKSRILSMQPVKLHQRLPLFLGSLEDMEELESYGDVQQKVNPGYEV

SEQ ID NO: 9219 - protein, 196 aa, Rhizophora mangle
PEQEKALLNSLQCGTRLLAAGYVLYSSATILCTSFGTGTHAFTLDRSTGDFILTHPDMKIPSRGQIYSVNDARYFDWPEGLRQYIDTVRQGKGSYPKKYSARYICSLVADFHRTLMYGGVAMNPRDHLRLVYEANPLSFLVEQAGGRGSDGKSRILSIQPVKLHQRLPLFLGSLKDMEELESYGDVQQKVNPGYEV

SEQ ID NO: 9220 - protein, 407 aa, Solanum lycopersicum
MLSSTISSLNFPPRTKLSSPNPAIFPQNYNFVPFCTENMASSPFSGGLINSRVDSPIAIGCKNASVDSANSGFSTLMEYMGKGGVDVGDDLVLLFGHLEYASKKIAALVACPFNSSLNNNVAIGNTGTSSDRDKPKPLDIVSNEIILSSLRNSGKVAVMASEEDECPVWITDDGPFVVVMDPLDGSRNIDASIPTGTIFGIYRRLVEIDHLPVEEKALLNCLQSGSKLVAAAYVLYSSATILCASFGSGTHAFTLDHTTGDFLLTHPNINIPPRGQIYSVNDARYFDWPEGLRQYIDTIRQGKGQHPKKYSARYICSLVADFHRTLLYGGVAMNPRNHLRLVYEANPLSFLAEKAGGRGSDGKNRILSIQPVKLHQRLPLFLGSLEDIEELQSYGDVQQKVNPGYDV

SEQ ID NO: 9221 - protein, 81 aa, Vaccinium corymbosum
MYGGVAMNPRDHLRLVYEANPLSFLVEHAGGRGSDGKSRILSLQPVKLHQRLPLFLGSSEDMEELESYGDVQQKVNPGYEV

SEQ ID NO: 9222 - protein, 378 aa, Gossypium hirsutum
LPVLTHRLSFTPTKMALFWVLAKSQMGMTAGGGGGDGANGFSSLMDYVGKGGLDVGDDLLVLLYHIQFACKRIAALVASPFNSALGKHSALTGATSGAAASDRDKPKPLDIVANEIILSSLRNSGKVSVMASEEDDAPIWINDDGPFVVVLDPLDGSRNIDASIPTGTIFGVYNRLTELDNQPTEEKALLNSLQSGRKLVAAGYVLYSSATILCASFGSGTHAFTLDHSTGDFILTHPSIRIPPRGQIYSVNDARYFDWPEGLRQYIDTVRQGKGKFPKKYSARYICSLVADFHRTVLYGGIAMNPRDHLRLVYEANPLSYLAEQAGGKGSDGKSRILSIQPVKLHQRLPLFLGSLEDIDELESYGDVQQKVNPGYEV

SEQ ID NO: 9223 - protein, 407 aa, Gossypium raimondii
MRQLLSPTISYPSPLLHLTSHPFPPKPHFCPTHRLSFYPPPKMASFSGFLAKSQMGMTAAAAAGDGANGFSSLMDYVGKGGLDVGDDLLVLLYHIQFACKRIAALVASPFNSALGKHSALTGATSGAAASDRDKPKPLDIVANEIILSSLRNSGKVSVMASEEDDAPIWINDDGPFVVVLDPLDGSRNIDASIPTGTIFGVYNRLTELDNQPTEEKALLNSLQSGRKLVAAGYVLYSSATILCASFGSGTHAFTLDHSTGDFILTHPSIRIPPRGQIYSVNDARYFDWPEGLRQYIDTVRQGKGKFPKKYSARYICSLVADFHRTVLYGGIAMNPRDHLRLVYEANPLSYLAEQAGGKGSDGKSRILSIQPVKLHQRLPLFLGSLEDIDELESYGDVQQKVNPGYEV

SEQ ID NO: 9224 - protein, 398 aa, Lactuca sativa
MQSPTTTITAAIQNLNLTPNFLPKFPPNPLRILPEFVNHRSTASMASTFGRFKVNSKLDNSSGEFLTITEYAGKGGANVGDDLVVLFSHLEYAFKRIAALVASPVNSSLGKSSGGSQDVDAGRDKPKPLDIVSNEIILSSLKNSGKVAVMASEEDDAPVWITDNAPFVVVTDPLDGSRNIDASIPTGTIFGIYNRLTELDNLPTEEKALLNSLQSGNRLVAAGYVLYSSATILCTTFGSGAHAFTLDHSTGDFVLTHPDIKIPPRGQIYSVNDARYFDWPEGLRRYIDTIRQGKGKFPKKYSARYICSLVADFHRTLMYGGVAMNPRDHLRLVYEANPLSFVAEQAGGKGSDGKNRILSIQPVKLHQRLPLFLGSPEDIDELESYGDVQQTVNPGYDV

SEQ ID NO: 9225 - protein, 305 aa, Papaver somniferum
MLARELLQLFIPFNSVLGKKGFDGSSMGDRDAPKPLDIVSNEIILSSLRSSGKAAVMASEEDDVPVWITDDGPFVVVTDPLDGSRNIDASIPTGTIFGIYNRLEELDHLPIEEKAQLNSLQSGARLIAAGYVLYSSATILCVSFGSGTHAFTLDHTTGDFVLTHPRIKIPPRGQIYSVNDARYFDWPDGLRKYIDTVRQGKGKFPKKYSARYICSLVADFHRTLMYGGVTMNPRDHLRLVYEANPLSFLVEQAGGRGSDGKVKILSIQPVKLHQRLPLFLGSSEDMEELESYGDVQQKINPGYEV

SEQ ID NO: 9226 - protein, 402 aa, Sesamum indicum
MHSAAILLSSISNYPPGIHLFHSELQNFHPRLNLYTQPIKRMAFSGGLGFKISAGGTTAASGDGGGSGFQTLREYMGRREEHVGDELVVLFSHLEYACKRVAALVASPFNSSLGKDFNVAAAGSAERDKPKPLDIVANEIILSSLKNSRKVAVMASEEDDAPVWLADDGPFVVVLDPLDGSRNIDASIPTGTIFGIYRRLVELDHLPTEEKAMLNSLQSGTKLIASGYVLYSSATILCTSFGSGTHAFTLDHSTGDFILTHPNIKIPPRGQIYSVNDARYFDWPEGLRKYIDTVRQGKGKHPKKYSARYICSLVADFHRTLLYGGIAMNPRDHLRLVYEANPLSFLAEQAGGKGSDGKARILSLQPVKLHQRLPLFLGSPDDIEELESYGDVQQKVNPGYDV

SEQ ID NO: 9227 - protein, 261 aa, Amsonia hubrichtii
SSIYSNPSLNFPPRLHLFTPYISLAPGRSKMTSDSSFLGGLNLRVSAKMGSDASGGSFDGNNGAFSTLMDYVGKGGLNVGDDLVVLFVHLEYAFKRIAALVASPFNSSLAKNVGVAAAGSVSERDKPKPLDIVSNEIILSSLRSSGKVAVMASEEDDLPVWITDDGPFVVVTDPLDGSRNIDASIPTGTIFGIYKRLIELDHLPVEEKAMLNSLQSGTRLVAAGYVLYSSATILCTSFGTGTHAFTLDRSTGGFHPHASKY

SEQ ID NO: 9228 - protein, 399 aa, Aquilegia formosa
MQSSALFINPTLNFPQKISYFPPTNPHLLQNLPFRPRLASSSSSISTKFQSKMFSSNSGDGFQTLLDYIGKEGEDVGDDLVVLIAHLQYACKRIAAVVASPFNSVLGKQNKTGGGDSSVGGAERDDPKPLDIVSNEIILSSLRNSGKVAVMASEEDDVPVWITDNGPFVVVTDPLDGSRNIDASIPTGTIFGIYNRLVELDHLPIKEKAQLNSLQSGTRLIAAGYVLYSSATIFCVSFGSGTHAFTLDHTTGDFVLTHPSIKVPSRGQIYSVNDARYFDWPEGLRRYIDTVRQGKGKYPKKYSARYICSLVADFHRTLMYGGVAMNPRDHLRLVYEANPLSFLVEQAGGKGSDGKSRILSLQPVKLHQRLPLFLGSLEDMEELESYGDVQQKVNPGYEV

SEQ ID NO: 9229 - protein, 402 aa, Manihot esculenta
MQSSVLPIYPTSLVPPKSHSFHAKVHLFLPNYPVFAGSCCNCRPRMASLGGFTVKSKMGASASGDNGFCTLVEYMGKGGIDVGDDLVVLFSHLQYASKRIAALVASPFNSSLSKQGNVAGDGSSSDRDAPKPLDIVSNEIILASLRNSGKVAVMASEEDDAPIWINDNGPFVVVTDPLDGSRNIDASIPTGTIFGVYKRLVELDHLPQEEKAMLNSLQSGTRLVAAGYVLYSSATIFCASFGSGTHAFTLDHSTGDFILTHPGIKIPPRGQIYSVNDARYFDWPEGLRQYIDTVRQGKGKYPKKYSARYICSLVADFHRTLMYGGVAMNPRDHLRLVYEANPLSFLVEQAGGRGSDGKVRILSLQPVKLHQRLSLFLGSLEDMEELESYGDVQQKVNPGYEV

SEQ ID NO: 9230 - protein, 396 aa, Catharanthus roseus
SAFLKHSLNFPPRLHLFPPNTCLGQRKSKMASLPPSFLGGLNLRVSAKMSGDASSDCNNNSGFSTLKEYVGKTGLNVSDDLLILFDHLEYAFKRIAALVASPFNSTLGKNVSVAVGSDSERDKPKPLDIVSNEIILSCLRSSGKVAVMASEEDDLPVWITDDGPFAVVTDPLDGSRNIGASIPTGTIFGIYKRLVEIDHLPVDEKAMLNSLQSGTRLVAAGYVLYSSATILCTSFGTGTHAFTLDRSTGDFILTHPNIKIPPRGQIYSVNDARYFDWPEGLRQYIDTVRQGKGKYPKKYSARYICSLVADFHRTLLYGGVAMNPRDHLRLVYEANPLSFLAEQAGGKGSDGKSKILSIQPVKLHQRLPLFLGSPEDIDELESYGDVQQKVNPGYEV

SEQ ID NO: 9231 - protein, 407 aa, Gossypium hirsutum
MQQLLSPTISYPSPLLHLTSHPFPPKPHFCSTHRLSFYLPPKMASFSGFLAKSQMGMTAGGGGGDGANGFSSLMDYVGKGGLDVGDDLLVLLYHIQFACKRIAALVASPFNSALGKHSALTGATSGAAASDRDKPKPLDIVANEIILSSLRNSGKVSVMASEEDDAPIWINDDGPFVVVLDPLDGSRNIDASIPTGTIFGVYNRLTELDNQPTEEKALLNSLQSGRKLVAAGYVLYSSATILCASFGSGTHAFTLDHSTGDFILTHPSIRIPPRGQIYSVNDARYFDWPEGLRQYIDTVRQGKGKFPKKYSARYICSLVADFHRTVLYGGIAMNPRDHLRLVYEANPLSYLAEQAGGKGSDGKSRILSIQPVKLHQRLPLFLGSLEDIDELESYGDVQQKVNPGYEV

SEQ ID NO: 9232 - protein, 397 aa, Cucumis sativus
MQSTTIPPFNPPVSFPSNLPRFAPTIRHFPPPSKLRVPTAMASTPFGLAVRSRTEAAPSGTGTDGLCTLTDFVGKGGIGLGDDLVLLLTHIQYACKRIAALVASPFSSDLQNPAGLAVGSERDAPKPLDIVSNEIILSSLRNSGKVAVMASEEDDEPVWIRDDGPFVVVTDPLDGSRNIDASIPTGTIFGVYKRLVELDNLPREEKAVLNSLQSGTKLLAAGYVLYSSATILCASFGSGTHAFTLDHSTGDFILTHPHIKIPPRGQIYSVNDARYFDWPEGLRRYIDTIRQGKGKNPKKYSARYICSLVADLHRTLLYGGVAMNPRDHLRLVYEANPLSLLVEQAGGRGSDGKHRILSLQPGKLHQRLPLFLGSMEDMEELESYGDVQQKVNPGYEV

SEQ ID NO: 9233 - protein, 392 aa, Euphorbia peplus
MQSCSIVICPPPKSPTFLQSFHLFPPKASIFVGSLRSKMASMGTFVVKSQMGTSGSGYSTLGEYMGKGGVNVGDDLVLLFTHIQYASKKIAALVASPYNSTLSKQGVVAADGTVSDRDAPKPLDLVSNEIILASLKNSGKVAVMASEEDDAPIWINDDGTFAVVTDPLDGSRNIDASIPTGTIFGIYRRLEELDHLPQTEKAMLNSLQSGARLVAAGYVLYSSATILCATFGSGTHAFTLDHSTGDFILTHPGIKIPPRGQIYSVNDARYFDWPEGLRQYIDTVRQGKGRYPKKYSARYICSLVADFHRTLMYGGVAMNPRDHLRLVYEANPLSFLVEQAGGRGSDGKNRILSIQPVKLHQRLPLFLGSLEDIEELESYGNVQQKVNPGYEV

SEQ ID NO: 9234 - protein, 81 aa, Flaveria ramosissima
MYGGVAMNPRDHLRLVYEANPLSFLAEQAGGKGSDGKSRILSIQPVKLHQRLPLFLGSPDDIDELESYGDVQQTVNPGYDV

SEQ ID NO: 9235 - protein, 95 aa, Flaveria ramosissima
RYICSLVADFHRTLMYGGVAMNPRDHLRLVYEANPLSFLAEQAGGKGSDGKNRILSIQPVKLHQRLPLFLGSPDDIDELESYGDVQQTVNPGYDV

SEQ ID NO: 9236 - protein, 399 aa, Vitis vinifera
MHSPAIPLYSTSIFPPKLHIFTPSRRLFSRTVLLQQRMASFSRIGVSSEVGGVRSSSGGDDGVGTLMEFVGKRGVDVGDELVVLFHHIQYACKRIAALVASPFNSTLGKHSGLGGGGGAGGSDRDAPKPLDIVSNEIILSSLRNSGKVAVMASEEDDFPVWISDDGPFVVVTDPLDGSRNIDASIPTGTIFGIYNRLVELDHLPKEEKTMLNSLQSGLKLVAAVYVLYSSATILCTSFGSGTHAFTLDHSTGDFILTHPNIKIPPRGQIYSVNDARYFDWPQGLRQYIDTVRQGKGKYPKKYSARYICSLVADFHRTLMYGGVAMNPRSHLRLVYEANPLSFLVEQAGGRGSDGKIRILSIQPVKLHQRLPLFLGSPEDIEELESYGNVQQKVNPGYEV

SEQ ID NO: 9237 - protein, 405 aa, Lotus japonicus
MHSAAASPFYQLVPFHPKFQTFQSKTPLTTPYCTPRLASISGSAKMRPLRALGGSSSSAGGDGDDGDGVVTLIEYLGKEGIDLKDDLVVLLDHIQYACKRIAAIVASPFSCSIGKQTGVGAGGGGGSSGRDAPKPLDIVSNEIILSSLKKSGKVAVMASEENDAPTWIIDDGPYVVVTDPLDGSRNIDASIPTGTIFGIYNRLEELDNLPTEEKAQLNSLQSGSKLIAAGYVLYSSATILCVSFGSGTQAFTLDHSTGDFILTNPSIKIPPRGQIYSVNDARYFDWPEGLRQYIDTVRQGKGRYPKKYSARYICSLVADLHRTLMYGGVAMNPRDHLRLVYEANPLSFLVEQAGGRGSDGKNRILSLQPVKLHQRLPLFLGSLEDMEELESFGDVQQKVNPGYEV

SEQ ID NO: 9238 - protein, 279 aa, Pennisetum glaucum
AGGSVAADRDAPKPLDELSNDIILSSLKSSGKVAVLASEENDLPIWICDDGPYVVVTDPLDGSRNIEVSIPTGTIFGIYNRLVELDHLPLEERAQLNSLQSGTRLVAAGYVLYSSATVLCISFGAGTHAFTLDWSTGEFILTHPSLQIPPRGQIYSVNDARYFDWPEGLRKYIDTIRQGKGQHPKKYSARYVCSLVADFHRTIIYGGVAMNPRDHLRLVYEANPLSFLAEQAGGRGSDGKNRILSIQPVKLHQRLPLFLGSMEDMLELVSYGDVQQKVN

SEQ ID NO: 9239 - protein, 401 aa, Mimulus guttatus
MYSATVISNPISNYPIKPNIFPPNLHNFQPRFNFCALPIERMAFPGLKISAGATAADADGSGGGDAGFQTLTEYMGKGGENVGDELVVLYSHLEYACRKIAALVASPFNSALAKTSSSAAAGSAERDKPKPLDIVANDIILSSLKNSGKVCVMASEEDDAPVWLADDGPFVVVLDPLDGSRNIDASIPTGTIFGIYKRLVELDHLPLEEKATLNSLQSGTKLIASGYVLYSSATIMCTSFGSGAHAFTLDRSTGDFILTHPNIKIPPRGQIYSVNDARYFDWPEGLRKYIDTVRQGRGENPKKYSARYICSLVADFHRTLLYGGTAMNPRDHLRLVYEANPLSFLAEQAGGKGSDGKVRILSLQPVKLHQRLPLFLGSSKDIEELESYGDVQQKVNPGYDV

SEQ ID NO: 9240 - protein, 151 aa, Pisum sativum
RSTGDFILTNPNIKIPLRGQIYSVNDARYFDWPEGLRKYIDTVRQGKGKYPKKYSARYICSLVADLHRTLLYGGVAMNPRDHLRLVYEANPLSFIVEQAGGRGSDGKSRILSLQPVKLHQRLPLFLGSLEDMEELESYGDVQQKVNPGYEV

SEQ ID NO: 9241 - protein, 117 aa, Lippia dulcis
GLRRYIDTVRQGKGKHPKKYSARYICSLVADFHRTLLYGGIAMNPRDHLRLVYEANPLSFLAEQAGGKGSDGKVRILSLQPVKLHQRLPLFLGSPDDIEELESYGDVQQKVNPGYDV

SEQ ID NO: 9242 - protein, 349 aa, Platanus occidentalis
MGRSSSGGNGFRTLIDYVGKGGADVGDDLVVLLAHIQYACKRIAAVVASPFNSELGKHMGFAGGSAVGEPGAGRDAPKPLDIVSNEIILSSLQNSGKVAVMASEEDDAPVWIADDGPFVVVTDPLDGSRNIDASIPTGTIFGIYNRLVELDHLPPEEKALLNSLQSGTRLVAAGYVLYSSATIFCVTFGSGTHAFTLDQSTGDFVLTHPSIKIPSRGQIYSVNDARYFDWPEGLRRYIDTVRQGKGKYPKKYSARYICSLVADLHRTLMYGGIAMNPRDHLRLVYEANPLSFLVEQAGGRGSDGKSRILSIQPVELHQRLPLFLGSFEDMEELESYGDVQQKINPGYEV

SEQ ID NO: 9243 - protein, 406 aa, Prunus persica
MPLPTTITPPSLCPAPIFPPNHPHFPPRHQFPPRPIFHRPRMATLSGFIAGSQLVGSSGSGGGGDNEARTLIEYVGGGGVDVGDDLVLLIHHLQYACKKIAALVASPFNSTLGKHTSFAAGAGGSAGGSGRDAPKPLDIVSNEIILSSLRSSGKVAVMASEEDDTPTWIRDDGPFVVVTDPLDGSRNIDASIPTGTIFGIYRRLEELDHLPTEEKALLNSLQTGTRLVASGYVLYSSATIFCTSFGSGTHAFTLDHSTGDFILTHPSLKIPSRGQIYSVNDARYFDWPDGLRLYIDTVRQGKGRYPKKYSARYICSLVADFHRTLLYGGVTMNPRDHLRLVYEANPLSFLVEQAGGKGSDGKYRILSIQPVKLHQRLPLFLGSCEDMEELESYGNVQQKVNPGYEV

SEQ ID NO: 9244 - protein, 240 aa, Rosa hybrid cultivar
MATPPPYAVASSGKASTTLTEYVGDGGVGVGDDLVLLFHHIEYACKRIAALVASPYNNSSLAKPMSLPTATGSGSDRDAPKPLDIVSNEIIFSSLRNSGKVAVMASEEDDTPVWISDDGPYVVVTDPLDGSRNIEASIPTGTIFGIYKRLAELDHLPKEEKALLNSLQVGTRLVAAGYVLYSSATIFCTSFGAGTHAFTLDHSTGDFILTHPSLTIPPRGQIYSVNDARYFDWPEGLRSI

SEQ ID NO: 9245 - protein, 75 aa, Rosa hybrid cultivar
MNPRDHLRLVYEANPLSFLVEQAGGKGSDGKNRILSIQPIKLHQRLPLFLGSLEDMDELESYGDVQQKVNPGYEV

SEQ ID NO: 9246 - protein, 407 aa, Solanum phureja
MLSSTVSSLNFPARTKLSSPNPAIFPQNYNLVPFCTENMASSPFSGGLINSRVDSPIAICCKNASVDSANSGFSTLMEYMGKGGVGVGDDLVLLFGHLEYASKKIAALVASPFNSSLNNNVAIGNTGISSDRDKPKPLDIVSNEVILSSLRNSGKVAVMASEEDECPVWITDDGPFVVVMDPLDGSRNIDASIPTGTIFGIYRRLVEIDHLPVEEKALLNCLQSGSKLVAAAYILYSSATILCASFGSGTHAFTLDHTTGDFLMTHPNINIPPRGQIYSVNDARYFDWPEGLRQYIDTIRQGKGQYPKKYSARYICSLVADFHRTLLYGGVAMNPRNHLRLVYEANPLSFLVEKAGGRGSDGKNRILSIQPVKLHQRLPLFLGSSEDIEELQSYGDVQQKVNPGYDV

SEQ ID NO: 9247 - protein, 373 aa, Fragaria vesca
DNAITPEHRLIISNLAAKASSSLVPPFPPNHNGNSFFFLSSTSLIEYVGQGGGHVGDDLVLLFHHIEYACKRIAALVASPYNSTLSKRMPLPSSSADRDAPKPLDILSNEIILSSLRNSGKVAVMASEEDDTPVWISDDGPYVVVTDPLDGSRNIEASIPTGTIFGIYKRLAELDHLPKEEKALLNSLQAGTRLVAAGYVLYSSATIFCTSFGSGTHAFTLDHSTGDFILTHPSLKIPPRGQIYSVNDARYFDWPEGLRKYIDTVRQGKGRYPKKYSARYICSLVADLHRTLLYGGVAMNPRDHLRLVYEANPLSFLVEQAGGKGSDGKNRILSIQPIKLHQRLPLFLGSLEDMDELESYGDVQQKVNPGYEV

SEQ ID NO: 9248 - protein, 181 aa, Vinca minor
TCCCWLCSVFIGHYTMHELWYRNTCIYVRSLNRGISFSHIQILKLPPRGQIYSVNDARYFDWPEGLRQYIDTVRQGKGKYPKKYSARYICSLVADFHRTLLYGGVAMNPRDHLRLVYEANPLSFLAEQAGGKGSDGKSRILSIQPVKLHQRLPLFLGSPEDIDELESYGDVQQKVNPGYEI

SEQ ID NO: 9249 - protein, 174 aa, Juglans hindsii x Juglans regia
LLNSLQTGARLVAAGYVLYSSATILCASFGSGTHAFTLDHSTGDFILTHPSIKIPSRGLRRYIDTMRQGKGRYPKKYSARYICSLVADLHRTLMYGGVAMNPRDHLRIVYEGNPLSFLVEQAGGRGSDGKNRILSMQPVKLHQRLPLFLGSLEDMEELESYGDVQQKVNPGYEV

SEQ ID NO: 9250 - protein, 201 aa, Eschscholzia californica
ELDHLPTEEKAQLNSLQSGGKLVAAGYVLYSSATIFCVSFGSGTHAFTLDHTTGDFVLTHPRMKIPPRGQIYSVNDARYFDWPEGLKKYIDTIRQGKGKYQKKYSARYICSLVADFHRTLMYGGVAMNPRDHLRLVYEANPLSFLVEQAGGRGSDGKSKILSIQPVKLHQRLPLFLGSLEDIEELESYGDVQQKINPGYEV

SEQ ID NO: 9251 - protein, 360 aa, Tabernaemontana elegans
MQSSSVFLNHSLNFPPRLHLFRPHISLAQRRSRMASVPSFLGGLNLRVSAKTGCDSSGGGSYDGDSGGFSTLMECVGKGGLNSSDDLVVLFAHLEYAFKRIAVLVASPFNSSLGKNVGIAAAGAGSMSERDEPKPLDIVSNEIILSSLRSSGKVAVMASEEDDLPVWITDDGPFVVVTDPLDGSRNIEASIPTGTIFGIYKHLVELDHLPVEEKAMLNSLQSGTRLVAAGYVLYSSATILCMSFGTGTHAFTLDRSTGDFILTHPNIKIPRRGQIYSVNDARYFDWPEGLRQYIDTVRQGKGKYPKKYSARYICSLVADFHRTLLYGGVAMNPRDHLRLVYEANPLSFLAEQAGGKGSDR

SEQ ID NO: 9252 - protein, 397 aa, Citrullus lanatus
MQSTAIPPFNPPVSFPSNLPRFAPIIRQFPPPSKLRVPTAMASSPSGLAVGSRTGAVSSGAPVDGPCTLTDFVGKGGIGLGDDLVLLLTHIQYACKRIAALVASPFSSDLQYPAGLAVGLERDAPKPLDIVSNEIILSSLRNSGKVAVMASEEDDEPVWIRDDGPFVVVTDPLDGSRNIDASIPTGTIFGVYKRLVELDNLPREEKAVLNSLQSGSKLLAAGYVLYSSATILCASFGSGTHAFTLDHSTGDFVLTHPHIKIPPRGQIYSVNDARYFDWPEGLRRYIDTIRQGKGKNPKKYSARYICSLVADLHRTLLYGGVAMNPRDHLRLVYEANPLSLLVEQAGGRGSDGKNRILSMQPGKLHQRLPLFLGSLEDMEELESYGDVQQKVNPGYEV

SEQ ID NO: 9253 - protein, 249 aa, Ambrosia trifida
MASEEDDAPVWITDDGPFVVVTDPLDGSRNIDASIPTGTIFGIYNRLIELDSLPVEEKAMLNSLQSGSRLIAAGYVLYSSATILCTSFGSGAHAFTLDHSTGDFVLTHPNIKIPPRGQIYSVNDARYFDWPEGLRRYIDTIRQGKGKFPKKYSARYICSLVADFHRTLMYGGVAMNPRDHLRLVYEANPLSFLAEQAGGKGSDGKHRILSIQPIKLHQRLPLFLGSPDDIDELESYGDVQQTVNPGYDV

SEQ ID NO: 9254 - protein, 404 aa, Theobroma cacao
MQQLLLPTTSFPPPLFPLKSHPFPRKQQFCLRDGLSLYAPPKMASFSGFVAKSQMQTTADGGDANGFSTLMEYVGKGGLDVGDELVVLLYHMQYACKRIAALVASPFNSALGKHSGLSAGTSGSGGLDRDKPKPLDIVANEVILSSLRNSGKVSVMASEEDDAPIWINDDGPFVVVLDPLDGSRNIDASIPTGTIFGIYKRLVELDHLPTEEKASLNSLQSGTRLLAAGYVLYSSATILCASFGSGTHAFTLDHSTGDFILTHPSIRIPARGQIYSVNDARYFDWPEGLRQYINTVRQGKGKYPKKYSARYICSLVADFHRTLLYGGLAMNPRDHLRLVYEANPLSFLAEQAGGKGSDGKSRILSIQPVKLHQRLPLFLGSLEDIDELESYEDVQQKVNPGYAI

SEQ ID NO: 9255 - protein, 413 aa, Citrus clementina
MQSSTITLYQTPIFQPKFSSFPPKNNHHHQQQQFLVRTNLLISPKMASSSSSLSGYFPIRSQKADSLSVVNDEANGFPTLMDYVGKGGLNVGDDLVVLLTHLHYACKRIAALVASPFNSSLAKHMGGSAAGGSAESGRDVAKPLDIVSNEIILSSLRSSGKVAVMASEEDDSPIWINDDGPFVVVTDPLDGSHNIDASIPTGTIFGVYNRLVELDHLADKEKALLNSLQSGSRLVAAGYVLYSSATILCASFGSGTHAFTLDHSTGDFVLTHPNIKIPPRGQIYSVNDARYFDWPEGLRKYIDTVRQGKGKNPKKYSARYICSLVADFHRTLLYGGVAMNPRDHLRLVYEANPLSFLAEQAGGKGSNGKSRILSIQPVQVHQRLPLFLGSSEDMEELESYGDVQQKVNPGYEV

SEQ ID NO: 9256 - protein, 77 aa, Conyza canadensis
VAMNPRDHLRLVYEANPLSFLAEQAGGKGSDGKNRILSLQPVKLHQRLPLFLGSPDDIDELESYGDVQQTVNPGYDV

SEQ ID NO: 9257 - protein, 403 aa, Eucalyptus grandis
MQLPTTLEYPFPSTSPKSLLFIRKAQNFRTQPNFPPRNRFCTSKMASFPGFSVRCRAAGGATEGLSEYRTLVEFLGKEGIGVGDDLVLLFDHIQYACKRIASLVASPFNSSLGKQASLVGGVGGESGRDAPKPLDIVSNEIILSSLRNSGKVAVMASEEDDAPVWIVDGGPFVVVTDPLDGSRNIDASIPTGTIFGIYNRLVELDHLPKDEKAQLNSLQSGTRLVASAYVLYSSATILCATFGSGTHAFTLDQSTGDFILTHPNIKIPPRGQIYSVNDARYFDWPDGLRRYIDTVRQGKGRYPKKYSARYICSLVADFHRTLLYGGVAMNPRDHLRLVYEANPLSFLVEQAGGRGSDGKSRILSIQPVKLHQRLPLFLGSPEDIEELESYENVQQKVNPGYEV

SEQ ID NO: 9258 - protein, 398 aa, Medicago truncatula
MQSATTTTPFYQLLLTFRPKLQTFQSKTQTLFYTPTMASVSEFRTRVKPLSALGNSSSSSSTVANDDGSVTLMEYMGKRGGIGVNDDLVILIDHIQYACKRIAALIASPFNYTIDMPSSGSDRDAPKPLDIISNEIILSSLQKSGKVAVMASEENDTPTWISDDGPYVVVTDPLDGSRNIDASIPTGTIFGIYKRLEELDDLPTEEKALLNSLQSGNRLIASGYVLYSSATILCITFGSGTHAFTLDRSTGDFILTNPSIKIPPRGQIYSVNDARYFDWPEGLRKYIDTVRQGKGKYPKKYSARYICSLVADLHRTLLYGGVAMNPRDHLRLVYEANPLSFIVEQAGGRGSDGKSRILSLQPVKLHQRLPLFLGSSEDMEELESYGDIQQKVNPGYEV

SEQ ID NO: 9259 - protein, 413 aa, Citrus sinensis
MQSSTITLYQTPIFQPKFSSFPPKNNHHHQQQQFLVRTNLLISPKMASSSSSLSGYFPIRSQKADSLSVVNDEANGFPTLMDYVGKGGLNVGDDLVVLLTHLHYACKRIAALVASPFNSSLAKHMGGSAAGGSAESGRDVAKPLDIVSNEIILSSLRSSGKVAIMASEEDDSPIWINDDGPFVVVTDPLDGSRNIDASIPTGTIFGVYNRLVELDHLADKEKALLNSLQSGSRLVAAGYVLYSSATILCASFGSGTHAFTLDHSTGDFVLTHPNIKIPPRGQIYSVNDARYFDWPEGLRKYIDTVRQGKGKNPKKYSARYICSLVADFHRTLLYGGVAMNPRDHLRLVYEANPLSFLAEQAGGKGSNGKSRILSIQPVQVHQRLPLFLGSSEDMEELESYGDVQQKVNPGYEV

SEQ ID NO: 9260 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTGHGSVGSDRDAPKPLDIVSNEIILSSLRKSRKVAVMASEENDAPTWISDDGPYVVVTDPLDGSRNIDASIPTGTIFGIYKRLEELDNLPTEEKAMLNSLQSGSKLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 9261 - protein, 400 aa, Glycine max
MQSTAAPPLYQLVSFKPKLQTFPSKSQLCPLGTPFCRLEMASISGFGLKPLRAVSVSSSSSASSDDGFVTLTEYVGKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 9262 - protein, 79 aa, Helianthus annuus
GGVAMNPRHHLRLVYEANPLSFLAEQAGGKGSDGKHRILSIQPIKLHQRLPLFLGSPDDIDELESYGDVQQTVNPGYDV

SEQ ID NO: 9263 - protein, 236 aa, Tripterygium wilfordii
MMAHLWWFWIPLMVLEILMPPFPQELYLGFIAGLWSWIIFRERRRLLLNSLQTGTSLVAAGYVLYSSATILCISFGSGTHAFTLDRSTGDFILSHPSIEIPPRGQIYSVNDARYFDWPEGLRRYIDTVRQGKGRYPKKYSARYICSLVADFHRTLLYGGVAMNPRDHLRLVYEANPLSFLVEQAGGKGSDGKCRILSIQPDKLHQRLPLFLGSSEDIEELESYGDVQQKVNPGYEV

SEQ ID NO: 9264 - protein, 88 aa, Utricularia gibba
YICSLVADLHRTLLYGGIAMNPRDHLRLVYEANPLSFLVEQAGGRGSNGKARILSLQPVKIHQRLPLFLGSPEDVQELESYGDVQQKR

SEQ ID NO: 9265 - protein, 359 aa, Amborella trichopoda
MASSSPSGSGFKVQSLMGSSSSEGFQTLMDYIGKEGADIGDDLVILLNHLQYACKKIAALVASPVSSKLRQQIEFSEFGQRMARDKPKPLDIVSNEIILASLRSSGKVAAMASEEDDSPVWIADNGPYIVVTDPLDGSRNIDASIPTGTIFGIYNRLIELDHLPVTEKALLNSLQCGQRLIAACYVLYSSATILCISFGSGTHAFTLDRSLGDFVLTHPYIKIPARGQIYSVNDARYFDWPEGLKQYIDTIRQGKGEYPKKYSARYICSLVADLHRTLIYGGVAMNPRDHLRLVYEANPLSFLVEQAGGRGSDGKSRILSIQPVELHQRLSLFLGSSEDIEELESYGEVQQKVNPGYEV

SEQ ID NO: 9266 - protein, 643 aa, Musa acuminata
MKGAAARNESWDVVILDPPKLAPRRKVLQSASGMYRNLNSLAMQITKRGGLLMTCSCSGAMTQSGLFLRVLQGCCIDGREKNHSLASSWRRMRPSDRPLLPGGCLPHQLLAPRPLRRRQNVDTTVTGDSSLQMSSSCINFSTMVDGAHRTSCITQVPCHHHLQHNKIIYGVKEKLVRYCGFHCNSSDHYINHHHPYLFAVVTSKSIFLLFDLASPSITTSSSNFILPQLLCRPSMESPALLLSPPAANPNHPPSSLSPHRVLWSPRRNLRPLGCSLSTSSGRATRRPPLGSPRVVSEMASSTGGESYMTLLEYVGKGGADVGDDLVVLLCHLQYACKRIAALVASPFNAELGRDGGGGVASSSSSSKRDAPKPLDIVSNDIILASLRKSGKVAVMASEEDDVPVWITDHSPFVVVVDPLDGSRNIDVSIPTGTIFGVYNRLAELDHLPIEEKAQLNSLQSGKRLVAAGYILYSSATIFCISFGSGTHAFMLDHSTGEFVLTHPSIQVPRRGQIYSVNDARYFDWPDGLRRYIDTVRQGKGQFPKKYSARYVCSLVADFHRTLIYGGVVMNPRDHLRLVYEANPLSFLIEHAGGRGSDGKTRILSIQPVELHQRLPLFLGSVEDMHELESYDSIQQKINPGYDV

SEQ ID NO: 9267 - protein, 339 aa, Centaurea maculosa
SDTDGFVTISEYAGKGGVDVGDDLVVLFTHLEYAFKRIAALVASPANSSLGISSGAGEDVGSGRDTPKPLDIVSNEIILSSLRNSGKVAVMASEEDDAPVWIADNAPFVVVTDPLDGSRNIDASIPTGTIFGIYNRLIEVDSLPVEEKAMLNSLQSGARLIAAGYVLYSSATILCTTFGSGSHAFTLDRSTGDFVLTHPNIKIPPRGQIYSVNDARYFDWPEGLRRYIDTIRQGKGKFPKKYSARYICSLVADLHRTLMYGGVAMNPRDHLRLVYEANPLSFVVEQAGGKGSDGKNRILSIQPVKLHQRLPLFLGSPDDIEELESYGDVQQTVNPGYDV

SEQ ID NO: 9268 - protein, 395 aa, Cicer arietinum
MQSATFYQLVNFRPKLQTFQSKTPTLFSTRRMASVSGFRRMALDGSSSSSSTVASDDGFVTLMEYMGKGGGIGVNDDLVVLIDHLQYACKRIAALVASPFNHSIGKQTSLGDFPNTGSDRDAPKPLDILSNEIILSSLQKSGKVVVMASEENDTPTWISGDGPYVVVTDPLDGSRNIDASIPTGTIFGIYKRLEELEDLPTEEKALLNSLQSGNRLIAAAYVLYSSATILCITFGSGTHAFTLDRSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKSRILSLQPVKLHQRLPLFLGSLEDMEELESYGDIHQKVNPGYEV

SEQ ID NO: 9269 - protein, 254 aa, Plantago ovata
GKVAVMASEEDDAPVWLADDGPFVVALDPLDGSRNIDASIPTGTIFGVYKRLVELDHLPVEEKAMLNSLQSGTKLLAACYVLYSSATILCASFGSGTHTFTLDRSTGDFVLTQQNLKIPSRGQIYSVNDARYFDWPEGLRKYIDTVRQGKGKYPKKYSARYICSLVADFHRTLLYGGIAMNPRDHLRLVYEANPLSFLAEQAGGKGSDGKARILSLQPNKMHQRLPLFLGSPEDIEELESYGDIQQKVNPGYDV

SEQ ID NO: 9270 - protein, 112 aa, Amaranthus tuberculatus
VSQVRQGKGQYPKKYSARYICSLVADFHRTLLYGGVAMNPRDHLRLVYEANPLSFIAEQAGGKGSDGKSRILSIQPVKLHQRLPLFLGSPEDIEELESYEEVQQKVNPGYEV

SEQ ID NO: 9271 - protein, 249 aa, Ambrosia trifida
MASEEDDAPVWITDDGPFVVVTDPLDGSRNIDASIPTGTIFGIYNRLIELDSLAVEEKAMLNSLQSGGRLIAAGYVLYSSATILCTSFGSGAHAFTLDRLTGDFVLTHPNIKIPPRGQIYSVNDARYFDWPEGLRRYIDTIRQGKGKFPKKYSARYICSLVADFHRTLMYGGVAMNPRDHLRLVYEANPLSFLAEQAGGKGSDGKHRILSIQPIKMHQRLPLFLGSPYDIDELESYGDVQQTVNPGYDV

SEQ ID NO: 9272 - protein, 81 aa, Arnica chamissonis
ADFHRTLMYGGVAMNPRDHLRLVYEANPLSFLPSKRVEKGLMVRSEFCLFSLLNCIKDFHCSWEARMISMSWKAMVTFNKR

SEQ ID NO: 9273 - protein, 399 aa, Phaseolus coccineus
MQSAVRPPLYHLVSLRPKLQKFSSKSQLCALGTPFCRLRMTSVSGSELRPLRAVGGSSSSSGGDDGFVTLLEYVGKEGIHVKDDLVVLLDHIQYASKRIAALVASPFNYSLGKQTGFDSVGSDRDAPKPLDILSNEIILSSLRKSGKVAVMASEENDEPTWISEDGPYVVVTDPLDGSRNIDASIPTGTIFGIYKRLEELDDLPIEEKAMLNSLQSGSRLIAAAYVLYSSATILCITFGSGTHAFTLDHSTGDFILTNPSIQIPPRGQIYSVNDARYFDWPEGLRQYIDTVRQGKGRYPKKYSARYICSLVADLHRTLLYGGVAMNPRDHLRLVYEANPLSFIVEQAGGRGSDGKHRILSLQPYKLHQRLPLFLGSLEDMEELESYGDIQQKVNPGYEV

SEQ ID NO: 9274 - protein, 97 aa, Phaseolus coccineus
SARYICSLVADLHRTLLYGGVAMNPRDHLRLVYEANPLSFIVEQAGGRGSDGKHRILSLQPYKLHQRLPLFLGSLEDMEELESYGDIQQKVNPGYEV

SEQ ID NO: 9275 - protein, 126 aa, Cirsium arvense
MPDILTGRRGLRRYIDTIRQGKGQFPKKYSARYICSLVADLHRTLMYGGVAMNPRDHLRLVYEANPLSFVVEQAGGKGSDGKNRILSIQPVKLHQRLPLFLGSPDDIEELESYGDVQQTVNPGYDV

SEQ ID NO: 9276 - protein, 413 aa, Citrus sinensis
  misc_feature (100)..(100): Xaa can be any naturally occurring amino acid
  misc_feature (103)..(103): Xaa can be any naturally occurring amino acid
  misc_feature (408)..(408): Xaa can be any naturally occurring amino acid
MQSSTITLYQTPIFQPKFSSFPPKNNHHHQQQQFLVRTNLLISPKMASSSSSLSGYFPIRSQKADSLSVVNDEANGFPTLMDYVGKGGLNVGDDLVVLLXHLXYACKRIAALVASPFNSSLAKHMGGSAAGGSAESGRDVAKPLDIVSNEIILSSLRSSGKVAVMASEEDDSPIWINDDGPFVVVTDPLDGSHNIDASIPTGTIFGVYNRLVELDHLADKEKALLNSLQSGSRLVAAGYVLYSSATILCASFGSGTHAFTLDHSTGDFVLTHPNIKIPPRGQIYSVNDARYFDWPEGLRKYIDTVRQGKGKNPKKYSARYICSLVADFHRTLLYGGVAMNPRDHLRLVYEANPLSFLAEQAGGKGSNGKSRILSIQPVQVHQRLPLFLGSSEDMEELESYGDVQQKVXPGYEV

SEQ ID NO: 9277 - protein, 153 aa, Cynara scolymus
RGYSTGDFVLTHPNIKIPPRGQIYSVNDARYFDWPEGLRRYIDTIRQGKGKFPKKYSVRYICSLVADLHRTLMYGGVAMNPRDHLRLVYEANPLSFVVEQAGGKGSDGKNRILSIQPVKLHQRLPLFLGSPDDIEELESYGDVQQTVNPGYDV

SEQ ID NO: 9278 - protein, 294 aa, Euonymus alatus
FGSSLCKQTTLSGGGGNGRDAPKPLDIVSNEIILSSLQNSGKVASMASEEDDAPVWISDDGPFVVVLDPLDGSRNIDASIPTGTIFGVYRRLVELDHLPREEKATLNSLQTGTSLVAAGYVLYSSATILCISFGSGTHAFTLDRSTGDFILSHPSIEIPPRGQIYSVNDARYFDWPEGLRRYIDTVRQGKGRYPKKYSARYICSLVADFHRTLLYGGVAMNPRDHLRLVYEANPLSYLVEQAGGKGSDGKCRILSIQPDKLHQRLPLFLGSSEDIEELESYGDVQQKVNPGYEV

SEQ ID NO: 9279 - protein, 159 aa, Fagopyrum esculentum
GVHSFTLDHSTGDFVLTQPSLKIPSRGQIYSVNDARYFDWPEGLRRYIDTVRQGKGRYPEKYSARYICSLVADFHRTLMYGGVAMNPRDHLRLVYEANPLSFLAEQAGGKGSDGTRRILSKQPVKLHQRLPLFLGSPEDIDELESYGDVQQKFNPGYNV

SEQ ID NO: 9280 - protein, 243 aa, Orobanche aegyptiaca
MLRFGFPMTARLWWFLDPLDGSRNIEASIPTGTIFGIYKRLFELDYLPKEEKATLNSLQSGTKLIASAYVLYSSATILCTTFGSGAHAFTLDRSTGDFILTHPNVKIPPRGQIYSVNDARYFDWPDGLRQYIDTIRQGKGKNPKKYSARYICSLVADFHRTILYGGVAMNPRDHLRLVYEANPLSFLAEQAGGKGSDGKVRILNLQPVRLHQRLPLFLGSRDDIEELESYGDVQQKVNPGYDV

SEQ ID NO: 9281 - protein, 399 aa, Arachis hypogaea
MQSASTTLYQLPSLRGKFQTLLSKAQLFPVSYFCRPRTRPSVSGSGMRSVIALSGSSSSYAVDDGFVTLIEYVGKRGINVEDGLVVLLDHIQYACKRIATLVASPFNSSLGKQEGIGAASGSDRDAPKPLDIVSNEIILSSLQKSGKVAVMASEENDAPIWISDDGPYVVVTDPLDGSRNIDASIPTGTIFGIYKRLEELDDLPTEEKAMLNSLQSGSRLVAAGYVLYSSATILCTTFGSGSQTFTLDHSTGDFILTNPSIEIPRRGQIYSVNDARYFDWPEGLRRYIDTIRQGKGKYPKKYSARYICSLVADLHRTLMYGGVAMNPRDHLRLVYEANPLSFIVEQAGGRGSDGKNRILSLQPVKLHQRLPLFLGSLEDMEELESYDDVQQRVNPGYEV

SEQ ID NO: 9282 - protein, 399 aa, Cajanus cajan
MQSAATPPFYQLVSFRPKLQTFPSKSRLCSLGTPFCRLRMASVSGFGLRPLRALGGSSSSSASDDGFVTFIEYVGKEGMNVKDDLVVLLDHIQYACKRIAALVASPFNYSLGKQTGLASVGSDRDAPKPLDIVSNEIILSSLQKSGKVAVMASEENDEPTWIRDDGPYVVVTDPLDGSRNIDASIPTGTIFGIYKRLEELDNLPTEEKATLNSLQSGSKLIAAAYVLYSSATILCITFGSGTQAFTLDHSTGDFVLTNPSIKIPPHGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFMGSLEDMEELESYGDIQQKVNPGYEV

SEQ ID NO: 9283 - protein, 107 aa, Scabiosa columbaria
VRQGKGKYPKKYSARYICSLVADFHRTLLYGGVAMNPRDHLRLVYEANPLSFLVEQAGGIGSDGKSRILSIQPVELHQRLPLFLGSSEDIEELESYGDVQQKVNPGY

SEQ ID NO: 9284 - protein, 399 aa, Nicotiana tabacum
  misc_feature (320)..(320): Xaa can be any naturally occurring amino acid
  misc_feature (390)..(390): Xaa can be any naturally occurring amino acid
MLSSTISSLNLPPRTQLSSSNPPFFPQRYNLAPFHNMTSSPFSGGLINLRVNSPTAIGSKRDSVNSGFYTLMEYMGKDGAADDLVLLFGHLEYASKKIAALVASPFNSSLSKNIVGTETSSSDRDKPKPLDLVSNEIILSSLRNSGKVAVMASEENEGPVWITDDGPFVVVMDPLDGSRNIDASIPTGTIFGIYRRLMEIDHLPVEEKALLNCLQSGAKLVAAAYVLYSSATILCTSFGSGTHAFTLEHTTGDFLLTHPNISIPPRGQIYSVNDARYFDWPEGLRQYIDTIRQGKGKHPKKYSARYICSLVADFHRTLLXGGVAMNPRDHLRLVYEANPLSFLAEKAGGRGSDGKNRILSIQPVKLHQRLPLFLGSPDDIEELQSYGDVXQKVNPGYDL

SEQ ID NO: 9285 - protein, 397 aa, Tragopogon dubius
MQSPTTITATIHTSHLTPTFLTKFPPNPLRIRPEFFDRRSSTSMASSFARFKLNSKTDTSSDGFLTLTEYAGNGGANVGDDLVVLFSHLEYAFKRIAALVASPINSSLGKSSGGGGDVDAGRDKPKPLDIVSNEIILSSLRNSGKVAVMASEEDDAPVWITDNAPFVVVTDPLDGSRNIDASIPTGTIFGIYNRLIELDNLPPEEKALLNSLQSGSNLIAAGYVLYSSATILCTTFGSGAHAFTLDHSTGDFVLTHPDIKIPPRGQIYSVNDARYFDWPEGLRRYIDTIRQGKGKFPKKYSARYICSLVADFHRTLMYGGVAMNPRDHLRLVYEANPLSFVAEQAGGKGSDGKNRILGIQPVKLHQRLPLFLGSPDDIEELESYGDVQQTVNPGYDV

SEQ ID NO: 9286 - protein, 156 aa, Triphysaria pusilla
AFTLDRSTGDFILTHPNIKIPPRGQIYSVNDARYFDWPEGLRQYIDTIRQGKGKYPKKYSARYICSLVADFHRTLLYGGVAMNPRDHLRLVYEANPLSFLAEQAGGKGSDGKVRILNLQPVKLHQRLSLFLGSTDDIEELESYGDVQQKVNPGYDV

SEQ ID NO: 9287 - protein, 403 aa, Elaeis guineensis
MQSSFLLPTPIANSNSPPSLSLRLPPPSTRTFSFPTGLGLFSVGGRTRRQLSSLRAKPKMDLSGGRGHRTLLEYAGKGGADVGDDLAVLLAHIQHACKRIAAVVASPFNAELGRHGGGGGDGSLSSGRDAPKPLDIVSNDILFSSLQSSGKVAVMASEEDDVPIWITDGGPFVVVTDPLDGSRNIDVSIPTGTIFGIYNRLAELDHLPVEEKAQLNSLQSGNRLVAAGYVLYSSATVLCISFGSGTHAFTLDRSTGEFVLTHPSIQIPRRGQIYSVNDARYFDWPDGLRQYIDTIRQGKGQFPKKYSARYVCSLVADFHRTLIYGGVVMNPRDHLRLVYEANPLSFLVEHAGGRGSDGKSRILSIQPVELHQRLPLFLGSLEDMQELESYDNVQQKINPGYEV

SEQ ID NO: 9288 - protein, 324 aa, Cleome gynandra
RNVNNDLVVLMYHIQHACKKIASLVASPFNSSLGKQVLNSSDGSGGSGRDAPKPLDIVSNDIILSSLKNSGKVAVMASEEDDSPVWIKDDGPYVVVIDPLDGSRNIEASIPTGTIFGIYNRLVELDYLPVEEKAQLNSLQRGNRLVASGYVLYSSATILCLSLGSGTHAFTLDHSTGEFVLTHQNIKIPPRGQIYSVNDARYFDWPEGLRKYIDTVRQGKGQNPKKDSARYICSLVADLHRTLLYGGIAMNPRDHLRLVYEGNPLAFLVEQAGGRASDGKSGILSIQPVKLHQRLPLFLGSVEDVIELESYGDVQQTVNPGYDV

SEQ ID NO: 9289 - protein, 116 aa, Linum usitatissimum
LRRYIDTVRQGKGRYPKKYSARYICSLVADLHRTLLYGGIAMNPRDHLRLVYEANPLSFLVEQAGGKGSDGRSRILSLQPVKLHQRLPLFLGSPEDIEELESYGDVQQRVNPGYEV

SEQ ID NO: 9290 - protein, 402 aa, Phalaenopsis aphrodite
MHIFLIPNPSTTLNLPPSLCNVVPFRSSFCTTIIGATASSRLPTVKPISPCLNAVRSEMALLDEKRSYTMMEYLGKTGADLGDDLAILIVHLEYACKRIAALVASPFSSEVGRRPVHGEFGLSSSGRDTPKPLDLVSNDIILSALKSSGKVAVIASEEDDLPVWITDDGPFVVVADPLDGSRNIDVSIPTGTIFGIYNRLEELDHLPIEEKAQLNALQSGNRLVAAGYVLYSSATILCLSFGSGTHAFTLDRSTGDFVLTHPFMRIPPRGQIYSVNDARYFDWPNGLRQYIDTIRQGKGQFPKKYSARYICSLVADFHRTLIYGGIAMNPRDHLRLVYEANPLSFLVEHAGGRGSDGKTRILSIQPVELHQRLPLFLGSLDDMHELESYDNIQQKVNPGYEV

SEQ ID NO: 9291 - protein, 124 aa, Valeriana officinalis
RYFDWPEGLKRYIDTVRQGKGENPKKYSARYICSLVADFHRTLLYGGIAMNPRDHLRLVYEANPLSFLVEQAGGKGSDGKTGILSIQPVKLHQRLPLFLGSSKDIQELESYGDVQQRINPGYEV

SEQ ID NO: 9292 - protein, 75 aa, Pseudoroegneria spicata
MNPRDHLRLVYEANPLSFLAEQAGGRGSDGKARILSIQPVKLHQRLPLFLGSMEDMLELESYGDVQQKVNPGYDV

SEQ ID NO: 9293 - protein, 289 aa, Aristolochia fimbriata
QKGVGGTLGSTAGRDAPKPPDIVSNEIILAALQNSGKVTVMASEEEAEPVWITDDGPFVVVTDPLDGSRNIDASIPTGTIFGIYKHLVELDHLPTKEKALLNSLQSGNRLIAAGYVLYSSATMFCITFGSGTHAFTLDHSTGDFVLTHPSIKIPPRGQIYSVNDARYFDWPEGLRQYIDTVRQGKGQFPKKYSARYICSLVADLHRTLVYGGIAMNPRDHLRLVYEANPLSFLVEQAGGKGSDGKSRILSLQPVELHQRLPLFLGSVEDIEELESYGEIQQKVNPGYEV

SEQ ID NO: 9294 - protein, 206 aa, Zingiber officinale
YNRLAELDHLPVEEKAQLNSLQSGNRLVAAGYVLYSSATILCISVGSGTHAFTLDHSTGEFVLTHPSIQVPPRGQIYSVNDARYFDWPDGLRQYIDTVRQGKGQFPKKYSARYICSLVADFHRTLVYGGVVMNPRDHLRLVYEANPLSFLIEHAGGRGSDGKTRILSFQPVELHQRLPLFLGSIDDMNELESYDSIQQKINPGYDV

SEQ ID NO: 9295 - protein, 228 aa, Silene vulgaris
MDPLDGSRNIDASIPTGTIFGVYNRLVELDNLPQEEKATLNSLQSGSKLVAAGYVLYSSATIFCATFGSGVHSFTLDHSTGDFILTNPNIKIPSRGQIYSVNDARYFDWPEGLRHYIDTVRQGKGRYPKKYSARYICSLVADFHRTLLYGGIAMNPRDHLRLVYEANPLSYVAEQAGGKGSDGKRRILAIQPAKLHQRLPLFLGSPEDIEELESYGDIQQKVNPGYEV

SEQ ID NO: 9296 - protein, 65 aa, Cucumis melo
MRQTPLSLLVEQAGGRGSDGKHRILSLQPGKLHQRLPLFLGSLEDMEELESYGDVQQKVNPGYEV

SEQ ID NO: 9297 - protein, 384 aa, Allium cepa
GVIPRQNDQRYPLPTTNFILHNSTPTLPKTQIKKPRFVSFRMKSQMGSQTLLEYMSIKQKSSKIGDDMAILVTHLQYACKKIASIVASPFGSEYGSNMIEVGSVADSGRDAPKPLDLVSNDIILSSLQNSGKVAVMASEEDENPVWISDTGPFVVVTDPLDGSRNIDASIPTGTIFGIYNRLPELDHLPIEEKAQLNSLQSGTRLLAAGYVLYSSATIMCVSFGLGTHAFTLDHATGEFMLTHPSIKIPTRGQIYSVNDARYFDWPDGLRQYIDTVRQGKGQYPKKYSARYICSLVADLHRMLMYGGVVMNPRDHLRLVYEANPLSFLVEHAGGKASDGKTRILSIQPVKLHQRLPLFMGSLDDMHELESYDTIQQKVNPGYEV

SEQ ID NO: 9298 - protein, 407 aa, Eutrema halophilum
MQSLTITWYPTLISPPRLDLYPLRQIAASSVLSSPTAGNKRRGMTSRRESASLKSLASRRTSTGDDDDGYCTLVDFAGNGGGGREGTTVGDDLVVLLYHLQHACKRIASLVASPFNSSLGKLSVNSSSGSDRDAPKPLDIVSNDIILSSLRNSGKVAVMASEEDDSPTWIKDDGPYVVVVDPLDGSRNIDASIPTGTIFGIYNRLVELDHLPVEEKAELNSLQRGNRLVASGYVLYSSATILCVSLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKASDGKREILSIQPVKLHQRLPLFLGSVEDVAELESYGDVQQTVNPGYEV

SEQ ID NO: 9299 - protein, 396 aa, Eutrema parvulum
MQSLTITRYPTSISRPRQITTSVLSPPTAGYNRRGMAFRREPASFKSLAARRTSIGDNDDGYCTLVDFAGNGGEGADVGDDLVVLLYHLQHACKRVASIVASPFNSSLGKLSVNSSSGSDRDAPKPLDIVSNDIILSSLKNSGKVAVMASEEDDSATWIKDDGPYVVVVDPLDGSRNIDASIPTGTIFGIYSRLVELDHLPVEEKAELNSLQRGNRLVASGYVLYSSATILCVTLGSGTHAFTLDRSTGEFVLTHQNIKIPARGQIYSVNDARYFDWPEGLRKYIDTVRQGKGENPKKYSARYICSLVADLHRTLLYGGVAMNPRDHLRLVYEGNPLAFLVEQAGGKASDGKREILSIQPVKLHQRLPLFLGSVEDVAELESYGDVQQTVNPGYEV

SEQ ID NO: 9300 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 9301 - protein, 142 aa, Brassica juncea
HQNIKIPTRGQIYSVNDARYFDWPEGLRKYIDTVRQGKGENPKKYSARYICSLVADLHRTLLYGGVAMNPRDHLRLVYEGNPLAFLVEQAGGKASDGKREILSIQPVKLHQRLPLFLGSVEDVTELESYGDVQQTVNPGYEV

SEQ ID NO: 9302 - protein, 407 aa, Brassica juncea
SLTLTLFPTSISPSSLDLYPLRQTSQTVPSVLSPSTAGYNRRGMASRSDSTSFKSLAARETSISGDDDGYCTLVDFAGNGGGGREGANVGDDLVVLLYHLQHACKRIASLVASPFNSSLGKLSVNSSSGSDRDAAKPLDIVSNDIILSSLRNSGKVAVMASEEDDTPTWIKDDGPYVVVVDPLDGSRNIDASIPTGTIFGIYNRLVELDHLPVEEKAELNSLQRGNRLVASGYVLYSSATIFCVTLGSGTHAFTLDHSTGEFVLTHQNIKIPARGQIYSVNDARYFDWPEGLRKYIDTVRQGKGENPKKYSARYICSLVADLHRTLLYGGVAMNPRDHLRLVYEGNPLAFLVEQAGGKASDGKREILSIQPVKLHQRLPLFLGSVEDVTELESYGDVQQTVNPGYEV

SEQ ID NO: 9303 - protein, 343 aa, Lippia dulcis
MAFLGGFGSKISSSGIHGASVDGGENGFPTLKEYMGKGGENVGDELAVLFGHLEYACKKIGALVASPFNSSLAKSFSSAAGSAERDKPKPLDIVANEIVLSSLKNSGKVAVMASEEDDAPIWLDDDGPFVVVLDPLDGSRNIDASIPTGTIFGIYNRLAELDHLPVEEKAMLNSLQSGTKLIASGYVLYSSATILCTSFGSGTHAFTLDHSTGDFLLTHPNIKIPSRGQIYSVNDARYFDWPEGLRKYIDTIRQGKGKHPKKYSARYICSLVADFHRTLLYGGIAMNPRDHLRLVYEANPLSFLAEQAAGKGSDGKSRILSLQPVKLHQRLPLFWEVQMISKS

SEQ ID NO: 9304 - protein, 78 aa, Primula obconica
MYGGIAMNPRDHLRLVYEANPLSFLVEQAGGRGSDGQNRILSLQPVKLHQRLPLFLGSLEDIEELESYGDVQQRINPG

SEQ ID NO: 9305 - protein, 407 aa, Thellungiella halophila
  misc_feature (226)..(226): Xaa can be any naturally occurring amino acid
  misc_feature (240)..(240): Xaa can be any naturally occurring amino acid
MQSLTITWYPTLISPPRLDLYPLRQIAASSVLSSPTAGNKRRGMTSRRESASLKSLASRRTSTGDDDDGYCTLVDFAGNGGGGREGTTVGDDLVVLLYHLQHACKRIASLVASPFNSSLGKLSVNSSSGSDRDAPKPLDIVSNDIILSSLRNSGKVAVMASEEDDSPTWIKDDGPYVVVVDPLDGSRNIDASIPTGTIFGIYNRLVELDHLPVEEKAELNSLQRGXRLVASGYVLYSSAXILCVSLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKASDGKREILSIQPVKLHQRLPLFLGSVEDVAELESYGDVQQTVNPGYEV

SEQ ID NO: 9306 - protein, 837 aa, Cajanus cajan
MTAGKQTTSSSVSLSSASSSSSSSDEREYEVQDLRDRLKSSRGSRFNLIETELALNSRWSKFSRQALLHGIRGFSIDFFKNFIIHPDNRWYRAWTKFILLWAVYSSFFTPMEFGFFRGLPENLFILDIIGQVAFLVDIVLQFFVAYRDSQTYRMVYKRTPIALRYLKSSFIFDLLGCMPWDIIFKACGRKEEVRYLLWIRLYRVRKVTDFFHKLEKDIRVNYIITRIVKLIVVELYCTHTAACIFYYLATTLPESQEGYTWIGSLKMGDYSYSHFREIDIWKRYTTSLYFAIVTMATVGYGDIHAVNMREMIFIMIYVSFDMILGAYLIGNMTALIVKGSKTEKFRDKMTDLMKYMNRNRLGRDIREQIKGHLRLQYESSYTEAAVIQDIPISIRAKISQTLYLPYIEKVSLFKGCSSEFINQIVIRLHEEFFLPGEVILEQGNVVDQLYFVCHGMLEEVGTAEDGTEETVSLLQPNSSFGEISILCNIPQPYTVRVCELSRLLRLDKQSFTNILDIYFYDGRKVLNNLLEAKESFRGKQLESDITFHIGKQEAELALKVNSAAFNGDLCQLKGLIRAGADPNKMDYDGRSPLHLAASRGYEDITLFLIKEGVDVNIKDNFGNTPLLEAVKNGHDRIASLLVGEGASMKIENAGCFLCTAVARGDSDYLKRLLSNGMDPNLKDYDYRSPLHIAAAEGLYLMAKFLLEAGASVFSKDRRGNTPLDEARMCGNQNLIKLLENAKSAQLSEFPYPSQEFTDKMHPKKCTVFPFHPWDPKDSRRHGIVLWVPQSIEELIKTAAEQIEFSGDSCILSEDAGKITDVDMIKDGQKLYLVHETH

SEQ ID NO: 9307 - protein, 835 aa, Medicago truncatula
MKMKEEEDEGEKNRINNQTATCSGSSSLTPSSSSDEREYQVQDLRDKLKSSRGSRFNLIEKELGLKIGWRKFSRRTLLHEFVINPLNRWYRAWLKFILLWAVYSSFFTPMEFGFFRGLPENLFILDIVGQIAFLVDIVLQFFVAYRDSQTYRMVYKRTPIALRYLKSTFVIDLLGCMPWDLIYKACGRREEVRYLLWIRLYRAERVVQFFRNLEKDIRVNYIIARIVKLLVVELYCTHTAACIFYYLATTLPESQEGYTWIGSLKLGDYAYSKFREIDIWKRYTTSLYFAIVTMATVGYGDIHAVNLREMIFIMIYVSFDMVLGAYLIGNMTALIVKGSKTEKFRDRMTDLMKYMNRNKLHKDIREQIKGHVRLQFESSYTDAAVLQDIPISIRSKISESLYSPYIKNVSLFSGCSSEFINQIVTRLHEEFFLPGEVIMQQGYVVDQLYFVCDGVLEEVGIADDGSEETVALLERNSSFGEISILCNIPQPHTVRVCELCRVLRIDKQSFSNILDIYFYDGKKVLDNLLEGKESIRGKQLESDITFHIGKLESELALKVNRTAFDGDLYQLKSLIRAGADPKKTDYDGRSPLHLAACRGYEDITLLLIHERVDMNVKDNFGNTPLLEAVKNGHDRIASLLVREGASLKIDDGGSFLCSAVARGDSDYLKRLLSNGMDANLKDYDYRTPLHVAASEGLIFMAKLLLEAGASVFTKDRWGNTPLDEARMSGNKNLIKLLEDAKSAQLTEFPFPQEITDKVHPKKCTVFPFHPWDPKEQRRNGIVLWIPHTIQELIITAAEQIGFSSDACILSEDAGKIIDISMIKDDQKLYLVNETH

SEQ ID NO: 9308 - protein, 822 aa, Secale cereale
APPGAFLSSGITVERAREECRGLIGAAAAQKAGGLDTDVPFDAGCRRVFEVAVELSRNMGCSFISPEHLAIALFTLDDPTTNNLLRSLGADPSQLASVAVTRLHEELAKDGRDLKGASSLKVPEKAPAGAAAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYEAYHKCKFTLEAINAAVYLSARYIPDRQLPDKAIDLIDEAGSRARIESYQKKKEGQSSVLLKEPDEYWQEIKAVQAMHEVVSSNKMKYSPNKSNQQNASLNTEAPHQDKAESTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISNGRRSMGFSTEDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDNKGKPCLSRLNQPPVVQVSDSTRTF

SEQ ID NO: 9309 - protein, 765 aa, Triticum aestivum
NMGCSFISPEHLAIALFTLDDPTTNNLLRSLGADPSQLASVAVTRLHEELAKDGRDLAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYETYHKCKFTLEAINAAVYLSARYIPDRQLPDKAIDLIDEAGSRARIESYQKKKEGQSSVLLKEPDEYWQEIKAVQAMHEVVLSNKMKYSPNENKQQNASVNTEAPHQDKAEPTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYVGYGETGTLTEAVRRKPFTVVLLDEIEKAHPDIFNILLQIFEDGHLADSQGRRVSFKNTLIVMTSNVGSTSISNGRRSMGFSTEDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDSKGKPCLSRLNQPPIVQVSDSTRTF

SEQ ID NO: 9310 - protein, 763 aa, Triticum aestivum
GCSFISPEHLAIALFTLDDPTTNNLLRSLGADPSQLASVAVTRLHEELAKDGRDLAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYETYHKCKFTLEAINAAVYLSARYIPDRQLPDKAIDLIDEAGSRARIESYQKKKEGQSSVLLKEPDEYWQEIKAVQAMHEVVLSNKMKYSPNENKQQNASVNTEGPHQDKAESTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISNGRRSMGFSTDDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDSKGKPCLSRLNQPPTVQVSDSTRTF

SEQ ID NO: 9311 - protein, 754 aa, Hordeum vulgare
LAIALFTLDDPTTNNLLRSLGADPSQLASVAVTRLHEELAKDGRDTAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYETYHKCKFTLEAINAAVYLSARYIPDRQLPDKAIDLIDEAGSRARIESYQKKKEGQSSVLLKEPDEYWQEIKAVQAMHDVVLSNKMKYSPNENNQQNASLNAEGPRQDKAESTTEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISNGRRSMGFSTDDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDNKGKPCLSRLNQPPIVQVSDSTRTF

SEQ ID NO: 9312 - protein, 882 aa, Pennisetum glaucum
LRGVIRAVFERFTERAVKAVVLSQREARGLGEAAVAPRHLFLGLVAEDRSSAGYLSSGIGIERAREGCRGIAARDDDAPAKAPPSKAGSGGLDTDVPFSAASKQVFEVAVVLSKNMGCSFISPEHLAIAIFTLDDPTTNNLLRSLGADPSQLASVAVDRLQAELAKDGRDPAGASSFKIPEKAPAAAGRSAFSQSLTTKKEKGALDQFCFDLTTQASGGFIDPIIGREEEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTIGKGKGSSLDIGNLLKPALARGELQCIAATTLDEHRMHFEKDKALARRFQPVLVAEPSQEDAVKILLGLREKYETYHKCKFTLEAINAAVYLSARYIPDRQLPDKAIDLIDEAGSRARMESFNRKKEGQSSILLKSPDEYWQEIRAAQAMHEVVLSNKAKYSPNANDQETGNADVEAPYEDNRGSTSTSSLSADEPIVVGTEEIARVASLWSGIPVQQLTADDKKLLVGLDDELRRRVIGQDDAVVAISRAVKRSRVGLSDPDRPIATLLFCGPTGVGKTELTKALAASYFGSESDMLRLDMSEYMERHTVSKLIGSPPGYIGYGETGTLTEAVRRKPFTVVLLDEIEKAHPDIFNILLQIFEDGHLTDSQGRRVSFKNTLIVMTSNVGSTSISKGRQSIGFLKEDTESSSYVAMKSLVMEELKAFFRPELLNRIDEMVMFRPLEKTQMLAILDIILKEVKGRLLALGIGLEVSDAMKDLICREGYDKSYGARPLRRAVTHMIEDAISEAILFGEFKPGDTVLMDIDDEGKPCMSHLDQQIVQVINTTRAF

SEQ ID NO: 9313 - protein, 500 aa, Oryza sativa
MASTVTTPSRPVSAGCHRRSPRRSAPVVLSLGGGPRRRTPSSTSCSALASPAKQGTAKLPPPQPTASRTAAADAERERERTDYNEVAAALESIYKLSPAVVEEKDADEEDEKSKQTKRKRKGRVGRSRNATVTVRSSRRRRRGQRMDLGKRVEMRRREEEEGGGGAGKVEDEERGFEEMLLREHAVSTDMGSLDWKRMKIPPVLTSAQSIRLFRIMQPMKAIMEMKENLENEVQSEPNDAQLAEAMNMSVLQMRRHLEVGRAARNKLIKHNLRLVLYTINKYYPDMSNDERFDDICQAGANGLITAIDRFEPKRGFRISTYALFWIRHSIVRAITLSNFTRFPFAMESERQEIHRAREELAFELGRAPTEEEVMKKVGLSPARYRDVVRMTRPTYSLHARNRVTQEELINEVTDDDAIGVDTSSHNTLLRLAIDDLLDSLKPKESVVIRQRFGLDGRGKRTLSEIAGNLNISREMVRKYELKALMKLKHPTRVEYLRRYM

SEQ ID NO: 9314 - protein, 484 aa, Setaria italica
MTSTVTTPSRPLAAGCRCAAGPRRSGPAVLALNNGPRRRAPSTSCSALASPEKQRTAKLPPPQRPSRAPAEEGEGTDYNEVAAALESIYKLSPAVVEEKHGEDDEAKKDKKKRKGRVGRSTVIVRSRRRRRGRRMDLGKRVEMKQKEGDAGGKQEEEREFEEMLLREHSVSTDMGSLDWKRMKIPPVLSSAQSARLFKTMQPMKAIFEVQESLREDLQRDPTDAELAEATGMTVQQLRRRLDVGRAARNKVIKHNLRLVLYAINKYYPDMANDERFDDLCQAGANGLITAIDRFEPKRGFRISTYALFWIRHSIVRAMTLSNFTRFPFAMESERQEINKAREELAFELGRAPTDEEVIKRVGISQQRYRDVLRMTRPTYSLHSRNRVTQEELINEVTDDDAIGVDAGKHNTLLRLAIDDLLDSLKPKESLVIRQRFGLDGRGKRTLSEIAGNLSISREMVRKYELKALMKLKHPTRVEYLRRYM

SEQ ID NO: 9315 - protein, 354 aa, Panicum virgatum
GRRMDLGKRVEMKSMEDDAGGGRQDEEREFEEMLLREHSVSTDMGSLDWKRMKIPPVLSSAQSARLFKTMQPMKAIFEVQESLREDLQRDPTDAELAEATGMTVQQLRRRLDVGRAARNKLIKHNLRLVLYAINKYYPDMASDERFDDLCQAGANGLITAIDRFEPKRGFRISTYALFWIRHSIVRAMTLSNFTRFPFAMESERQEINKAREELAFELGRAPTDEEVIGRVGISQERYRDVLRMTRPTYSLHSRNRVTQEELINEVTDDDAIGVDAGKHNTLLRLAIDDLLDSLKPKESLVIRQRFGLDGRGKRTLSEIAGNLNISREMVRKYELKALMKLKHPTRVDYLRRYM

SEQ ID NO: 9316 - protein, 501 aa, Sorghum bicolor
MTSTVTTPSRPLAAGTRPRRSWPAVLSLSKGSSGPRRRRPPSTSCAALASPDKQRTANKLPVSSRKQQQQEEEEEVRATDYNEVAAALESIYKLSPAVEVDEENERHGGHDDDDEGGKKAKKKRKSRVAGRSTVIVKSRRRRRGRRMDLGKRVEMKSAAVSREGDEDDEGEREREFEEMLLREHSVSTDMGSLDWKRMKIPPVLTSSQSARLFKTMQPMKAIFEVQESLREELQRDPTDAELAEATGMTVHQLRRRLDVGRAARNKLIKHNLRLVPYAINKYYPDMGTDERFDDLCQAGANGLITAIDRFEPKRGFRISTYALFWIRHSIVRAMTLSSFTRFPFAMESERQEIGKAREELAFELGRPATDEEVRRKVGISPQRYRDVLRMTRPTYSLHARNRVTQEELINEVTDDDAIGVDAGGRHNTLLRLAIDDLLDSLKPKESLVIRQRFGLDGRGKRTLSEIAGNLSISREMVRKYELKALMKLKHPTRVEYLRRYM

SEQ ID NO: 9317 - protein, 497 aa, Zea mays
MTSTVTTPSRPLAAGSRPRRSGPAVLSLSKGGGGQRRQRRLAPSTSCAVLASPDKQSTANKLPLSSRKQEEEVEKATDYNEVAAALETIYKLSPAVEVEEKKRQGGNEDDGGGEAKKKRKRRVAGRSTVVVRSRRRRGGRRMDLGKRVEMKGAAAASREQQQGGEEQGEREFEEMLLREHSVSTDMGSLDWKRMKIPPVLTSSQSARLFKTMQPMKAIFEAQESLREELQRDPTDAEVAEATGMTVHQLRRRLDVGRAARNKLIKHNLRLVPYALNKYYPDMGGDERFDELCQAGANGLITAIDRFEPKRGFRISTYALFWIRHSIVRAMTLSSFTRFPFAMESERQEIGRAREELAFELGRPPTDEEVRARVGLSPQRYRDVLRMARPTYSLHARNRVTQEELIGEVTDAEAVGVDAGGKHDALLRLAIDDLLDSLKPKESLVIRQRFGLDGRGRRTLSEVAGNLSISREMVRKYELKALMKLKHPTRVEYLRRYM

SEQ ID NO: 9318 - protein, 524 aa, Brachypodium distachyon
MASTVTTPSRPLPSSAGIISQHRRRCYCCCSCRPAAVLALAGGGAAAKPRRRRSSPAASTSCAALKSPEKQSTAAAAAKVPPRRPARRSATPAPEEAAAAGASTDYGEVAAVLETLYQLSPTVVEEDEEESSIKEAEKKKQKQRRKTKTLPAMKTTVVVRSRRRGRRMDLGKRVEMREAAAGGKLGGDDEAAEFEEALLREHGVSTDMGGLDWRRTKIPPVLSAAHSSRLFKLMQPMKAIFQVKENLESELGREPTDAELGAAMNMAVPRLRRHRDVGRAARNKLIKHNLRLVLYAINRYYPDMAGGGDGGKFEEVCQAGANGLITAIDRFEPRRGFRLSTYALFWVRHSISRAMAALSSFTHFPFAMESERREIGKAREELAWELGRAPTDEETMRKAGVSPARYRDVARMSRPAGSLHARNRVTQEELINEVTDADAVGAADTHRHSNRLLRLAIDDLLDSLKPKESVVMRQRFGLDGRGRRTLSEIAGNLRISREMVRKYELKALMKLKHPTRVEYLRRYM

SEQ ID NO: 9319 - protein, 140 aa, Pennisetum glaucum
GGGGYGGGGGGGGYGGGGGGYTPGYSGTGTCDYWKSHPDAIISCIGSLGSILGSLGDVCSAFFGSKLQTLQDALCNTRTDCYGDLLREGTAAYLNSIAAKKQYAYSTQQVKDCIAVALTSEVAAAAQAAMFKKANYACHY

SEQ ID NO: 9320 - protein, 184 aa, Zea mays
MSGKALLVVAVVLLVGVASRCSGSRGLHQQGDHVAEQKYGTGNGYGGGGGGYGGDGGGGGGYTPGYSGTGTCDYWKSHPDAIVSCVGSLGSVLGSLGDACSAFFGGKLQTLQDALCNARADGYGDLLREGAAAYLNSVAAAAAGKYAYTTQQVKDCIAVALSSEAAAAAQAAMFNKANYACHYY

SEQ ID NO: 9321 - protein, 192 aa, Brachypodium distachyon
MGCKVLLVTLLLVGIASRSSARSLEANHLSEQKSGYGGGGGGYGSGGGGGYGGGGGGGGYGGGGGGYTPTPTPTTPSYTGTCDYWKSHPDKIISCVGSLGSIVGSFGDVCSSFYGTKIQTLKDALCSTRTDCYGDLLREGAAAYINSIAAKKAHFAYTTHQVKDCIALALTSEVAAAAQAALFKKANQACHY

SEQ ID NO: 9322 - protein, 319 aa, Zea mays
MAAAMTSFVAKNPLLAAAARRRAPPLAGRALPFSPLASTRAPRRTVTCFVPQDTAAPAAPVPALDEEARAAAARRVAEKEARKRSERRTYLVAAVMSSLGVTSMAVAAVYYRFSWQMEGGEVPVIETLGTFALSVGAAVGMEFWARWAHRALWHASLWHMHESHHRPREGPFELNDVFAIVNAAPAISLLAYGFFHRGIVPGLCFGAGLGITLFGMAYMFVHDGLVHRRFPVGPIADVPYFRRVAASHKIHHMDKFGGVPYGLFLGPKELEEVGGLDELVSSPVSEATDTEDAGEEKTRPVVCVVRTSVFMGQSVPNEF

SEQ ID NO: 9323 - protein, 303 aa, Secale cereale
MAAGLSGSTMTSFAVKNPLLAAAARFRTLPSRAGRPLPFSPFTRTARRRGQETVTCFVPQEGQAPGPAPEPVPSLEEEAASAAARRVAERKARKQSERRTYLVAAVMSSLGVTSMAIASVYYRFAWQMEGGEVPMTEMLGTFALSVGAAVGMEFWAQWAHKALWHASLWHMHESHHRPRDGPFELNDVFAIINALPAIALLAYGFFHRGIVPCLCFGAGLGITLFGMAYMFVHDGLVHRRFPVGPIADVPYFRRVAAAHKIHHMDKFEGVPYGLFLGPKELEDVGGLDELEQELARINRTRSI

SEQ ID NO: 9324 - protein, 209 aa, Sorghum bicolor
MASSLARLGAALPRARPCATARALPPGRWDAAALGASRRAALNACRCQVHSDVKVAPASDLKDGSKSETWRIKMLYDGDCPLCMREVNMLRERNKSYGAIKFVDISSKDYSPDNNQGLDYETAMGRIHAILSDGTVVTDVEAFRKLYEEVGLGWVYAVTKYEPVATMANAVYGVWAKYRMQITGRPPLEEIMASRRAAGECKDDKVCKM

SEQ ID NO: 9325 - protein, 210 aa, Setaria italica
MASSLARLGAALPRARPRPGARVLPPGRWDAAALGASRRAAPNVGRCQVHSDVKVAPTSDLKDGDNSSKNWRIKMLYDGDCPLCMREVNMLRERNKSYGAIKFVDISSKDYSPDDNQGLDYETVMGRIHAILSDGTIVTDVEAFRRLYEEVGLGWVYAVTKYEPVATMANAVYGVWAKYRMQITGRPPLEEIMASRKAAGECKDDKVCKM

SEQ ID NO: 9326 - protein, 209 aa, Oryza sativa
MASSLARMGAALPRVRPRAAARFPPPPGRWDSAAALRRAPVYGFRCQVHSDVKVGPSSGLKDGENSSGSWRIKMLYDGDCPLCMREVNMLRERNKSYGAIKFVDISSKDYSPQDNQNLDYETAMGRIHAILSDGTIVTDVEAFRKLYEEVGLGWIYAVTKYEPVAKVANAIYGVWAKYRMQITGRPPLEEIMESRKLAAECKDDKVCKM

SEQ ID NO: 9327 - protein, 661 aa, Triticum aestivum
MPPRRSKGGAGGKPDPEATDAEPVETTVDAMSEDEADDDNSKEESAESGAEDTDGEDSKEEAAETKAEEMDAEHQEEAAETKAEETVAEPEANGADAETKVEAADAKVEEEAAESDSEREADAGEADPEAEAEETDGENDKQAARADGESGEEAAGSGGEDEEEAAGTDGDNAAEVGGEKVDADSEAEGEGTDAEPDAREESPPPSPPARSRRRKRVVKPDPPTEDDEEEETPLPPRRRRRRKAGERGDSPPPLPDNLRCRRSDGKKWRCSARALPTVSFCEYHYAKASKGKKPPADGEVLAVALQRQKKNKRKGRRRLNLAPESPKATRDLPNGLMTISPGSSGAVGSPVTTKVGVDIPAPLRRCYRSKNAEPVPVGPVKVVPHAMSKAKAAQMSCHRCGLKKVARVVKCKNCENKYFCNSCINKWYSGMSRNDIKIKCPVCRGCCDCKKCTLGQTKGGMQKESPAGQGKLIRIKICNHQFYKLLPLKLDQEQLDELEIEAKIQGTKLSNIRVQVAEDDQSGSLYCNNCKLSVHQVLRSCPRCPFKLCLSCCQKIREGNMSGSTPEDKFTQRLLQQESAHEDGSISCPSIELGGCGDSLLNLIYTTPSDDQSEELSSGDELDAPGNDSGVKDAQAHSSPLAESNGSLARLSGGQQESMST

SEQ ID NO: 9328 - protein, 662 aa, Triticum aestivum
MPPRRSKGGGGGKPDPEATDAEPVETAVDAMSEDEADDDNSKEESAESGAEDTDGEDSKEEAAETKAEEMDTEHQEEAAETKAEETVAEPEANGADAETKVEAADAKVEEEAAAESDSEREADAGKADPEAEAEETDGENDEQAARADGESGEEAAGTGGDDEEEAAVTDGDNAAEVRGENVDADSEAEGEGTDAEPDAREESPPPSPPARGRRRKRVVKPDPPTEDDEEEETPLPPRRRRRRKAGERGDSPPPLPDNLRCRRSDGKKWRCSARALPTVSFCEYHYAKASKGKKPPADGEVLAVALQRQKKNKRKGRRRLNLAPESPKATRDLPNGLMTISPGSSGAVGSPVTTKVGVDIPAPLRRCYRSKNAEPVPVGPVKVVPHAMSKAKAAQMSCHRCGLKKVARVVKCKNCENKYFCNSCINKWYSGMSRNDIKIQCPVCRGCCDCKKCTLGQTKGGMQKESPAGQGKLIRIKICNHQFYKLLPLKLDQEQLDELEIEAKIQGTKLSNIRVQVAEDDQSGSLYCNNCKLSVHQVLRSCPRCPFKLCLSCCQKIREGNMSGSTPEDKFTQRLLQQESAHEDGSISCPSIELGGCGDSLLNLIYATPSDDQSEELSSGDELDAPGNDSGVKDAQVHSSPLAESNGSLARLSGGQQESMST

SEQ ID NO: 9329 - protein, 662 aa, Triticum aestivum
MPPRRSKGGAGGKPDPEATDAEPVDETTVDAMSEDEADDDNSKEESAESGAEDTDGEDSKEETAETKAEEMDAEHQEEAAETKAEETVAEPEANGADAETKVEAADAKVEAEAAESDSEREADAGEADPEAEAEETDGENDKQAARADGESGEEAAGSGGEDEEEAAGTDGDNAAEVGGEKVDADSQAEGEGTDAEPDALEESPPPSPPARSRRRKRVVKPDPPTEDDEEEETPLPPRRRRRRKAGERGDSPPPLPDNLRCRRSDGKKWRCSARALPTVSFCEYHYAKASKGKKPPADGEVLAVALQRQKKNKRKGRRRLNLAPESPKATRDLPNGLMTISPGSSGAVGSPVTTKVGVDIPAPLRRCYRSKNAEPVPVGPVKVVPHAMSKAKAAQMSCHRCGLKKVARVVKCKNCENKYFCNSCINKWYSGMSRNDIKIKCPVCRGCCDCKKCTLGQTKGGMQKESPAGQGKLIRIKICNHQFYKLLPLKLDQEQLDELEIEAKIQGTKLSNIRVQVAEDDQSGSLYCNNCKLSVHQVLRSCPRCPFKLCLSCCQKMREGNMSGSTPEDKFTQRLLQQESAHEDGSISCPSIELGGCGDSLLNLIYTTPSDDQSEELSSGDELDAPGNDSGVKDAQAHSSPLAESNGSLARLSGGQQESMST

SEQ ID NO: 9330 - protein, 664 aa, Secale cereale
MPPRRSKGGGGGKPDPEATDAEPVDEAVATAVDAGDAMSEDEADDDNSAESGAEDTDGEDSKEEAAETKAEVMDAEHQEEAAETKAEEMVAAPEANGADAETKVEAADAKVEEEAAKSDSEREADAGEADPEAEAEETDGENDKQAARADGESGEEAAGTGGEDEEEAAGTDGDNAAEVGGRNVDADSEAEGEGTDAEPDAPEESPPPSPPARGRRRKRVVKPDPPTEDDEEEETPLPPRRRRRRKAGERGDSPPPLPDNLRCRRSDGKKWRCSARALPTVSFCEYHYAKASKGKKPPADGEVLAVALQRQKKNKRKGRRRLNLAPESPKATRDLPNGLMTISPGSSGAVGSPVTTKVGVDIPAPLRRCYRSKNAEPVPVGPVKVVPHAMSKAKAAQMSCHRCGLKKVARVVKCKNCENKYFCNSCINKWYSGMSRNDIKIKCPVCRGCCDCRKCTLGQTKGGLRKESPGGQGKLIRIKICNHQFYKLLPLKLDQEQLDELEIEAKIQGTKLSNIRVQVAEDDPSGSLYCNNCKLSVHQVLRSCPRCPFKLCLSCCQKIREGSMSGSTPEDKFTQRLLQQESAHEDGSISCPSIELGGCGDSLLNLIYASPSDDQSEELSSGDGLDAPGNDSGVKDAQTHSSPLAESNGSLARLSGGQQESMST

SEQ ID NO: 9331 - protein, 171 aa, Triticum aestivum
MAARRTILLAMAAMAILSTASAAIYNVGEPGGAWDLSTNYGTWASSRNFQTNDQIVFKYSPQAHDVLEVSKADYDSCSTASPVTILNSGNDVVTLNATGTRYFICGFPGHCAGGMKVKIDVMPGSSSTSPAPASGPSATNAPPPTPVSTATNVEATGFGLAVLLAVVGLMA

SEQ ID NO: 9332 - protein, 170 aa, Triticum aestivum
MTATRIILLAVAVMVVLSTASAAIYNVGEPGGAWDLGTNYGTWASSRNFQTDDQIIFKYSPQAHDVLEVSKADYDSCSTARAITTLNSGNDVVTLSASGTRYFICGFPGHCAGGMKVKIDVTSGSSSSAAPASGPSASNAPPPTPVSAATNVEATGFGLAVLLAVAGLLA

SEQ ID NO: 9333 - protein, 171 aa, Secale cereale
MAATRTILLAVAAMAILSTASAAIYNVGEPGGAWDLSTNYGTWASSRNFHPNDQIVFKYSPQAHDVLEVSKVDYDSCSTTSPIATLNSGNDVISLNATGTRYFLCGFPGHCTGGMKVKIDVVSSRSSSSPAPASGPSASNAPPPVPVSAATSMGAIGFGLIILLAVAGLVA

SEQ ID NO: 9334 - protein, 733 aa, Triticum aestivum
MDYSTSLLRLTFLALGAALVLIVARSAFRLPLAIDAPAASFLHGAGGCTRFSPWACRSPRTEKSTPRRPSHESDVPRHPLDPLTVTEVNRARELLRAHPPFASAPSALAVHALALDEPDKPAVRRWRKGAHAIPPRRAVAVVRFQGESHVLAVDLAAGKVAPLPVPASGYPTMTMDEQTALCAAPFRDPAFNATIRRRGVRLADVACLPISPGWYGPAEDGGRRLIKSQCYSTEGTANFYMRPIEGLTVLIDMDTRKVVHISDRGAGIPIPAAKNTDYRLAANDDADRFGYQTVRAPSMEPAPEGPGIQIEDGHTVRWAGWEFHLKADARAGLVVSRATVQDPATGARREVMYKGMASELFVPYMDPTEAWYFKTYMDAGEYGFGLQAMPLVPLNDCPRHARYMDGVFVAADGRPYVRENMICVFERYAGDIAWRHSESPITGMDIRESRPKVTLVARMAASVANYDYIVDWEFQTDGLIRIKVGLSGILMVKGTPYSHMNQVRQNEEMHGTLLSENVIGVIHDHYVTFRLDMDVDGADNSFVRVDMARQDTAPGESPRRSYLKATRHVASTEKDARVRLKLYEPAEFHIINPTKKTRVGNPVGYKVVPAGTAGSLLDPEDPPQKRGAFTNNQIWVTPYNKNEEWAGGLFVYQSKGEDTLATWSERDRPIENKDLVLWYTLGFHHIPCQEDFPIMPTVSSSFDLKPVNFFESNPILKQRPTMEKDLPVCAATA

SEQ ID NO: 9335 - protein, 157 aa, Triticum aestivum
MAFVAIHARLAVLPPRLSAAASSLRSAPPRTRLPPLRTSTGHVFRSLRCRRRPCRARAASISITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 9336 - protein, 157 aa, Triticum aestivum
MAFVAIHARLAVLPPRLSAAASSLRSAPPRTRLPPLRTSTGHIFRSLRCRRRPCRARAASISITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 9337 - protein, 155 aa, Triticum aestivum
MAFVAIHARLAVLPPRLSAAASSLRSAPPRTRLSPLRTSTGHIFRSPRCRRRPCRARAASITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 9338 - protein, 157 aa, Brachypodium distachyon
MAFVAIHARLLVFRPPLAAAASASSSLHSAPFPAGLPRLSTAAGNRCSLRHRRRPGRARAAAITASLDLTEDNVRQAIVDAKAELAQLFDTSVGITGQVDLAELDGPFVKLRLKGKFWHTRATVVARIGNYLKNRIPEILEVEIEDENQLDDSPAAY

SEQ ID NO: 9339 - protein, 155 aa, Avena sativa
MAFVAIHARLAVFPPRLSAPAAASSLRSASFVSRLPTLRTPTGNRRRSLRYRRRPCRAATITASLDLTEDNVRQAILDAKVELAQLFDSSVGMTGEVDLAELDGPFVKLRLKGKFWHTRATVVARIGNYLKNRIPEILEVEIEDESQLDDSPAAY

SEQ ID NO: 9340 - protein, 171 aa, Triticum aestivum
MAFVAIHARLAVLLPRLSAAASSLRSAPPRTRLSPLRTSTGHIFRSPRCRRRPCRARAASITASLDLTEDNVRQAIVDAKAEASKASFPLTSTPKNISLAQLFDTSVGITGQVDLAELDGPFVKLRLKGKFWHTRATVVARIGNYLKNRIPEILEVEIEDEDQLDDSPAAY

SEQ ID NO: 9341 - protein, 404 aa, Hordeum vulgare
MTLSPHTLCPPLLPPLPPSSNRRPPPPRSRPCPRILLPALAGRRSRVHLARPPRAGAGAGDGMASQDAHYPTLLEHMGRAGAPADLAVLVAHIQAACKRIAALVASPGNADLSRAKPAAAAGGASAAGRDAPKPLDELSNEIILSSLQSSGKVAVVASEENDLPVWMCDDGPYVVVTDPLDGSRNIEVSIPTGTIFGIYDRLVELDHLPVEEKAQLNSLQSGSRLVAAGYVLYSSATIFCISFGEGTHGFTLDRSTGEFVLTYPFMQIPPRGQIYSVNDARYFDWPEGLKKYIDTIRQGKGQNPKKYSARYVCSLVADFHRTVIYGGVAMNPRDHLRLVYEANPLSFLAEQAGGRGSDGKTRILSIQPVKLHQRLPLFLGSMEDMLELESYGDVQQKVNPGYDV

SEQ ID NO: 9342 - protein, 361 aa, Triticum aestivum
PPPSRSRPRAVRRSELLAGDGMASHGSHPTLLEHMGRAGAPADLAVLVAHIQAACKRIAALVASPGNADLSRAKPAAAGAASAAGRDAPKPLDELSNEIILSSLQSSGKVAVVASEENDLPVWMCDDGPYVVVTDPLDGSRNIEVSIPTGTIFGIYDRLVELDQLPVEEKAQLNSLQSGSRLVAAGYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 9343 - protein, 402 aa, Brachypodium distachyon
MPLSAFCLPLSLPLPTTSNHRHHPPPPSLPRPNPLLLHLPPLTRRRVPLDRPPRAGATDMAAPAAAASPPTLLEHMGRAGTPADLAVVIAHIQGACKRIAALAASPANADLSRGKAGGGAAVVAAGRDAPKPLDELSNEIIMSSLQSSGKVAVVASEENDLPVWMCDDGPYVVVTDPLDGSRNIEVSIPTGTIFGVYNRLVELDHLPVEERAQLNSLQSGTRMVAAGYVLYSSATIFCISFGTGTHGFTLDRSTGEFILTHPSIQIPPRGQIYSVNDARYFDWPEGLKKYIDTIRQGKGQHPKKYSARYVCSLVADFHRTLIYGGVAMNPRDHLRLVYEANPLSFLAEQAGGRGSDGKTRILSIQPVKLHQRLPLFLGSTEDMLELESYEDVQQKVNPGYEV

SEQ ID NO: 9344 - protein, 308 aa, Panicum virgatum
MASAASAPVFERVAGIRTIAESGRFKAWFLDQFGVLHDGKKPYPGAILALEKLAVNGAKMVIISNSSRRSSVTMDKLKSLGFDTSCFLATITSGELTHQHLLKRNDPWFAALGRKCIHITWGNRGAISLEGLGLQVVDNVDDAEFILAHGTEALGSPSGDPLPKSLEELEQVLMLGLERQLPMVVANPDYVTVEARDLRVMPGTLAAKYENLGGEVKWMGKPDKVIYNSAMSLAGVDAHECIMVGDSLHHDVKGANASGITSAFITGGIHAAELGLSESGETTGEDAINTLCSKHGSYPSYVLPSFTW

SEQ ID NO: 9345 - protein, 223 aa, Saccharum officinarum
MAAAAALLLSPRLVSLPPHPSLAPGFIKRPTSDPLGRRGAGARLRAVGDGPGAGLPDQTTVYNGAYGPWTVEDSDVREVLLYRSGLVTAAASFVAAASAAFLPEGNPAAGAGAADLLYAAGASGLGLSLLLIHIYVTPIKRFLQALWAVGVLGSLGTYLVAARPLDEGLVQYVLEHPAALWFVGPTFAALTGLVFKEGLCYGKLEAGILTFVIPGLLLGICLV

SEQ ID NO: 9346 - protein, 289 aa, Sorghum bicolor
MAAALLLSPRLVSLPPHPSLAPGFTFIKRPTSYPLGRRGARLRAVGDGPGAGLTSDQTTVYNGAYGPWTVDDSDVREVLLYRSGLVTAAASFVAAASAALLPEGNPASGAGAADLLYAVGASGLGLSLLLIHIYVTPIKRFLQALWAVGVLGSLGTYLVAARPLDEGLVQYVLDHPAALWFVGPTFAALTGLVFKEGLCYGKLEAGILTFVIPGLLLGHLSGLMDNSTKTTLLGVWMLLFTVFAARKFQQPIKDDIGDKSVFMFNALPEEEKNALIQKLERQKAQQQFE

SEQ ID NO: 9347 - protein, 293 aa, Setaria italica
MAAAAAALLLQPRVVSLPPNPRLAPTFNKPAPTFAPIGRRRAGARLRAVGDGPGAGLADQTTVYNGVYGPWTVEDSDVREVLLYRSGLVTAAASFVAAASAAFLPEGNAAGDAIRQSIDLLYAAGAAGLGLSLVLIHIYVTPIKRFLQALWAVGVLGSVGTYLVAAQPLDEGLVQYVLEHPAALWFVGPTFAALTGLVFKEGLCYGKLEAGILTFVIPGLLLGHLSGLMDNSTKSGLLGVWMVLFTIFAARKFQQPIKDDIGDKSVFMFNALPEEEKNALIQKLERQNEQKFE

SEQ ID NO: 9348 - protein, 295 aa, Cenchrus ciliaris
  misc_feature (261)..(261): Xaa can be any naturally occurring amino acid
  misc_feature (267)..(267): Xaa can be any naturally occurring amino acid
MATAVAAALLLQPRFVSLPPNPSLAPTFVNKPAPSFAAISRRRAGARLRAVGDGPGAGLADQTTVYNGVYGPWTVEDSDVREVLLYRSGLVTAAASFVAAASVAFLPEGNAAGDAIRQSIDLFYATGAAGLGLSLVLIHIYVTPIKRFLQALWAVGVLGSVGTYLVAAQPLDEGLVQYVLDHPAALWFVGPTFAALTGLVFKEGLCYGKLEAGILTFVIPGLFFGHLFGLMDNSTKSGLLGVWMVLFTIFAARKFQQPIKXDIGDKXVFMFNALPEEEKNALIQKLERQTEQKFE

SEQ ID NO: 9349 - protein, 449 aa, Saccharum officinarum
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFWSADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQPLTLPLLVFWVALAALLAYA

SEQ ID NO: 9350 - protein, 449 aa, Sorghum bicolor
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFWSADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFDKGWAFPRRVYFNGDNCVMPSPENYPWLPNASPLTRQPLTLPLLVFWVALAALLAYA

SEQ ID NO: 9351 - protein, 449 aa, Setaria italica
MAAGGRSVAYCAAVLLAAALLLSAPTGTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAAASFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPNGSNCVNEDSPNLQSAIDGPGKWTGQPLVQCTSHMCPIRIHWHVKLNYKEYWRVKITITNFNFRMNYTQWNLVAQHPNFDNITQLFSFNYKPLTPYGSGINDTAMFWGVKFYNDLLMQAGKLGNVQSELLLRKDSQTFTFEKGWAFPRRVYFNGDNCVMPSPENYPWLPNASPLTKQPLTLPLLVFWVVLATLLAYA

SEQ ID NO: 9352 - protein, 448 aa, Zea mays
MAASGRSVACCAAALLAAALLLSAPTATEAYDSLDPNGNITIKWDIMQWTPDGYVAVVTMFNYQQFRHIGAPGWQLGWTWAKKEVIWSMVGAQTTEQGDCSKFKSSPPHCCKKDPTIVDLLPGTPYNMQIANCCKAGVVNTFNQDPANAASSFQISVGLAGTTNKTVKVPRNFTLKTPGPGYTCGRAIVGRPTKFFTADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKPLALPFLVFWVALAALLAYA

SEQ ID NO: 9353 - protein, 289 aa, Cenchrus ciliaris
  misc_feature (285)..(285): Xaa can be any naturally occurring amino acid
MAAGGRSVACCAAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAAASFQISVGLAGTTNKTVKVPKNFTLKTPGPGYTCGRAIVGRPTKFFTSDGRRATQALMTWNVTCTYSQFLAQKTPTCCVSMSSFYNDTIVNCPTCSCGCQNPSGSNCVTEDSPNLQSAIDGPGKWTGQPLVQCTXHMSR

SEQ ID NO: 9354 - protein, 430 aa, Panicum virgatum
LLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLFVFWVVLATLLAYA

SEQ ID NO: 9355 - protein, 457 aa, Oryza sativa
MAVGGAGSSRSVAPCCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 9356 - protein, 456 aa, Brachypodium distachyon
MAVGGGTGSSRSAACCGAVMLAAVLLFLAPATTEAYDSLDPNGNITIKWDIMEWTADGYVAVVTMFNYQQFRHISAPGWQLGWTWAKKEVIWSMVGAQTTEQGDCSKFKSSPPHCCKRDPTIVDLLPGTPYNQQIANCCKAGVINTFNQDPSNAASSFQVSVGLAGTTNKTVKVPKNFTLKAPGPGYTCGRALVGRPTKFFTSDGRRATQALMTWNVSCTYSQFLAQKTPSCCVSLSSFYNDTIVNCPTCSCGCQNNNTRPGSCVNENSPYLQSAIDGPGKYTGQPLVQCTSHMCPIRIHWHVKLNYKDYWRVKVTITNFNYRMNYTQWNLVVQHPNFDNITKLFSFNYKPLTPYGGGINDTAMFWGMKFYNDLLMQAGPLGNAQSEILMKKDSATFTFDKGWAFPRRVYFNGDNCVMPSPDAYPWLPNASPLTKQPLTLPLLVFWTVLATLLAYV

SEQ ID NO: 9357 - protein, 456 aa, Brachypodium distachyon
MAVGGDAGSSRSAACSCAVLLAAVLLFSAPATTEAYDSLDPNGNITIKWDIREWTADGYVAVVTMFNYQQFRHISAPGWQLGWTWAKKEVIWSMVGAQATEQGDCSKFKSSPPHSCKRDPTIVDLLPGTPYNQQIANCCKAGVIDTFNQDPSNAASSFQVSVGLAGTTNKTVKVPKNFTLKAPGPGYTCGRAIVGKPTKYFTSDGRRATQALMTWNVTCTYSQFLAQKTPSCCVSLSSFYNDTIVNCPTCSCGCQNNNTRPGSCVNENSPYLQSAIDGPGKYTGQPLVQCTSHMCPIRIHWHVKLNYKDYWRVKVTITNFNYRMNYTQWNLVVQHPNFDNITKLFSFNYKPLTPYGGGINDTAMFWGMKFYNDLLMQAGPLGNAQSEILLKKDSATFTFDKGWAFPRRVYFNGDNCVMPSPDAYPWLPNASPLTKQPLTLPLLVFSILLATLLAYV

SEQ ID NO: 9358 - protein, 447 aa, Triticum aestivum
MAALGGCAVLLAAALLLSAPAATEAYDSLDPNGNITIKWDLKEWTPDGYVAMVTIYNYQQFRHISAPGWQLGWTWAKKEVIWSMVGAQTTEQGDCSKFKTNPPHCCKRDPTVIDLLPGTPYKDQVGNCCKGGVISTFNQDPANAASSFQISVGLAGTTNKTVKLPKNFTLKTPGPGYTCGRATVVRPTKFLIGDGRRTTQALMTWNVTCTYSQFLAQKTPTCCVALSSFYNNTIVGCPTCSCGCQNNNTHPGSCVNPNSPYLQSAIDGPGKYTGQPLVQCTSHMCPVKVHWHVKLNYKDYWRVKVTITNFNYRMNYTDWNLVVQHPNFNNITKLFSFNYKPLSPYGGRINDSAMFWGMKFYNDLLNQAGPFGNAQTEILLQKDPETFTFEKGWAFPRRVYFNGDNCVMPPPDAYPWLPNASPPMKQPWTLELLVFWTALAALLAYYV

SEQ ID NO: 9359 - protein, 447 aa, Triticum aestivum
MAALGGCAVLLAAALLLSAPAATEAYDSLDPNGNITIKWDLKEWTPDGYVAMVTIYNYQQFRHISAPGWQLGWTWAKKEVIWSMVGAQTTEQGDCSKFKTNPPHCCKRDPTVIDLLPGTPYKDQVGNCCKGGVISTFNQDPANAASSFQISVGLSGTTNKTVKLPKNFTLKTPGPGYTCGRATVVRPTKFLIGDRRRTTQALMTWNVTCTYSQFLAQKTPTCCVALSSFYNNTIVGCPTCSCGCQNNNTHPGSCVNPNSPYLQSAIDGPGKYTGQPLVQCTSHMCPVKVHWHVKLNYKDYWRVKVTITNFNYRMNYTDWNLVVQHPNFNNITKLFSFNYKPLSPYGGRINDSAMFWGMKFYNDLLNQAGPFGNAQTEILLQKDPETFTFEKGWAFPRRVYFNGDNCVMPPPDAYPWLPNASPPMKQPWTLELLVFWTALATLLAYYV

SEQ ID NO: 9360 - protein, 447 aa, Secale cereale
MAALSRCALLLAAALLLSAPAATEAYDSLDPNGNITIKWDILSWTADGYVAMVTMYNFQQFRHISAPGWQLGWTWAKKEVIWSMVGAQTTEQGDCSKFKTNPPHCCKRDPTVIDLLPGTPYKDQVANCCKGGVISTFNQDPANAASSFQISVGLSGTTNKTVKLPRNFTLKTPGPGYTCSRATVVRPTKFLIGDGRRTTQALMTWNVTCTYSQFLAQKTPTCCVALSSFYNNTIVGCPTCSCGCQNNNTHPGSCVNPNSPYLQSAIDGPGKYTGQPLVQCTSHMCPVKVHWHVKLNYKDYWRVKVTITNFNYRMNYTDWNLVVQHPNFNNITKLFSFNYKPLSPYGGRINDSAMFWGMKFYNDLLNQAGPFGNAQTEILLQKDPETFTFEKGWAFPRRVYFNGDNCVMPPPDAYPWLPNSSPPTKQPWTLELLVFWTALAILLAYYV

SEQ ID NO: 9361 - protein, 447 aa, Secale cereale
MAALSGCAVLLAAALLLSAPAATEAYDSLDPNGNITIKWDILSWTADGYVAMVTIYNFQQFRHISAPGWQLGWTWAKKEVIWSMVGAQTTEQGDCSKFKTNPPHCCKRDPTVIDLLPGTPYKDQVANCCKGGVISTFNQDPANAASSFQISVGLSGTTNKTVKLPRNFTLKTPGPGYTCSRATVVRPTKFLIGDGRRTTQALMTWNVTCTYSQFLAQKTPTCCVALSSFYNNTIVGCPTCSCGCQNNNTHPGSCVNPNSPYLQSAIDGPGKYTGQPLVQCTSHMCPVKVHWHVKLNYKDYWRVKVTITNFNYRMNYTDWNLVVQHPNFNNITKLFSFNYKPLSPYGGRINDSAMFWGMKFYNDLLNQAGPFGNAQTEILLQKDPETFTFEKGWAFPRRVYFNGDNCVMPPPDAYPWLPNASPPMKQPWTLELLVFWTALATLLAYYV

SEQ ID NO: 9362 - protein, 766 aa, Sorghum bicolor
MAHEREPLLQQRQTGVGNAAAGAKGSSSAPAPAASAALPSLARTVLKFLMWAVFLTWAAGIFLYPTKPVQAVFTKWVRLSKESMFGIAGGIFLAFSAPILIIALLAYVYISFFPSERVVEKKKLRSLSFRLWTFPVLVDGPFGVVSAAEFIGIVLFIIFVVYSMTYYAVESVSLVSKFDLPSMTQSELILDVIGARFGAVGLFCMLFLFLPVARGSVLLRLIDIPFEHATRYHVWLGHLTMALFTLHGLFFVISWSMEGRLREEMREWNETGVANLPGVISLAAGLLMWVTSLHPVRKRFFELFFYTHQLYVIFIVFLAFHVGNFLFSISAGVVFLFMLDRFLRFWQSRAKVDIISAACRPCGTVELVFSKPPGLRYNALSFIFIQVRELSFLQWHPFSVSSSPMDGRYHMSVLIKILGTWTEKLRSIITDVQDKNRGDSELQCGRMTACVEGPYGHESPYHLMYENLILVAGGIGISPFLAILSDIIHRIEEGKQCMPKNVLVLWSVKKSKELSLLSAVDAQTISSSVSDRLKLDIQAFVTQESLPPLEDGIVVDDRKVPGMFVKNGSTMSGLVGTGDNFWAAMYFLASTLGFLLAFTLVEAYYVKPHNVVAWWYRSLLFMLCMVAGVALPGGLVVLLWHLSEKQRMEGDKWDAAADSQSPRAEQTGPAAAAGGGDDDAVPGVSLAALRTTRYGCRPNFEAEFAAFAERAGDAADVGVLVCGPPGLQTSVARECRARNLRRRGGGGAEKSRSSAVFHFNSHSFDL

SEQ ID NO: 9363 - protein, 173 aa, Setaria italica
MAPTAPAATGAASPAAPTVAKGEAKAAARSVGLRLPALPPLPGLGLAAQGQTRAVSVCKLLARNVVAMAAGEPAAPNAANEEFTEFVNALKQEWDRIEDKYAVTTLAVAATLGMWSAGGVVSAIDRLPVVPGLMEAVGIGYSGWFAYRNLLFKSDRDAFFAKVREVYEDIISG

SEQ ID NO: 9364 - protein, 372 aa, Glycine max
MATTSASFARFSVISRPSSSNPQFILFNAAPRTGTPHSRTGSARFRCLAGQTGFFTKLGRLIKEKAKSDVEKLFSGFSKTRSNLAVIDELLLYWNLADTDRVLDELEEALLVSDFGPRITIKIVENLREDIFSGKLKSGNEIKEALKRNVLELLTSKGSKTELQLGYRKPAVIMIVGVNGGGKTTSLGKLAYRLKNEGAKILMAAGDTFRAAASDQLEIWAERTGCEIVVAESEKAKASSVLSQAVKKGKELGFDIVLCDTSGRLHTNYSLMEELISCKKSVAKVVPGAPNEILLVLDGTTGLNMLPQAREFNDVVGVTGLVLTKLDGSARGGCVVSVVDELGIPVKFVGVGEGVEDLQPFDAEAFVNAIFM

SEQ ID NO: 9365 - protein, 371 aa, Cajanus cajan
MATTSASFARFSVISKLSSHPQFILFNIATPTGNPHSRTGAARFRCSAGQTGFFTKLGRLLKEKAKSDVEKVFSGFSKTRNNLAVIDELLLYWNLADTDRVLDELEEALLVSDFGPKITIKIVENLREDILSGKLKSGNEIKEALKRNVLELLTSKGSKTELQLGFRKPSVIMIVGVNGGGKTTSLGKLAYRLKNEGAKILMAAGDTFRAAASDQLEIWAERTGCEIVVAESEKAKASSVLSQAVKKGKELGFDIVLCDTSGRLHTNYSLMEELISCKKSVAKVIPGAPNEILLVLDGTTGLNMLPQAREFNDVVGVTGLILTKLDGSARGGCVVSVVDELGIPVKFVGVGEGVEDLQPFDAEAFVNAIFM

SEQ ID NO: 9366 - protein, 371 aa, Phaseolus coccineus
MATISASLARFCVISRPSSNSQYILFNVAPRTGTPNSRTGSARFRCSAGQAGFFTKLGRLIKEKAKSDVEKVFSGFSKTRNNLAVIDELLLYWNLADTDRVLDELEEALLVSDFGPKITIKIVENLREDILSGKLKSGNEIKEALKRNVLELLTSKGSKTELQLGFRKPAVIMIVGVNGGGKTTSLGKLAYRLKNEGAKILLAAGDTFRAAASDQLEIWAERTGCEIVMAESEKAKASSVLSQAVKKGKQLGFDVVLCDTSGRLHTNYSLMEELISCKKSVAKVIPGAPNEILLVLDGTTGLNMLPQAREFNDVVGVTGLILTKLDGSARGGCVVSVVDELGIPVKFVGVGEGVEDLQPFDADAFVNAIFM

SEQ ID NO: 9367 - protein, 371 aa, Phaseolus coccineus
  misc_feature (10)..(10): Xaa can be any naturally occurring amino acid
  misc_feature (12)..(12): Xaa can be any naturally occurring amino acid
  misc_feature (109)..(110): Xaa can be any naturally occurring amino acid
MATISASLAXFXVISRPSSNSQYILFNVAPRTGTPNSRTGSARFRCSAGQTGFFTKLGRLIKEKAKSDVEKVFSGFSKTRNNLAVIDELLLYWNLADTDRVLDELEEAXXVSDFGPKITIKIVENLREDILSGKLKSGNEIKEALKRNVLELLTSKGSKTELQLGFRKPAVIMIVGVNGGGKTTSLGKLAYRLKNEGAKILLAAGDTFRAAASDQLEIWAERTGCEIVMAESEKAKASSVLSQAVKKGKQLGFDVVLCDTSGRLHTNYSLMEELISCKKSVAKVIPGAPNEILLVLDGTTGLNMLPQAREFNDVVGVTGLILTKLDGSARGGCVVSVVDELGIPVKFVGVGEGVEDLQPFDADAFVNAIFM

SEQ ID NO: 9368 - protein, 365 aa, Cicer arietinum
MATTASASFTRFSIIPKPPSQPHFILYNFPNRTGTSRFTCSAGQAGLFSKLGRLLKEKAKSDVEKLFSGFSKTRNNLSVIDELLLYWNLSDTDRVLDELEEALLVSDFGPKITMKIVENLREDILSGKLKSGNEIKEALKKNVLDLLTKKGSKTELQLGFRKPAVIMIVGVNGGGKTTSLGKLAYRLKNGGAKILFAAGDTFRAAASDQLEIWAERTGCEIVVAESQKAKASSVLSQAVKRGKELGFDVVLCDTSGRLHTNYSLMEELISCKKAVAKVVAGAPNEILLVLDGTTGLNMLPQAREFNEVVGVTGLILTKLDGSARGGCVVSVVDELGIPVKFVGVGEGVEDLQPFDAEAFVNAIFM

SEQ ID NO: 9369 - protein, 373 aa, Arachis hypogaea
MASSSSSMCASYSSVISRPFYNSQPQFAFFRTGKLGSVPDSGGRFRCMAGQTGFFTKLGRLIKEKAKSDVEKIFSGGFTKTRKNLAVIDELLLYWNLSDTDRVLDELEEALLVSDFGPKITIKIVENLREDILSGKLKSGTEIKEALKQNVLDLLTTKGSKTELQLGFRKPAVIMIVGVNGGGKTTSLGKLAYRLKKEGAKILMAAGDTFRAAAGDQLEIWAERTDCEIVRAESEKAKASSVLTQAVKKGKELGFDIVLCDTSGRLHTNYSLMEELISCKKAVSKVVAGAPNEILLVLDGTTGLNMLPQAREFNEVVGVTGLILTKLDGSARGGCVVSVVDELGIPVKFVGVGERVEDLQPFDAEAFVNAIFS

SEQ ID NO: 9370 - protein, 251 aa, Medicago truncatula
MATTTSASFSRLSIPPKSPSQPQFLIFTSPFQTKSPSSRTRFTCSAGETGLFTKLGRLLKEKAKSDVEKLFSGFSKTRNNLSVIDELLLYWNLSDTDKVLDELEEALLVSDFGPKITIKIVENLREDILSGKLKSGSEIKEALKKNVLDLLSNKGSKTELQLGYRKPAVIMIVGVNGGGKTTSLGKLAYRLKNGGAKILLAAGDTFRAAASDQLEIWAERTGCEIVVAESEKSKASAVLSQAVKRRKRARL

SEQ ID NO: 9371 - protein, 369 aa, Quercus alba
MAASSANLSLLSKPSTASSPPHLLFNLPKTLSANPRPGTSRFKCSAGQTGFFTRLGRLIKEKAKSDVEKVFSGFSKTRENLAVIDELLLYWNLADTDKVLDELEEALLVSDFGPRITIKIVESLREDILSGKLKSGSEIKDALKKSVLELITTRGSKTELQLGFRKPAVVIIVGVNGGGKTTSLGKLAYRLKNEGAKILMAAGDTFRAAASDQLEIWAERTGCEIVVAEKDKAKASSVLSQAVKRGKEQGFDVVLCDTSGRLHTNFSLMEELIACKKAVGKIVPGAPNEILLVLDGTTGLNMLPQAREFNEVVGITGLILTKLDGSARGGCVVSVVDELGIPVKFVGVGEGVEDLQPFDAEAFVNAIFS

SEQ ID NO: 9372 - protein, 367 aa, Gossypium hirsutum
MASSAQFSLTFKPSPSPLFSNFPRTRFSPFTTARPIASRFKVLASQTGFFTRLGRLIKEKAKSDVEKIFSGFSKTRDNLAVIDELLLYWNLADTDRVLDELEEALLVSDFGPRITIKIVERLREDILSGKLKSGSEIKDALKKSVLDLLTTKGSNTELRLGFRKPAVIMIVGVNGGGKTTSLGKLAYRLKNEGAKILMAAGDTFRAAASDQLEIWAERTGCEIVVAEKENAKASSVLSQAVKRGKEQGFDVVLCDTSGRLHTNYSLMEELIACKKAVEKVVRGAPNEILLVLDGNTGLNMLPQAREFNEVVGITGFILTKLDGSARGGCVVSVVDELGIPVKFVGVGEGVEDLQPFDAEAFVNAIFS

SEQ ID NO: 9373 - protein, 365 aa, Citrullus lanatus
MAAASLSQLSFLSNPSPRSLIVPSLRPTTPFHGGGSRFRCSAGQTGFFTRLGRLLKEKAKSDVEKIFSGFSKTRDNLAVIDELLLYWNLAETDRVLDELEEALLVSDFGPRITIKIVDSLRDDILAGKLKSGSEIKDALKKNVLELLTGKGSKTDLQLGFRKPAVIMIVGVNGGGKTTSLGKLAFRLKNEGAKILMAAGDTFRAAASDQLEIWADRTGCEIVVAEKDNAKASSVLSQAVKKGKEGGFDIVLCDTSGRLHTNYSLMEELIACKKAVAKVIPGAPNEILQVLDGTTGLNMLPQAREFNDVVGITGLILTKLDGSARGGCVVSVVDELGIPVKFIGVGEGLEDLQPFDAEAFVDAIFS

SEQ ID NO: 9374 - protein, 365 aa, Prunus persica
MASPLPSSLHRLSLLSKPSPPQNHRLLVTPTRPELSRFECRAGQTGFFTRLGRLIKEKAKSDVEKLFSGFSKTRDNLAVIDELLLYWNLADTDRVLDELEEALLVSDFGPKITIKIVESLREDIVAGKLKSGSEIKEALKKSVLDLLTTKGSKTELQLGYRKPAVVMIVGVNGGGKTTSLGKLAYRLKKEGAKVLMAAGDTFRAAACDQLEIWAGRTGCEIVVAEKEKAKAASVISQAVKRGKEQGYDIVLCDTSGRLHTNYSLMEELIACKKAVSKVIPGAPNEILQVLDGTTGLNMLPQAREFNEIVGITGLILTKLDGSARGGCVVSVVNELGIPVKFVGVGEGVEDLQPFDAEAFVNAIFS

SEQ ID NO: 9375 - protein, 368 aa, Cucumis sativus
MAAASLSQLSFLSNPSPRSLFVPSLRPTTPFRRIHGDGSRFRCSAGQTGFFTRLGRLLKEKAKSDVEKVFSGFSKTRDNLAVIDELLLYWNLAETDRVLDELEEALLVSDFGPRITIKIVDSLRDDILAGKLKSGSEIKEALKKNVLELLKGKGSKTDLQLGFRKPAVIMIVGVNGGGKTTSLGKLAFRLKNEGAKILMAAGDTFRAAASDQLEIWADRTGCEIVVAEKENAKASSVLSQAVKRGKEGGFDIVLCDTSGRLHTNYSLMEELIACKKAVAKVIPGAPNEILQVLDGTTGLNMLPQAREFNDVVGITGLILTKLDGSARGGCVVSVVDELGIPVKFVGVGEGLEDLQPFDPEAFVDAIFS

SEQ ID NO: 9376 - protein, 367 aa, Gossypium raimondii
MASSTQFSLTFKPSPSPLFSNFPRTRFGPFTTARPIASRFKVLASQTGFFTRLGRLIKEKAKSDVEKIFSGFSKTRDNLAVIDELLLYWNLADTDRVLDELEEALLVSDFGPRITIKIVERLREDILNGKLKSGSEIKDALKKSVLDLLTTKGSNTELRLGFRKPAVIMIVGVNGGGKTTSLGKLAYRLKNEGAKILMAAGDTFRAAASDQLEIWAERTGCEIVVAEKENAKASSVLSQAVKRGKEQGFDVVLCDTSGRLHTNYSLMEELIACKKAVEKVVRGAPNEILLVLDGNTGLNMLPQAREFNEVVGITGFILTKLDGSARGGCVVSVVDELGIPVKFVGVGEGVEDLQPFDAEAFVNAIFS

SEQ ID NO: 9377 - protein, 370 aa, Unknown
  Sequence found in Organisms: Citrus clementina, Citrus sinensis
MASATPTRLPLISKHTSFYLTNCLPQTRFSHCTAIRPATNRFKCSAGGQTGFFTRLGRLIKEKAKSDVEKIFSGFSKTRDNLAVIDELLLYWNLADTDKVLDELEEALLVSDFGPRITIKIVESLRDDILAGKLKSGPDIKDALKNSVLDLLTKKGNKTELQLGYRKPAVVLIVGVNGGGKTTSLGKLAYRLKNEGAKILMAAGDTFRAAASDQLEIWAERTGCEIVVAEGEKAKASSVLSQAVKRGKEQGFDIVLCDTSGRLHTNYSLMEELVACKKAVGKVVNGAPNEILLVLDGTTGLNMLPQAREFNDVVGITGLILTKLDGSARGGCVVSVVDELGIPVKFVGVGEGVEDLQPFDAEAFVNAIFS

SEQ ID NO: 9378 - protein, 367 aa, Gossypium hirsutum
MASSTQFSLTFKPSPSPLFSNFPRTRFGPFTTARPIASRFKVLASQTGFFTRLGQLIKEKAKSDVEKIFSGFSKTRDNLAVIDELLLYWNLADTDRVLDELEEALLVSDFGPRITIKIVERLREDILNGKLKSGSEIKDALKKSVLDLLTTKGSNTELRLGFRKPAVIMIVGVNGGGKTTSLGKLAYRLKNEGAKILMAAGDTFRAAASDQLEIWAERTGCEIVVAEKENAKASSVLSQAVKRGKEQGFDVVLCDTSGRLHTNYSLMEELIACKKAVEKVVRGAPNEILLVLDGNTGLNMLPQAREFNEVVGITGFILTKLDGSARGGCVVSVVDELGIPVKFVGVGEGVEDLQPFDAEAFVNAIFS

SEQ ID NO: 9379 - protein, 367 aa, Vitis vinifera
MASPSPFVRSLSASPTPPSLFAFNLPRTRFAPKPPSAPRFTCQAGQTGFFTRLGRLIKEKTKSDVEKLFSGFSKTRDNLAVIDELLLYWNLADTDRVLDELEEALLVSDFGPRITIKIVESLRDDILAGKLKSGSEIKDALKKSVLDLLTKKGSKTALQLGFRKPAVVIIVGVNGGGKTTSLGKLAYKLKKEGAKVLMAAGDTFRAAASDQLEIWAERTGCEIVVAEGEKAKASSVLSQAVKRGKEQGFDIVLCDTSGRLHTNYSLMEELIACKKAVGKVVSGAPNEILLVLDGTTGLNMLPQAREFNEVVGISGLILTKLDGSARGGCVVSVVDELGIPVKFVGVGEGVEDLQPFDAEVFVNAIFS

SEQ ID NO: 9380 - protein, 174 aa, Fagus grandifolia
MAASPAHLSLLSKPSPTTSSPHLLLNLPNTRSTTPFHHTRPANSRFKCSAGQTGFFTRLGRLIKEKAKSDVEKIFSGFYKTRDNLAVIDELLLYWNLADTDKVLDELEEALLVSDFGPRITIKIVDRLREDILAGKLKSGSEIKEALKNSVLELITTRGSKPSFNSDSGNQLWL

SEQ ID NO: 9381 - protein, 351 aa, Vinca minor
PAPATTTIFSPSPLFHRSPSRRFKCSAGQGTGFFTKLGRLIKEKAKSDVEKIFSGFTKTRDNLAVIDELLLYWNLSDTDRVLDELEEVLLVSDFGPRITIKIVESLRDDIYGGKLKSGSEIKDALKRSILNLLTSKAPKTELKLGFRKPAVIMIVGVNGGGKTTSLGKLAYRLKKEGAKILMAAGDTFRAAASDQLEIWAERTGCEIVMAEKDKAKASSVLSQAVKRGKEEGYDIVLCDTSGRLHTNYSLMEELVACKKVVGKIIPGAPNEILLVLDGTTGLNMLPQAREFNEVVGVTGLILTKLDGSARGGCVVSVVDELGIPVKFVGVGEGVEDLQPFDAEAFVNAIFP

SEQ ID NO: 9382 - protein, 199 aa, Amsonia hubrichtii
MIVGVNGGGKTTSLGKLANRLKKEGAKILMAAGDTFRAAASDQLEIWAERTGCEIVVAEKEKAKASSVLSQAVKRGKEEGYDIVLCDTSGRLHTNYSLMEELVACKKTVSKIIPGAPNEILLVLDGTTGLNMLPQAREFNEVVGVTGLILTKLDGSARGGCVVSVVDELGIPVKFVGVGEGAEDLQPFDAEAFVNAIFP

SEQ ID NO: 9383 - protein, 383 aa, Cirsium arvense
MVSSISHGWSPALRNSISTPGSTTVFNHLSPPLLLRVQSPTTGGGGGTQFSKFRCSAAGSETGFFTKLGRLIKEKAKKDVEKIFSGGFSKTRDNLAVIDELLLYWNLSDTDRVLDELEEALLVSDFGPKITIKIVESLRDDIYAGKLKSGNEIKDALKNSVLDLLTKKGSKTELRLGYRKPAVIMIVGVNGGGKTTSLGKLAHRLKGEGATVLMAAGDTFRAAASDQLEIWAERTGCEIVSAEKEKAKASSVLSQAVKKGKEQGVDIVLCDTSGRLHTNYSLMEELIACKKAVAKVVPGAPNEILLVLDGTTGLNMLPQAREFNEVVGITGFILTKLDGSARGGCVVSVVDELGIPVKFVGVGEGVEDLQPFDAEAFVNAIFP

SEQ ID NO: 9384 - protein, 365 aa, Populus trichocarpa
MATLAHLSLLSKPPPQLNNLFSTIPRTRLNPQSKPTRFKCLASQTGFFTKLGRLIKEKAKSDVEKIFSGFSKTRDNLAVIDELLLYWNLSETDRVLDELEEALLVSDFGPRITIQIVEKLREDILAGKLKSGSEIKDALKKSVLDLLQKKGNKTELQLGFRKPAVVMIVGVNGGGKTTSLGKLAYRLKNEGAKILMAAGDTFRAAASDQLEIWAERTGCEIVVADREKAKASSVLSQAVKKGKEQEFDVVLCDTSGRLHTNYSLMEELIACKKAVGKIVRGAPNEILLVLDGTTGLNMLPQAREFNEVVGITGFILTKLDGSARGGCVVSVVDELGIPVKFVGVGEGVEDLQPFDAEAFVNAIFS

SEQ ID NO: 9385 - protein, 377 aa, Cirsium arvense
MVSSLPHPLRNYHSTPGSTTVFNHHSPPLFLRLQSGTSGGGTQASRLRCSAAGSQTGFFTKLGRLIKEKAKKDVEKIFSGGFSKTRDNLAVIDELLLYWNLSDTDRVLDELEEALLVSDFGPKITIKIVESLRDDIYAGKLKSGNEIKDALKSSVLDLLTKKGAKTELKLGFRKPAVIMIVGVNGGGKTTSLGKLAYRLKSEGATVLMAAGDTFRAAASDQLEIWAERTGCEIVSAEKEKAKASSVLSQAVKKGKEGGYDIVLCDTSGRLHTNYSLMEELIACKKAVAKVVAGAPNEILLVLDGTTGLNMLPQAREFNEVVGITGFILTKLDGSARGGCVVSVVDELGIPVKFVGVGEGVEDLQPFDAEAFVNAIFS

SEQ ID NO: 9386 - protein, 343 aa, Tripterygium wilfordii
CLPRTAWSVSCRTRRFKCSASQAGFFTRLGRLIKEKAKSDVEKIFSGFSKTRDNLAVIDELLLYWNLSDTDRVLDELEEALLVSDFGPRITIKIVESLREDILGGKLKSGSEIKDALKQIVLDLLTKKGSKTELQLGFRKPAVIMIVGVNGGGKTTSLGKLAYRLKNEGAKILMAAGDTFRAAATDQLEIWAERTSCEIVVAERENAKASSVLSQAVKRGKEQGFDVVLCDTSGRLHTNYSLMEELIACKKAVAKIVPGTPNEILLVLDGNTGLNMLPQAREFNEVVGITGFILTKLDGSARGGCVVSVVDELGIPVKFVGVGEGVEDLQPFDAEAFVNAIFS

SEQ ID NO: 9387 - protein, 242 aa, Euphorbia esula
EMAATRAHVSLLSKPSPPLNQLFEIPPRTGFNPRKSSKFKCQSSGFFTKLGRLIKEKAKSDVDKIFSGFSKTRDNLAVIDELLLYWNLSDTDRVLDELEEILLVSDFGPRITIKIVESLREDILSGKLKSGNEIKESLKKSVLELLIKKGNKTELQLGFRKPAVIMIVGVNGGGKTTSLGKLAYRLKNEGAKILMAAGDTFRAAASDQLEIWAERTGCEIVVAEKEKAKASSGCEKRERARL

SEQ ID NO: 9388 - protein, 170 aa, Prunus persica
MAAGDTFRAAACDQLEICAERMGCEIVVAEKEKAKAASVISQAVKRGKEQGYDIVLCDTSGRLHTNYSLMEELIACKKAVSKVIPGAPNEILQVLDGTMGLNMLPQAREFNEIVGITGLILTKLDGSARGGCVVSVVNELGIPVKFVGVGEGVEDLQPFDAEAFVNAIFS

SEQ ID NO: 9389 - protein, 365 aa, Fragaria vesca
MASPLPSSLSHFSLLSKPAPLPHQNHRLLLAPTRPGSSGLQCRAGTGFFNRLGRLIKEKAKSDVEKLFSGFSKTRDNLAVIDELLLYWNLADTDRVLDELEEALLVSDFGPKITIKIVESLREDIVAGKLKSGSEIKEALKKNVLDLLTIKGKTELQLGYRKPAVIMIVGVNGGGKTTSLGKLAYRLKNEGAKVLMAAGDTFRAAAGDQLEIWAERTGCEIVVAEKEKAKAATVISQAVKRGKEQGYDIVLCDTSGRLHTNYSLMEELIACKKAVGKVMPGSPNEILQVLDGTTGLNMLPQAREFNEIVGITGLILTKLDGSARGGCVVSVVNELGIPVKFVGVGESVEDLQPFDAEAFVNAIFS

SEQ ID NO: 9390 - protein, 362 aa, Ricinus communis
MATPTQLSLLSKPSTPHLFVKLPRTGFNPKKTGRFKCQASQSGFFTKLGRLIKEKAKSDVEKIFSGFSKTRDNLAAFDELLLYWNLSDTDKILDELEEILLVSDFGPRITINIVESLRKDILSGKLKSGSEIKDALKKSVLQLLINKGNKTDLQLGFRKPAVIMIVGVNGGGKTTSLGKLAYRLKNEGAKILMAAGDTFRAAASDQLEIWAERTGCEIVVAEKEKAKASSVLSQAIKRGKEQGFDVVLCDTSGRLHTNYSLMEELIACKKAIGKVVPGAPNEILLVLDGNTGLNMLPQAREFNEVVGITGLILTKLDGSARGGCVVSVVDELGIPVKFVGVGEGVEDLQPFDAEAFVNAIFP

SEQ ID NO: 9391 - protein, 372 aa, Tabernaemontana elegans
MATLSPRLSPLSSQRQILQPPPASTIFSLSTATRFPLSQSNQSRFKCSAGQTGFFTKLGRLIKEKAKSDVEKIFSGFTKTRDNLAVIDELLLYWNLSDTDRVLDELEEALLVSDFGPRITIKIVESLRDDIYGGKLKSGSEIKDALKGSILDLLTSKALKTELQLGFRKPAVIMVVGVNGGGKTTSLGKLANRLKKEGAKVLMAAGDTFRAAASDQLEIWAERTGCEIVVAEKEGAKASSVLSQAVKRGKEEGYDIVLCDTSGRLHTNYSLMEELVACKKTVSKILPGGPSEILLVLDGTTGLNMLPQAREFNEVVGVTGLILTKLDGSARGGCVVSVVDELGIPVKFVGVGEGTEDLQPFDAEAFVNAIFP

SEQ ID NO: 9392 - protein, 361 aa, Cleome spinosa
MASSAHLSFLAGRSALISGDGVRFSPNRPAWSRLRCSAGQSGFFTRLGRLIKEKAKSDVEKVFSGFSKTRDNLAVIDELLLYWNLADTDRVLDELEEALLVSDFGPKITIRIVEKLRDGIMSGKLKSGSEIKDALKNSVLEILSKKSNKTELQLGFRKPAVIMIVGVNGGGKTTSLGKLAHRLKNEGTKVLMAAGDTFRAAASDQLEIWAERTGCEIVVAEGEKAKASSVLSQAVKRGKEEGFDVVLCDTSGRLHTNFSLMEELIACKKAVGKVVSGAPNEILLVLDGNTGLNMLPQAREFNEVVGITGLILTKLDGSARGGCVVSVVDELGIPVKFIGVGEGVEDLQPFDAEAFVNAIFS

SEQ ID NO: 9393 - protein, 362 aa, Manihot esculenta
MAASAHLLLLAKPSTPHLVPAFPRTGSNQHKNARFKCLASQSGFFTRLGRLIKEKAKSDVDKLFSGFSKTRDNLAVIDELLLYWNLSETDRVLDELEEILLVSDFGPRITIKIVESLREDILAGKLKSGSEIKDALKRSVLDLLTKKGNKTDLQLGFRKPAVVLIVGVNGGGKTTSLGKLAYRLKNDGAKILMAAGDTFRAAASDQLEIWAERTGCDIVVAKEEKAKASSVLSQAVKRGKEEGFDVVLCDTSGRLHTNYGLMEELIACKKAVGKVVPGAPNEILLVLDGNTGLNMLPQAREFNEVVGITGLILTKLDGSARGGCVVSVVDELGIPVKFVGVGEGVEDLQPFDAEAFVNAVFS

SEQ ID NO: 9394 - protein, 378 aa, Eucalyptus grandis
MASPSPSSHHLSLLAKPSPPPPPPQPLGLRFRFPPNRTAAPSISRPAGSRFKCSASQTGFFNRLGRLIKEKAKSDVEKIFSGFSKTRENLAVIDELLLYWNLADTDRVLDELEEALLVADFGPRITVRIVDRLREDILAGKLKSGAEIKDTLKKSVLELLTTKGSKTELQLGFRKPAVVMIVGVNGGGKTTSLGKLANRLKREGAKVLLAAGDTFRAAASDQLEIWAERTGCEIVLAEGEKPKASSVLSRAVKRGKEQGFDVVLCDTSGRLHTNYSLMEELVACKKAVAKVVPGAPNEILLVLDGTTGLNMLPQAREFNDVVGVTGYILTKLDGSARGGCVVSVVDELGIPVKFVGVGEGVEDLQPFDAEAFVDAIFA

SEQ ID NO: 9395 - protein, 372 aa, Aristolochia fimbriata
MASPVSFLSPSPAVTSPPKHSFETVSRALIRSQVPTPARIGSARFRCSAGQTGFFTRLGRLIKEKAKSDVEKLFSGFSKTRDNLAVIDELFLYWNLAETDRVLDELEEVLLVSDFGPKISIKIVESLRSDILAGKLKSGSEIKDALKKCVLDLLTAKAKKTELQLGFRKPAVIMIVGVNGGGKTTSLGKLAYRLKNEEVKVLMAAGDTFRAAASDQLEIWAERTDSEIVVGEGEKVKASSVLSQAVKRGKEEGFDVVLCDTSGRLHTNYSLMEELIACKKAVAKVISGAPNEILLVLDGTTGLNMLPQAREFNEVVGITGLILTKLDGSARGGCVVSVVDELGIPVKFVGIGEGVNDLQPFDAEAFVNAIFS

SEQ ID NO: 9396 - protein, 360 aa, Cannabis sativa
MAVSCPSSLSHISLCSNSQSARLLLTRPDKSRFKCSASQTGFFTRLGRLIKEKAKNDVEKIFSGFSKTRDNLAVVDELLLYWNLADTDKVLDELEEALLVSDFGPRITIKIVESLRENILAGKLKSGSEIKDALKKCVLDLLTKKDSKSELQLGFRKPAVVMVVGVNGGGKTTSLGKLAHRLKKEGAKVLMAAGDTFRAAASDQLEIWAERTGCEIVVAEGEKAKASSVLSQAVKRGKLEDYDIVLCDTSGRLHTNYSLMEELISCKKAVGKVLPGAPNEILQVLDGTTGLNMLPQAREFNDVVGITGLILTKLDGSARGGCVVSVVDELGIPVKFVGVGEGVEDLQPFDAEAFVNAIFP

SEQ ID NO: 9397 - protein, 374 aa, Fagopyrum esculentum
MAASMALYLHPPPSSNAQSTITSITHLHRYRHRHLPPACSARFAADFKCRAGQTGFFTKLGRLIKEKAKSDVEKIFSGFSKTRDNLAVVDELLLYWNLADTDRVLDELEEALLVSDFGPKITIKIVESLRADILSGKLKSGPEIKEALKKSVLDLLTSKGNKTELKLGFRKPAVIMIVGVNGGGKTTSLGKLAYRLKNDGAKILMAAGDTFRAAAGDQLEIWAERTGCEIVRAEKEKAKASSVLQQAVKRGKEEGYDIVLCDTSGRLHTNYSLMEELVACKKALSKVVAGAPNEILLVLDGTTGLNMLPQAREFNDVVGITGFILTKLDGSARGGCVVSVVDELGIPVKFVGVGEGVEDLQPFEAEAFVNAIFS

SEQ ID NO: 9398 - protein, 463 aa, Hordeum vulgare
SKPPRRRAPAAATSCAALAAPEKQSTATAKVAPSPAPAPSAPEGTDYDEVAATLETLYKLSPVIVEEDGKSSKKQAATKKKRKQGRTKPAAATTTTPTPKRTVVVRSQRRRRMDLGKRVEMRDQAAGKEDEHRDGERAFEEALLREHAVSTDMGSLDWRRMKIPPVLSAPQSARLFKIMQPMKAILEVQENMRSELQSEPTEAEVAEAMNMPVQRLRRLRDVGRAARNKLIKHNLRLVLYAINKYYPDMTGDERFADLCQAGANGLITAIDRFEPKRGFRISTYALFWIRHSVVRAMTLSSFTRFPFAMESERQEINRAREELSFELGRTPTDEETMKKVGLSPARYRDVVRMTRPAYSLHSRNRVTQEELINEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 9399 - protein, 426 aa, Pennisetum glaucum
MAAAAAAATTPHSLLIQRPTTPAAPRAAAAASSLRLPSRAAKISCAAVAAPSASSPVTGAGDRGVYNFAAGPATLPLNVLQRAQAELVDYRGSGMSIMEMSHRGREFDAAIKKAEADLRALLAVPDTHAVLFLQGGATTQFAAVPLNLCAGPSDPADFVVSGSWSDKAFKEANKYSAASVAWSGKDGKYTALPPFDAIKQNPEARFLHICSNETIHGVEFKDYPEPRNKSGVLVADMSSNFCSKPVDVSRFGVIYAGAQKNVGPSGVTIAIVRKDLIGSAQPITPVMLDYKTHADNASLYNTPPCFAIYICGLVFEDLLAQGGLAEVEKKNAHKAGILYDTIDASGGYYICPLEKSVRSLMNVPFTLAKGPDFEKQFIAEAAKEGMVQLKGHRSVGGVRASIYNAMPLAGVEKLVAFMKDFQARNP

SEQ ID NO: 9400 - protein, 426 aa, Oryza sativa
MAAAAAAATTPNSLLLRRPAAPKPASAAASPLRLPTRAARISCAAVATPAQSSSSPAAAAADRGVYNFAAGPATLPLSVLQRAQAELVDYRGSGMSIMEMSHRGKEFDAAIKKAEADLRALLAVPDTHEVLFLQGGATSQFAAAPLNLCASPSDPADFVVSGSWSDKAFKEAKKFSAASVAWSGKDGKYTSLPPFDAIEQNPEARFLHICSNETIHGVEFKDYPEPKNKSGILVADMSSNFCSKPVDVSRFGLIYAGAQKNVGPSGVTIAIVRKDLVGSAQPITPVMLDYKTHADNASLYNTPPCFAIYICGLVFEDLLAQGGLAEVEKKNAHKAGILYDAIDASGGYYICPVEKSVRSLMNVPFTLAKGGDFEKQFIAEAAKEGMVQLKGHRSVGGVRASIYNAMPLAGVEKLVAFMKDFQARNP

SEQ ID NO: 9401 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 9402 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 9403 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 9404 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 9405 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 9406 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 9407 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 9408 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 9409 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 9410 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 9411 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 9412 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 9413 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 9414 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 9415 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 9416 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 9417 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 9418 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 9419 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 9420 - DNA, 31 bp, Artificial Sequence
  Primer
aaaggatcctacaatctcgtctacgctggag

SEQ ID NO: 9421 - DNA, 36 bp, Artificial Sequence
  Primer
aaaggtaccctacaagagatcgaatagaggaaccac

SEQ ID NO: 9422 - DNA, 31 bp, Artificial Sequence
  Primer
aaaggtaccataaagcatggctagaggcgag

SEQ ID NO: 9423 - DNA, 35 bp, Artificial Sequence
  Primer
aaaggtaccctagcgactccaatgactacagaaag

SEQ ID NO: 9424 - DNA, 31 bp, Artificial Sequence
  Primer
aaagaattcaatgcagaaagcatgccattag

SEQ ID NO: 9425 - DNA, 31 bp, Artificial Sequence
  Primer
aaaggtaccggaccaggtgttacaggttacg

SEQ ID NO: 9426 - DNA, 31 bp, Artificial Sequence
  Primer
aaagaattcttcaatgtccattatgctcacc

SEQ ID NO: 9427 - DNA, 34 bp, Artificial Sequence
  Primer
aaaggtaccctaaactgcaatcggtttcttgaac

SEQ ID NO: 9428 - DNA, 31 bp, Artificial Sequence
  Primer
aaaggtaccccaaatgaaagaatccgaacag

SEQ ID NO: 9429 - DNA, 32 bp, Artificial Sequence
  Primer
aaaggtaccctattctggaggttctggtcgtc

SEQ ID NO: 9430 - DNA, 31 bp, Artificial Sequence
  Primer
aaaggatccacctcaccatatgcaaacacag

SEQ ID NO: 9431 - DNA, 31 bp, Artificial Sequence
  Primer
aaaggtaccgttgtgcaaagacagttgttcg

SEQ ID NO: 9432 - DNA, 31 bp, Artificial Sequence
  Primer
aaaggatccattcagcattgatgtgatgtgc

SEQ ID NO: 9433 - DNA, 31 bp, Artificial Sequence
  Primer
aaaggtaccgcgcaaatggtacattacatcc

SEQ ID NO: 9434 - DNA, 32 bp, Artificial Sequence
  Primer
aaaggtaccacaagggaatcaattaggaaagc

SEQ ID NO: 9435 - DNA, 27 bp, Artificial Sequence
  Primer
tttaggcctcctacgcacgacctcatg

SEQ ID NO: 9436 - DNA, 30 bp, Artificial Sequence
  Primer
aaacccgggaaacgccacacattattctgc

SEQ ID NO: 9437 - DNA, 31 bp, Artificial Sequence
  Primer
aaaggtaccctgcagaatgttcgatcaagag

SEQ ID NO: 9438 - DNA, 31 bp, Artificial Sequence
  Primer
aaaggtaccttcaccagttgagaggaacaac

SEQ ID NO: 9439 - DNA, 36 bp, Artificial Sequence
  Primer
tttggtaccttcaggtcttcagtaatctcagtaagc

SEQ ID NO: 9440 - DNA, 35 bp, Artificial Sequence
  Primer
ttaggatccgcttaacattaaacatcgtatccagg

SEQ ID NO: 9441 - DNA, 29 bp, Artificial Sequence
  Primer
tttgatatctcagaatcacacggcctgga

SEQ ID NO: 9442 - DNA, 31 bp, Artificial Sequence
  Primer
aaagaattcctacaacatatctgccgcagtg

SEQ ID NO: 9443 - DNA, 31 bp, Artificial Sequence
  Primer
aaaggtacctagacatccaaacgaaggaacc

SEQ ID NO: 9444 - DNA, 31 bp, Artificial Sequence
  Primer
aaaaggccttctattgagctcgttcctccag

SEQ ID NO: 9445 - DNA, 31 bp, Artificial Sequence
  Primer
aaactcgagaagccatacttgctctcattgc

SEQ ID NO: 9446 - DNA, 34 bp, Artificial Sequence
  Primer
tttggtacctcaatccaccaatcacattctctcg

SEQ ID NO: 9447 - DNA, 33 bp, Artificial Sequence
  Primer
tttgaattcttacgtttagaacaggtcccattg

SEQ ID NO: 9448 - DNA, 35 bp, Artificial Sequence
  Primer
tttgaattctcatcactgtgagctgttgttgttgt

SEQ ID NO: 9449 - DNA, 35 bp, Artificial Sequence
  Primer
tttgaattcctacagctgcagctaattcttcatgc

SEQ ID NO: 9450 - DNA, 34 bp, Artificial Sequence
  Primer
aaaggtaccctatctctgcatcacaaacttccac

SEQ ID NO: 9451 - DNA, 31 bp, Artificial Sequence
  Primer
aaaaggccttagcactgcacagaaacacctc

SEQ ID NO: 9452 - DNA, 31 bp, Artificial Sequence
  Primer
aaagatatcgagtgagatcgacccatgtagc

SEQ ID NO: 9453 - DNA, 31 bp, Artificial Sequence
  Primer
aaagaattcgaacaaggacggtttctttgtg

SEQ ID NO: 9454 - DNA, 34 bp, Artificial Sequence
  Primer
aaagaattcctagatgtgcagacatgtgaaactg

SEQ ID NO: 9455 - DNA, 31 bp, Artificial Sequence
  Primer
aaaggtaccgctagcgtgattggatttcttc

SEQ ID NO: 9456 - DNA, 33 bp, Artificial Sequence
  Primer
aaaggtaccctaatacccgaatccgaacacaac

SEQ ID NO: 9457 - DNA, 31 bp, Artificial Sequence
  Primer
aaaggtacctacaacgggaagagatcagagc

SEQ ID NO: 9458 - DNA, 31 bp, Artificial Sequence
  Primer
aaaaggcctgatggcagaacaatacacttgc

SEQ ID NO: 9459 - DNA, 32 bp, Artificial Sequence
  Primer
aaagaattccaacacaaatctgcagacatcac

SEQ ID NO: 9460 - DNA, 31 bp, Artificial Sequence
  Primer
aaagaattctcatcaagaggaggaggatgcc

SEQ ID NO: 9461 - DNA, 30 bp, Artificial Sequence
  Primer
aaaggtaccacacgcatgcatctagctttc

SEQ ID NO: 9462 - DNA, 31 bp, Artificial Sequence
  Primer
aaaggtaccaaagatcactggtcacaccacc

SEQ ID NO: 9463 - DNA, 32 bp, Artificial Sequence
  Primer
aaaggtacccctcatatatggacgcaaatcag

SEQ ID NO: 9464 - DNA, 34 bp, Artificial Sequence
  Primer
aaaggtaccctaattgttgccattcaagttggtc

SEQ ID NO: 9465 - DNA, 31 bp, Artificial Sequence
  Primer
aaagaattcaacaagagatgccatgcctaag

SEQ ID NO: 9466 - DNA, 31 bp, Artificial Sequence
  Primer
aaaggtaccaagggatagacattccacctcc

SEQ ID NO: 9467 - DNA, 31 bp, Artificial Sequence
  Primer
aaagaattcagctccagctttaatagcccag

SEQ ID NO: 9468 - DNA, 31 bp, Artificial Sequence
  Primer
aaaggatcctcgcctgtttaatgagttcctc

SEQ ID NO: 9469 - DNA, 34 bp, Artificial Sequence
  Primer
aaagaattcctatgagctacaaacattcacggac

SEQ ID NO: 9470 - DNA, 31 bp, Artificial Sequence
  Primer
aaagaattcccgtcgtctcttctatttgacc

SEQ ID NO: 9471 - DNA, 29 bp, Artificial Sequence
  Primer
aaagaattcatcgcactggctatcatcag

SEQ ID NO: 9472 - DNA, 35 bp, Artificial Sequence
  Primer
aaaggtaccctaatacaaaggagcagtttggttgg

SEQ ID NO: 9473 - DNA, 31 bp, Artificial Sequence
  Primer
aaaggtacccatgtgaggatcagcctctctc

SEQ ID NO: 9474 - DNA, 34 bp, Artificial Sequence
  Primer
tttgaattcttaagtttacaggtcgaagctgtgg

SEQ ID NO: 9475 - DNA, 31 bp, Artificial Sequence
  Primer
aaaggatccaatatttgttggcgcacatctc

SEQ ID NO: 9476 - DNA, 31 bp, Artificial Sequence
  Primer
aaaggtaccggagtacaaagcaggaagcaac

SEQ ID NO: 9477 - DNA, 31 bp, Artificial Sequence
  Primer
aaaggtacccattcaatgaagattcagggtg

SEQ ID NO: 9478 - DNA, 31 bp, Artificial Sequence
  Primer
aaaggtaccagattccaaacaaccaccgtag

SEQ ID NO: 9479 - DNA, 31 bp, Artificial Sequence
  Primer
aaaggtaccccacttcagaccatatcccatc

SEQ ID NO: 9480 - DNA, 31 bp, Artificial Sequence
  Primer
aaaaggcctccaggaggtagcgatttaccag

SEQ ID NO: 9481 - DNA, 30 bp, Artificial Sequence
  Primer
aaaggtaccgatgaagccaaaccatcaaag

SEQ ID NO: 9482 - DNA, 31 bp, Artificial Sequence
  Primer
aaaggtaccgatcgaaaggaaacgtctgaag

SEQ ID NO: 9483 - DNA, 32 bp, Artificial Sequence
  Primer
aaaggtaccctagggcgatcgagtagtctttg

SEQ ID NO: 9484 - DNA, 31 bp, Artificial Sequence
  Primer
aaagaattccatcaggagttgatctcccttg

SEQ ID NO: 9485 - DNA, 34 bp, Artificial Sequence
  Primer
aaaggtaccctaacatcgtatcaatgaccacctg

SEQ ID NO: 9486 - DNA, 31 bp, Artificial Sequence
  Primer
aaaggtacccaattctaggacctgaagccag

SEQ ID NO: 9487 - DNA, 31 bp, Artificial Sequence
  Primer
aaagaattccaaattcaaacagctgcaacac

SEQ ID NO: 9488 - DNA, 31 bp, Artificial Sequence
  Primer
aaaaggccttaacatgcttgggtgtaagcag

SEQ ID NO: 9489 - DNA, 31 bp, Artificial Sequence
  Primer
aaagagctcagcacaacacattacaaggcac

SEQ ID NO: 9490 - DNA, 39 bp, Artificial Sequence
  Primer
tttggtaccctaaaactactgcctttgagtttctactgc

SEQ ID NO: 9491 - DNA, 34 bp, Artificial Sequence
  Primer
aaaggtaccctaaagtgccatctttcctgttgac

SEQ ID NO: 9492 - DNA, 31 bp, Artificial Sequence
  Primer
aaaggtaccaggtcgcatatccaattagtcg

SEQ ID NO: 9493 - DNA, 33 bp, Artificial Sequence
  Primer
aaaaggcctctagcgcgaccgagatatatacag

SEQ ID NO: 9494 - DNA, 34 bp, Artificial Sequence
  Primer
aaaggatccctattgtgctgagcctacctgtatc

SEQ ID NO: 9495 - DNA, 35 bp, Artificial Sequence
  Primer
aaaggatcctcaataatcctcccataagatgaaag

SEQ ID NO: 9496 - DNA, 31 bp, Artificial Sequence
  Primer
aaagaattcctacacatgatctgcacccatc

SEQ ID NO: 9497 - DNA, 31 bp, Artificial Sequence
  Primer
aaaggtacctgagaaagagggccaaataatg

SEQ ID NO: 9498 - DNA, 33 bp, Artificial Sequence
  Primer
aaagaattctgctctcgcacgtagtaatatagc

SEQ ID NO: 9499 - DNA, 31 bp, Artificial Sequence
  Primer
aaaggtaccaggggcgtgattatctacaatg

SEQ ID NO: 9500 - DNA, 31 bp, Artificial Sequence
  Primer
aaaggtaccaaagaacactacgtcagccacc

SEQ ID NO: 9501 - DNA, 31 bp, Artificial Sequence
  Primer
aaagaattcaaatcacatatgcgagacgatg

SEQ ID NO: 9502 - DNA, 31 bp, Artificial Sequence
  Primer
aaagtcgacactgaacccaataatccgatcc

SEQ ID NO: 9503 - DNA, 32 bp, Artificial Sequence
  Primer
aaaggatccccttctataatacgtctgcggtg

SEQ ID NO: 9504 - DNA, 29 bp, Artificial Sequence
  Primer
aaaggatcccatttgaaccggaggctacc

SEQ ID NO: 9505 - DNA, 28 bp, Artificial Sequence
  Primer
aaaggatccattaggcgcgtgagacgac

SEQ ID NO: 9506 - DNA, 31 bp, Artificial Sequence
  Primer
aaagtcgacttcacctctccgatctctgttc

SEQ ID NO: 9507 - DNA, 32 bp, Artificial Sequence
  Primer
aaaggatccaagaagattattgctgtggttgg

SEQ ID NO: 9508 - DNA, 30 bp, Artificial Sequence
  Primer
aaactcgagcctagaacccaaactcgaagc

SEQ ID NO: 9509 - DNA, 30 bp, Artificial Sequence
  Primer
aaaggatccactctcacatcaaaggcggag

SEQ ID NO: 9510 - DNA, 30 bp, Artificial Sequence
  Primer
aaaggatccagaaaggacagaaccctgagc

SEQ ID NO: 9511 - DNA, 30 bp, Artificial Sequence
  Primer
aaaggatccctaccgttccattccaattcc

SEQ ID NO: 9512 - DNA, 30 bp, Artificial Sequence
  Primer
aaagtcgactatcgtctcgtctcctcggac

SEQ ID NO: 9513 - DNA, 32 bp, Artificial Sequence
  Primer
aaaggatcccgcacctccatctgttctatatc

SEQ ID NO: 9514 - DNA, 30 bp, Artificial Sequence
  Primer
aaagtcgaccaagagtacgcagaggctgag

SEQ ID NO: 9515 - DNA, 33 bp, Artificial Sequence
  Primer
aaaggatccaaggcaaacaagactctctctctc

SEQ ID NO: 9516 - DNA, 31 bp, Artificial Sequence
  Primer
aaaggatcccttagatcagcacagagcgagg

SEQ ID NO: 9517 - DNA, 31 bp, Artificial Sequence
  Primer
aaagaattcctccaatggattactccacctc

SEQ ID NO: 9518 - DNA, 30 bp, Artificial Sequence
  Primer
aaagtcgacctagttcccgagtcgtacgtg

SEQ ID NO: 9519 - DNA, 31 bp, Artificial Sequence
  Primer
aaaggatccattacttgccgtaccacaccag

SEQ ID NO: 9520 - DNA, 28 bp, Artificial Sequence
  Primer
aaaggatccatcactctcccgtcccctc

SEQ ID NO: 9521 - DNA, 26 bp, Artificial Sequence
  Primer
aaaggatcccatccgcaacggccatg

SEQ ID NO: 9522 - DNA, 28 bp, Artificial Sequence
  Primer
aaagtcgaccgaagccatgacgttatcc

SEQ ID NO: 9523 - DNA, 27 bp, Artificial Sequence
  Primer
aaagtcgaccagcatcctgatgtccgt

SEQ ID NO: 9524 - DNA, 28 bp, Artificial Sequence
  Primer
aaactcgagaccaccgaagaagcctcag

SEQ ID NO: 9525 - DNA, 27 bp, Artificial Sequence
  Primer
aaaggatccgattcgatgccttgcctc

SEQ ID NO: 9526 - DNA, 31 bp, Artificial Sequence
  Primer
aaagtcgacatacatgccaacctgttgcttc

SEQ ID NO: 9527 - DNA, 29 bp, Artificial Sequence
  Primer
aaacccgggagatcagggacaagaggtgg

SEQ ID NO: 9528 - DNA, 26 bp, Artificial Sequence
  Primer
aaaggatcccagccatggaagccctc

SEQ ID NO: 9529 - DNA, 26 bp, Artificial Sequence
  Primer
aaagtcgacacctcatggccgattcc

SEQ ID NO: 9530 - DNA, 26 bp, Artificial Sequence
  Primer
aaagtcgaccggaggatggagcatgg

SEQ ID NO: 9531 - DNA, 26 bp, Artificial Sequence
  Primer
aaaggatccccgccatgtccaaagca

SEQ ID NO: 9532 - DNA, 31 bp, Artificial Sequence
  Primer
aaaggatcctccactcccttatcatcgtttc

SEQ ID NO: 9533 - DNA, 30 bp, Artificial Sequence
  Primer
aaagtcgacccgtctctcttctctgcttcc

SEQ ID NO: 9534 - DNA, 30 bp, Artificial Sequence
  Primer
aaagtcgacattagtgcgagcgaggtcatc

SEQ ID NO: 9535 - DNA, 29 bp, Artificial Sequence
  Primer
aaagtcgacgcccacgtcctatccactac

SEQ ID NO: 9536 - DNA, 31 bp, Artificial Sequence
  Primer
aaaggatccctgaatacaggagcaggagagc

SEQ ID NO: 9537 - DNA, 31 bp, Artificial Sequence
  Primer
aaaggatccccattactgtggaggatcaagc

SEQ ID NO: 9538 - DNA, 28 bp, Artificial Sequence
  Primer
aaaggatccctcctctcatctcgccaag

SEQ ID NO: 9539 - DNA, 32 bp, Artificial Sequence
  Primer
aaaggatccgctagattccacaactaggcagg

SEQ ID NO: 9540 - DNA, 27 bp, Artificial Sequence
  Primer
aaactcgaggcgccaaaccctagatcc

SEQ ID NO: 9541 - DNA, 30 bp, Artificial Sequence
  Primer
aaagtcgacctctctttccgccttcacttc

SEQ ID NO: 9542 - DNA, 26 bp, Artificial Sequence
  Primer
aaaggatcccatcgcatgcaaccacc

SEQ ID NO: 9543 - DNA, 31 bp, Artificial Sequence
  Primer
aaaggatcccgttgtcggaagctcaagttag

SEQ ID NO: 9544 - DNA, 29 bp, Artificial Sequence
  Primer
aaaggatccgtaggataagccgcttgtgg

SEQ ID NO: 9545 - DNA, 30 bp, Artificial Sequence
  Primer
aaaggatccctgagcactccatccactagc

SEQ ID NO: 9546 - DNA, 29 bp, Artificial Sequence
  Primer
aaaggatccttcgtcagtacaacgcctcc

SEQ ID NO: 9547 - DNA, 31 bp, Artificial Sequence
  Primer
aaagtcgacgatcctaagttgctgaccttgc

SEQ ID NO: 9548 - DNA, 31 bp, Artificial Sequence
  Primer
aaaggatcctcgtctcgtgtataaggcgttc

SEQ ID NO: 9549 - DNA, 31 bp, Artificial Sequence
  Primer
aaagtcgacccataatcccatcccatttaac

SEQ ID NO: 9550 - DNA, 32 bp, Artificial Sequence
  Primer
aaagtcgacgagagagacgaatcttccgaatc

SEQ ID NO: 9551 - DNA, 29 bp, Artificial Sequence
  Primer
aaagtcgacgagagcctccagaaacccac

SEQ ID NO: 9552 - DNA, 31 bp, Artificial Sequence
  Primer
aaagtcgacagcgtttaagttccactcctcg

SEQ ID NO: 9553 - DNA, 28 bp, Artificial Sequence
  Primer
aaagtcgacagtacgtgcgaagcagcac

SEQ ID NO: 9554 - DNA, 30 bp, Artificial Sequence
  Primer
aaaggatccctccgttcactccatctcttg

SEQ ID NO: 9555 - DNA, 30 bp, Artificial Sequence
  Primer
aaaggatccggcgcccaattgtatagtagc

SEQ ID NO: 9556 - DNA, 26 bp, Artificial Sequence
  Primer
aaaggatcctctcctggtcctggcca

SEQ ID NO: 9557 - DNA, 31 bp, Artificial Sequence
  Primer
aaagtcgacacgcactaaccctaaagcttcc

SEQ ID NO: 9558 - DNA, 31 bp, Artificial Sequence
  Primer
aaaggatcccattccatcttctgctgggtag

SEQ ID NO: 9559 - DNA, 31 bp, Artificial Sequence
  Primer
aaaggatcctacctctacctaccggagcagg

SEQ ID NO: 9560 - DNA, 27 bp, Artificial Sequence
  Primer
aaaggatcctgaacttcttggcggctg

SEQ ID NO: 9561 - DNA, 32 bp, Artificial Sequence
  Primer
aaaggatcccagaaccagtaactcgcactgac

SEQ ID NO: 9562 - DNA, 29 bp, Artificial Sequence
  Primer
aaagtcgaccgaattcccaaagtctcacg

SEQ ID NO: 9563 - DNA, 31 bp, Artificial Sequence
  Primer
aaaggatccctagcttctagcagtccggagg

SEQ ID NO: 9564 - DNA, 32 bp, Artificial Sequence
  Primer
aaaggatcccacacatatacacacctccttgc

SEQ ID NO: 9565 - DNA, 32 bp, Artificial Sequence
  Primer
aaaggatccctcaagagtcacacaagcaagag

SEQ ID NO: 9566 - DNA, 30 bp, Artificial Sequence
  Primer
aaactcgaggagaagccgagaagcaatcag

SEQ ID NO: 9567 - DNA, 28 bp, Artificial Sequence
  Primer
aaaggatccaagaacctctgcctccgtg

SEQ ID NO: 9568 - DNA, 30 bp, Artificial Sequence
  Primer
aaaggatccacacccatcgcctctctattc

SEQ ID NO: 9569 - DNA, 31 bp, Artificial Sequence
  Primer
aaactcgagtgcgggtcaaactagactcttc

SEQ ID NO: 9570 - DNA, 32 bp, Artificial Sequence
  Primer
aaagtcgactggatcttcttgtcttccaactc

SEQ ID NO: 9571 - DNA, 31 bp, Artificial Sequence
  Primer
aaagtcgacaattgaaaacccttcgtccaac

SEQ ID NO: 9572 - DNA, 32 bp, Artificial Sequence
  Primer
aaaggatccatcttcggcatcagacaatagac

SEQ ID NO: 9573 - DNA, 30 bp, Artificial Sequence
  Primer
aaaggatccggaggcacttagcagcagtag

SEQ ID NO: 9574 - DNA, 31 bp, Artificial Sequence
  Primer
aaaggatccctccttgccttccttcaagttc

SEQ ID NO: 9575 - DNA, 31 bp, Artificial Sequence
  Primer
aaagaattcagattctggactgttccacacg

SEQ ID NO: 9576 - DNA, 30 bp, Artificial Sequence
  Primer
aaagtcgacaccacagtcacaggtctcacg

SEQ ID NO: 9577 - DNA, 28 bp, Artificial Sequence
  Primer
aaagtcgaccggaagcaagtgagctgag

SEQ ID NO: 9578 - DNA, 28 bp, Artificial Sequence
  Primer
aaagtcgacgtgcgtgtgggagttgaag

SEQ ID NO: 9579 - DNA, 30 bp, Artificial Sequence
  Primer
aaaggatcctcggtttatcacctatcgagc

SEQ ID NO: 9580 - DNA, 27 bp, Artificial Sequence
  Primer
aaagatatcagagccaaacgccaagac

SEQ ID NO: 9581 - DNA, 27 bp, Artificial Sequence
  Primer
aaaggatccgaacggggaaagggatct

SEQ ID NO: 9582 - DNA, 28 bp, Artificial Sequence
  Primer
aaaggatccgagaaggacaatcgcgtcc

SEQ ID NO: 9583 - DNA, 30 bp, Artificial Sequence
  Primer
aaactcgaggcaaattcctcaccaaaccac

SEQ ID NO: 9584 - DNA, 36 bp, Artificial Sequence
  Primer
aaaggtaccctaaattcgtgcattacatttcaagag

SEQ ID NO: 9585 - DNA, 31 bp, Artificial Sequence
  Primer
aaagaattcagcaccagattcagcctgttac

SEQ ID NO: 9586 - DNA, 31 bp, Artificial Sequence
  Primer
aaaggtacccaattgcatgattgatcgaaag

SEQ ID NO: 9587 - DNA, 31 bp, Artificial Sequence
  Primer
aaagaattcgtcaaagacctctaggccacac

SEQ ID NO: 9588 - DNA, 31 bp, Artificial Sequence
  Primer
aaaggtaccaaaggtactgaggcaccaagtg

SEQ ID NO: 9589 - DNA, 31 bp, Artificial Sequence
  Primer
aaagaattctaatttgcagcaactagcaagg

SEQ ID NO: 9590 - DNA, 34 bp, Artificial Sequence
  Primer
aaaggtaccctaagcatattcgagtggaacaacc

SEQ ID NO: 9591 - DNA, 32 bp, Artificial Sequence
  Primer
aaaggtaccctatccaaaccaaatcccttctg

SEQ ID NO: 9592 - DNA, 31 bp, Artificial Sequence
  Primer
aaaggatccgaatcacatgaacatgcacctc

SEQ ID NO: 9593 - DNA, 31 bp, Artificial Sequence
  Primer
aaaggtacccactaatcatccaatcgcacac

SEQ ID NO: 9594 - DNA, 31 bp, Artificial Sequence
  Primer
aaaggtaccttcatccattcccaggtatcag

SEQ ID NO: 9595 - DNA, 31 bp, Artificial Sequence
  Primer
aaaggtaccatgccagattcatttccttcac

SEQ ID NO: 9596 - DNA, 34 bp, Artificial Sequence
  Primer
aaaggtaccctacccaatttcagcagacaagttc

SEQ ID NO: 9597 - DNA, 31 bp, Artificial Sequence
  Primer
aaagaattcacatgtttacattgccagaacg

SEQ ID NO: 9598 - DNA, 32 bp, Artificial Sequence
  Primer
aaaggtaccaacagactttacacacagggcac

SEQ ID NO: 9599 - DNA, 31 bp, Artificial Sequence
  Primer
aaactcgaggagagagtcggccctaagaatc

SEQ ID NO: 9600 - DNA, 31 bp, Artificial Sequence
  Primer
tttgaattcttaatgtgtatgggtcctgagc

SEQ ID NO: 9601 - DNA, 34 bp, Artificial Sequence
  Primer
aaaggtaccctaaccatgacaacatctctgcatc

SEQ ID NO: 9602 - DNA, 31 bp, Artificial Sequence
  Primer
aaaaggccttcgcatgcagtttctatcaatc

SEQ ID NO: 9603 - DNA, 31 bp, Artificial Sequence
  Primer
aaagatatccaggctagacagaggactccag

SEQ ID NO: 9604 - DNA, 31 bp, Artificial Sequence
  Primer
aaagaattccaaatgttcctcttaacgggtg

SEQ ID NO: 9605 - DNA, 31 bp, Artificial Sequence
  Primer
aaaggtaccctttgtgcaattacacggctac

SEQ ID NO: 9606 - DNA, 35 bp, Artificial Sequence
  Primer
aaaggtaccctagaatgacaaccactgcagatacc

SEQ ID NO: 9607 - DNA, 31 bp, Artificial Sequence
  Primer
aaaggtacccacccaactgaactgaagaatg

SEQ ID NO: 9608 - DNA, 31 bp, Artificial Sequence
  Primer
aaaaggcctatgaccagtttcagacaacacg

SEQ ID NO: 9609 - DNA, 31 bp, Artificial Sequence
  Primer
aaaggtaccacgcttcaggttcctttacaac

SEQ ID NO: 9610 - DNA, 31 bp, Artificial Sequence
  Primer
aaaggtaccacaggtgcagctggaagtagag

SEQ ID NO: 9611 - DNA, 31 bp, Artificial Sequence
  Primer
tttggatccttattagttggcagcggcagca

SEQ ID NO: 9612 - DNA, 31 bp, Artificial Sequence
  Primer
aaaggtaccacgtatggtacaggcacaactc

SEQ ID NO: 9613 - DNA, 31 bp, Artificial Sequence
  Primer
aaagaattcgcagtaggactgtaggcaggag

SEQ ID NO: 9614 - DNA, 31 bp, Artificial Sequence
  Primer
aaaggatccacagcaaatcgcatagttccag

SEQ ID NO: 9615 - DNA, 30 bp, Artificial Sequence
  Primer
aaagaattctcgtcttcatgtctttgggtg

SEQ ID NO: 9616 - DNA, 30 bp, Artificial Sequence
  Primer
aaagaattcgacaatcaccgtcgtctcttc

SEQ ID NO: 9617 - DNA, 28 bp, Artificial Sequence
  Primer
aaagaattcagcgtgtttggatcccttg

SEQ ID NO: 9618 - DNA, 31 bp, Artificial Sequence
  Primer
aaaggtacctgcaacatcgtttctgacaaag

SEQ ID NO: 9619 - DNA, 31 bp, Artificial Sequence
  Primer
aaaggtacctagtcaagaatgaacccgacac

SEQ ID NO: 9620 - DNA, 31 bp, Artificial Sequence
  Primer
aaaggtacctctgcagtttcatttcacaagc

SEQ ID NO: 9621 - DNA, 31 bp, Artificial Sequence
  Primer
aaaggatccacacatccttcatttgcctttc

SEQ ID NO: 9622 - DNA, 31 bp, Artificial Sequence
  Primer
aaaggtaccgcagaggttgttgtgtgaagac

SEQ ID NO: 9623 - DNA, 31 bp, Artificial Sequence
  Primer
aaaggtaccttaaccacaatacgaccgaacc

SEQ ID NO: 9624 - DNA, 31 bp, Artificial Sequence
  Primer
aaaggtaccgtagcataccacaaacccaagc

SEQ ID NO: 9625 - DNA, 31 bp, Artificial Sequence
  Primer
aaaggtaccaacttgatttggatgagcttgc

SEQ ID NO: 9626 - DNA, 31 bp, Artificial Sequence
  Primer
aaaggtacccatgctctctacgttgtgcatc

SEQ ID NO: 9627 - DNA, 31 bp, Artificial Sequence
  Primer
aaaggtaccgtttcccaaccaagctagacag

SEQ ID NO: 9628 - DNA, 34 bp, Artificial Sequence
  Primer
aaaggtacccccgtttagacttcagtctcttctc

SEQ ID NO: 9629 - DNA, 31 bp, Artificial Sequence
  Primer
aaaggtaccgtaacccacaagccaagaaatg

SEQ ID NO: 9630 - DNA, 32 bp, Artificial Sequence
  Primer
aaaggtacccacggaagtactgaatctgttgg

SEQ ID NO: 9631 - DNA, 33 bp, Artificial Sequence
  Primer
aaaaggcctggaaatgcaacaggcatatttaac

SEQ ID NO: 9632 - DNA, 31 bp, Artificial Sequence
  Primer
aaagagctcttccgagccaatactgaatagc

SEQ ID NO: 9633 - DNA, 31 bp, Artificial Sequence
  Primer
aaaggatcctccggagaggagagatgaatag

SEQ ID NO: 9634 - DNA, 34 bp, Artificial Sequence
  Primer
aaaggatcctcaacatcaataatcctcccataag

SEQ ID NO: 9635 - DNA, 35 bp, Artificial Sequence
  Primer
aaagaattcctatacatggactctttgaagcaacc

SEQ ID NO: 9636 - DNA, 31 bp, Artificial Sequence
  Primer
aaaggtaccttggcgtacagtcatctagtgc

SEQ ID NO: 9637 - DNA, 28 bp, Artificial Sequence
  Primer
aaagaattccagatggatgctctcgcac

SEQ ID NO: 9638 - DNA, 31 bp, Artificial Sequence
  Primer
aaaggtaccgctcagaacatacatcagctcg

SEQ ID NO: 9639 - DNA, 31 bp, Artificial Sequence
  Primer
aaaggtacctaatacaaggccgtagagccag

SEQ ID NO: 9640 - DNA, 31 bp, Artificial Sequence
  Primer
aaagaattcatggaaatgagatctcgcaaac

SEQ ID NO: 9641 - DNA, 31 bp, Artificial Sequence
  Primer
aaaggatccctgacgcacatccattaccttc

SEQ ID NO: 9642 - DNA, 31 bp, Artificial Sequence
  Primer
aaagtcgacgtccacgtctagtaggcagcac

SEQ ID NO: 9643 - DNA, 31 bp, Artificial Sequence
  Primer
aaagtcgacatctccagttccctttcacctc

SEQ ID NO: 9644 - DNA, 29 bp, Artificial Sequence
  Primer
aaaggatcctagtggaactgttgggcgac

SEQ ID NO: 9645 - DNA, 30 bp, Artificial Sequence
  Primer
aaactcgagatccgcctagaacccaaactc

SEQ ID NO: 9646 - DNA, 29 bp, Artificial Sequence
  Primer
aaaggatccatcaagcaccgtccactctc

SEQ ID NO: 9647 - DNA, 31 bp, Artificial Sequence
  Primer
aaaggatccttctgtccatctctaccgttcc

SEQ ID NO: 9648 - DNA, 29 bp, Artificial Sequence
  Primer
aaagtcgaccaccgctctcctatcgtctc

SEQ ID NO: 9649 - DNA, 31 bp, Artificial Sequence
  Primer
aaaggatcctagctagtgccctctgcatctc

SEQ ID NO: 9650 - DNA, 27 bp, Artificial Sequence
  Primer
aaaggatccaagaagccaccagcctcc

SEQ ID NO: 9651 - DNA, 32 bp, Artificial Sequence
  Primer
aaaggatccgcagacttgtcgacttctctctc

SEQ ID NO: 9652 - DNA, 33 bp, Artificial Sequence
  Primer
aaaggatccctctcagacggtcacatagaaagc

SEQ ID NO: 9653 - DNA, 30 bp, Artificial Sequence
  Primer
aaagtcgaccttctccagagcaaaccattg

SEQ ID NO: 9654 - DNA, 31 bp, Artificial Sequence
  Primer
aaaggatcccaacagcaacagctaagctacg

SEQ ID NO: 9655 - DNA, 31 bp, Artificial Sequence
  Primer
aaaggatccaccaccaccaagtacaatcctg

SEQ ID NO: 9656 - DNA, 30 bp, Artificial Sequence
  Primer
aaagtcgacccttccgtctctcttctctgc

SEQ ID NO: 9657 - DNA, 32 bp, Artificial Sequence
  Primer
aaaggatcccattacggtgcctctgtaaactg

SEQ ID NO: 9658 - DNA, 31 bp, Artificial Sequence
  Primer
aaaggatccaccttccgaccatacatacagc

SEQ ID NO: 9659 - DNA, 27 bp, Artificial Sequence
  Primer
aaaggatccctcgccgtctctttcctc

SEQ ID NO: 9660 - DNA, 31 bp, Artificial Sequence
  Primer
aaaggatccatcttgaaggagcgaaatcatc

SEQ ID NO: 9661 - DNA, 31 bp, Artificial Sequence
  Primer
aaaggatcccgtggcacagtcacatactttc

SEQ ID NO: 9662 - DNA, 26 bp, Artificial Sequence
  Primer
aaagtcgaccactccccccaacccga

SEQ ID NO: 9663 - DNA, 29 bp, Artificial Sequence
  Primer
aaaggatccctttctccaagcctgagcac

SEQ ID NO: 9664 - DNA, 29 bp, Artificial Sequence
  Primer
aaaggatccggacccaaacctctgaaagc

SEQ ID NO: 9665 - DNA, 31 bp, Artificial Sequence
  Primer
aaagtcgacattgctctcagaaggcactagc

SEQ ID NO: 9666 - DNA, 31 bp, Artificial Sequence
  Primer
aaagtcgacgtctgactctgagaccgagagc

SEQ ID NO: 9667 - DNA, 31 bp, Artificial Sequence
  Primer
aaagtcgaccacgcgtttagcgtttaagttc

SEQ ID NO: 9668 - DNA, 28 bp, Artificial Sequence
  Primer
aaagtcgacagagccagtacgtgcgaag

SEQ ID NO: 9669 - DNA, 31 bp, Artificial Sequence
  Primer
aaaggatccaccacctctccatccttaatcc

SEQ ID NO: 9670 - DNA, 31 bp, Artificial Sequence
  Primer
aaaggatcccctgtccaccaggctacttaac

SEQ ID NO: 9671 - DNA, 31 bp, Artificial Sequence
  Primer
aaaggatccgtgcggagttcttctctccttc

SEQ ID NO: 9672 - DNA, 29 bp, Artificial Sequence
  Primer
aaagtcgacctcttctttcacggctccac

SEQ ID NO: 9673 - DNA, 31 bp, Artificial Sequence
  Primer
aaaggatcctaatcttatctgatggcgctcg

SEQ ID NO: 9674 - DNA, 31 bp, Artificial Sequence
  Primer
aaaggatcccactcgttgcagcatatctacc

SEQ ID NO: 9675 - DNA, 28 bp, Artificial Sequence
  Primer
aaaggatccctgccctcttcattcgctc

SEQ ID NO: 9676 - DNA, 27 bp, Artificial Sequence
  Primer
aaaggatcccgcctgcccaactttatc

SEQ ID NO: 9677 - DNA, 34 bp, Artificial Sequence
  Primer
aaaggatcctgtcatccacactctagcttctagc

SEQ ID NO: 9678 - DNA, 30 bp, Artificial Sequence
  Primer
aaaggatccatgtaacaggctcgcttctcc

SEQ ID NO: 9679 - DNA, 31 bp, Artificial Sequence
  Primer
aaaggatccgctctcctgagtccctcactac

SEQ ID NO: 9680 - DNA, 32 bp, Artificial Sequence
  Primer
aaaggatccagtcatcacacaagaacctctgc

SEQ ID NO: 9681 - DNA, 33 bp, Artificial Sequence
  Primer
aaagtcgacgccgtctattactggatcttcttg

SEQ ID NO: 9682 - DNA, 30 bp, Artificial Sequence
  Primer
aaagtcgaccaggaaattgaaaacccttcg

SEQ ID NO: 9683 - DNA, 31 bp, Artificial Sequence
  Primer
aaaggatcccctcatcacctagctctccttg

SEQ ID NO: 9684 - DNA, 33 bp, Artificial Sequence
  Primer
aaagtcgacattcataaaccaccacagtcacag

SEQ ID NO: 9685 - DNA, 28 bp, Artificial Sequence
  Primer
aaagtcgacgaagccggaagcaagtgag

SEQ ID NO: 9686 - DNA, 34 bp, Artificial Sequence
  Primer
aaaggatccattatcggtttatcacctatcgagc

SEQ ID NO: 9687 - DNA, 30 bp, Artificial Sequence
  Primer
aaaggatcccgagaaccgagaaggacaatc

SEQ ID NO: 9688 - DNA, 1112 bp, Hordeum vulgare
acgagacggccgcctctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtctagctctgtgtactccatatgtcaccatttgtactctgtatctgatgagccttgtgcgttgttccctgaactatatctgtagtagcaggtagccaggttaaacccgcagtgatatatctgttattgacttgttgagaaggccactgggtaacatggtatcttgctttgggcggatccgcgggtgggcgcttttcttctgtttttgatggtgctgtactcccttatattaattgtaagatgtataagattccacaacagcagtgagaatttaatttttttttggttaagtagcgtgcattattggcggtgtaattgttgggtgctgtgttcatgtactgtaattggaatttattgttggctttggaacacaggcaatcag

SEQ ID NO: 9689 - DNA, 638 bp, Hordeum vulgare
gggggtccgacgacgacgaccacaccgccaaccacacacacaggaactcatttccgtctctcaagctcgcagcgcgcgcaccgagccgccggcgacgacgacgatggcggcgaccacggccgaggcggccctcctggtcctgctgctggtgaccctgggcggcgcggccaaggcgcagccgccgcgcggcacctgcggggcgcagctgagccagctggccccgtgcgcgcggtacagcgtgccgccgatgccggggcaggcgctcccggcgcccgggcccgagtgctgctcggcgctggggtccgtgtcccgcgactgcgcctgcggcgccatcgacatcatcaacagcctccccgccaagtgcggcctcccgcgcgtctcctgccagtgatcgccgcctggctccatgcaacgacaagaggaacaactgaagaaggcgaggatgaataagacgtcgatggtcggagcagacatcgagtagtagtggtagtagtactcagtggctgtccggttcgcctagatcgatctcctgtgatccattagaggctctcgtgtttgttgccatctggtgaaagtcggattgataataacaatggaaccccccaaaaaaaatttttttttgggcccacaaagacccg

SEQ ID NO: 9690 - DNA, 474 bp, Hordeum vulgare
tcggcacgaggcgacagcttaagcttctgagccttccagtgccggaacagagcagcatataagaatggcatccctgaaggccgtgaagccaaccggacttgaagggcaggccaaggagcctaccaaggttagtgccactaaggggcctgcaaagctcagtaacacggcgaccaagccagcagccgccaagggcggcatcaagaaggctgagtcaaagccacgggagcctaagaagagggtcaagagcaccaagccagcagcagcaaaaaactgacaacggcagcaggagaacggagcttgcatagctatctccatggtgctatgaattatatatgaatcctgcctttcccttcctctgtctcccatgatattgatcatgcctacacagggtgtgcgcacaatccatgtgacgaatattacaaataagacgtgtagttctgccatctgcttcatcttattctcccaaaaaaaaaa

SEQ ID NO: 9691 - DNA, 1865 bp, Hordeum vulgare
cggcacgaggctctcacctgctactgctagctagcccctccggctcaacggaagctagcgatcgccatagcctctgcgacttgccaaagctagcacgggcgctagaacaagaagaagaagcagaaccagaggcgcaaaaggctttgcgtgtggcctcaaggaaccccgaaaaggccgagaaggaaacaagataaaaggtaatttgagcagggggcaacgatgggttgcggcttgtcgacgccggacaacgaaggcggcggcacgcggaggaaacaggggagcgtcggcgacgtggtcgtcttcctcccggggctccggacgccgacgggcgtggacctgtcccagccgctcgccgggcgcctggaaaagggcgccgtggagaggctgtcggcgctgagagcgcgcgtcgtcgacatgacaatgcaagaatcggcgtcggccctcaaaccgaggcggaaggccgccgcacggcacggatctagcaccgctaacctcctgcaggcgctggaggactacctcccgcttctgctaggattggtgagagatggtggtgagttgaggaacagcgtggagtttgtgtggactaaccaagaggacaaggcagaggagacggccatggcggatgcgtggtacgaggtgctgtccgtgctgcatttgatggccatggtctgcttgctgcaggccaactcccttctccttccaagggcttacggcgacggttacgggccacgggtctctgaagagagcagacgcgccactgtcgacgttttcttgaaagcgtctggctacttggactgcgcgattcgacaagtgctcccacagataccaacagaactaaggagacaacttccagttgacctggctgaaggcaacctcaaagctcttagcctgcaagctctgggtcagggtgttgacatgcagcttgggctggcaatcgatagcccaaaggccacactagctgtaaaaaggcgcttagcttgtgagatggtcaaatattggcaccaggttcaggagagcattccagatcttcccgtgtctgacggatgggggaaaaaacatctgctatttgtcaagtggaagtacgtcgaagcaaagtctgcagcatactacttccatggcttgatcctcgacgaaggaaacagcgagaaatctcacggaatggcaatagcagcattggaagcttcagaggaatttctgaaagaaagcaaaagggcctctgaagccttccacgcaactcctccaacatctaggagccccactccattcggaacagccaagtatctgtttgacaagatcccgaaagaggcttcaagcaaggtccggatcaaccaggatctgtatactccagaaaggatcattggagcaccacccccattgccggatttctcgttggcactaacacctgaagactacgatcttcctccattagacccactttggaacaaagaagacggccaccagtaagtgtatattcagcattcagcaagagtgccttctgatgggaaggctctggcactactgagaaagcaacgaccaggattctgccatgcggaggccgaacacggcgcaaacgaagtgtacaaagatatgttgcaacaaaaaattggtgtcgacaaattggaagcaaattttagaaaggcctgaagatatctcaagagcatttttacagttaaatcttctctgacaatgggaacgcattgtcaaaagctttccaacaattcctgtaaaaattaaatttgcaatgagcgccatggttcctttttcttaggattttctggccatggcttagttttggggccattctgagcctgttgatgtggtaaatttaccaaacatgatcatgattttcattcaatgcttgagac

SEQ ID NO: 9692 - DNA, 1320 bp, Zea mays
atgcgcctcgcggccgcttcgacagtccctcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccaccgagatgggccgcgaggagggattcctgctccgcgagtggtgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcagataagcaatactggaaggcgatatctgaacttatcccacatgagattgctaacatcgagaagagaggggcaaggaaagacaaggagaagaagcctgggatcgtggtgatccagggaccgaagcctgggaagccaacggacatggcacggatgcggcagatattgctgaagctgaagcacactcccccaccacacatgaagccacctccgccacctgccgcagctaccggaaaggatggagcaccagctgccgccgggaaggatggagctaagccagcaaccgttgccaacggcagtgtccctgagatggaaaaggctgctgcggaggcatcagtgccagcggcagcaccaccagcagcaactgagccgatcgcagctgcttaatctaatcatctgtggtaggaggatgtgaaaaatctcttattggagttgttgcagaggcggtggtggtgagtgaaactgaaaacgtgtgaatttccggcatggtggaggcatgcactgtgtatttgttacctcgattcatttacattactgctactatatattgttattgcattttgtagagaaggggcgggcgtatcctggttcatggtaataataaggttgtattaggaggatgtttggctgtattatgtttcttcttccaagtgtttgtaaatttcccttttgttattaaaactgattgtattgttaaatttttctttgttattaaaactgattgtattgttaagcta

SEQ ID NO: 9693 - DNA, 1527 bp, Oryza sativa
aggaaacccaccaccgaattcgtccgtactcctcctcctgcttcccctccggcgacggcggcgcagatctccggttggaagttagggtgttcatcttgacacaaaatcatgccgaaatcaaactgtaccgaagcgaaaataagatatggattagctctccttccaattgatttatcgttctgtcaatattgatccgaatacgaaaattttaagtgctgttattttgaaggtttcggaaccggaattcggaattgcagtagcagtggatgcctttataaatcaagttcttgtccttggcttcaaatactcgatgtgtttcttggctaatcctaatccctagctgcttgtgtgttgcgtgtgcaatttctgacccttttgtggtggtgtatatcaacagagaaatctctagctttttcagcggcgaagcgaatccatggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttca

SEQ ID NO: 9694 - DNA, 1151 bp, Hordeum vulgare
  misc_feature (39)..(39): n is a, c, g, or t
  misc_feature (1024)..(1024): n is a, c, g, or t
tcggcacgaggctgtttttccggtgttcctcccgcgagnacgagacggccgcctctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtctagctctgtgtactccatatgtcaccatttgtactctgtatctgatgagccttgtgcgttgttccctgaactatatctgtagtagcaggtagccaggttaaacccgcagtgatatatctgttattgacttgttgagaaggccactgggtaacatggtatcttgctttgggcggatccgcgggtgggcgcttttcttctgtttttgatggtgctgtactcccttatattaattgtaagatgtataagattccncaacagcagtgagaatttaatttttttttggttaagtagcgtgcattattggcggtgtaattgttgggtgctgtgttcatgtactgtaattggaatttattgttggctttggaacacaggcaatcag

SEQ ID NO: 9695 - DNA, 719 bp, Hordeum vulgare
ctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtct

SEQ ID NO: 9696 - DNA, 498 bp, Hordeum vulgare
cgtctctcaagctcgcagcgcgcgcaccgagccgccggcgacgacgacgatggcggcgaccacggccgaggcggccctcctggtcctgctgctggtgaccctgggcggcgcggccaaggcgcagccgccgcgcggcacctgcggggcgcagctgagccagctggccccgtgcgcgcggtacagcgtgccgccgatgccggggcaggcgctcccggcgcccgggcccgagtgctgctcggcgctggggtccgtgtcccgcgactgcgcctgcggcgccatcgacatcatcaacagcctccccgccaagtgcggcctcccgcgcgtctcctgccagtgatcgccgcctggctccatgcaacgacaagaggaacaactgaagaaggcgaggatgaataagacgtcgatggtcggagcagacatcgagtagtagtggtagtagtactcagtggctgtccggttcgcctagatcgatctcctgtgatccattagaggctctcg

SEQ ID NO: 9697 - DNA, 404 bp, Hordeum vulgare
gcttaagcttctgagccttccagtgccggaacagagcagcatataagaatggcatccctgaaggccgtgaagccaaccggacttgaagggcaggccaaggagcctaccaaggttagtgccactaaggggcctgcaaagctcagtaacacggcgaccaagccagcagccgccaagggcggcatcaagaaggctgagtcaaagccacgggagcctaagaagaggcaggtcaagagcaccaagccagcagcagcaaaaaactgacaacggcagcaggagaacggagcttgcatagctatctccatggtgctatgaattatatatgaatcctgcctttcccttcctctgtctcccatgatattgatcatgcctacacagggtgtgcgcacaatccatgtgacgaatat

SEQ ID NO: 9698 - DNA, 1517 bp, Hordeum vulgare
aggctctcacctgctactgccagctagcccctccggctcaacggaagctagcgatcgccatagcctctgcgacttgccaaagctagcacccgcgctagaacaagaagaagaagcagaaccagaggcgcaaaaggctttgcgtgtggcctcaaggaaccccgaaaaggccgagaaggaaacaagataaaaggtaatttgagcagggggcaacgatgggttgcggcttgtcgacgccggacaacgaaggcggcggcacgcggaggaaacaggggagcgtcggcgacgtggtcgtcttcctcccggggctccggacgccgacgggcgtggacctgtcccagccgctcgccgggcgcctggaaaagggcgccgtggagaggctgtcggcgctgagagcgcgcgtcgtcgacatgacaatgcaagaatcggcgtcggccctcaaaccgaggcggaaggccgccgcacggcacggatctagcaccgctaacctcctgcaggcgctggaggactacctcccacttctgctaggattggtgaaagatagtggtgagttgaggaacagcgtggagtttgtgtggactaaccaagaggacaaggcagaggagacggccatggcggatgcgtggtacgaggtgctgtccgtgctgcatttgatggccatggtctgcttgctgcaggccaactcccttctccttccaagggcttacggcgacggttacgggccacgggtctctgaagagagcagacgcgccactgtcgacgttttcttgaaagcgtctggctacttggactgcgcgattcgacaagtgctcccacagataccaacagaactaaggagacaacttccagttgacctggctgaaggcaacctcaaagctcttagcctgcaagctctgggtcagggtgttgacatgcagcttgggctggcaatcgatagcccaaaggccacactagctgtaaaaaggcgcttagcttgtgagatggtcaaatattggcaccaggttcaggagagcattccagatcttcccgtgtctgacggatgggggaaaaaacatctgctatttgtcaagtggaagtacgtcgaagcaaagtctgcagcatactacttccatggcttgatcctcgacgaaggaaacagcgagaaatctcacggaatggcaatagcagcattggaagcttcagaggaatttctgaaagaaagcaaaagggcctctgaagccttccacgcaactcctccaacatctaggagccccactccattcggaacagccaagtatctgtttgacaagatcccgaaagaggcttcaagcaaggtccggatcaaccaggatctgtatactccagaaaggatcattggagcaccacccccattgccggatttctcgttggcactaacacctgaagactacgatcttcctccattagacccactttggaacaaagaagacggccaccagtaagtgtatattcagcattcagcaagagtgccttctgatgggaaggctctggcactactgtag

SEQ ID NO: 9699 - DNA, 863 bp, Zea mays
cagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccaccgagatgggccgcgaggagggattcctgctccgcgagtggtgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcagataagcaatactggaaggcgatatctgaacttatcccacatgagattgctaacatcgagaagagaggggcaaggaaagacaaggagaagaagcctgggatcgtggtgatccagggaccgaagcctgggaagccaacggacatggcacggatgcggcagatattgctgaagctgaagcacactcccccaccacacatgaagccacctccgccacctgccgcagctaccggaaaggatggagcaccagctgccgccgggaaggatggagctaagccagcaaccgttgccaacggcagtgtccctgagatggaaaaggctgctgcggaggcatcagtgccagcggcagcaccaccagcagcaactgagccgatcgcagctgcttaataa

SEQ ID NO: 9700 - DNA, 1295 bp, Oryza sativa
agatctccggttggaagttagggtgttcatcttgacacaaaatcatgccgaaatcaaactgtaccgaagcgaaaataagatatggattagctctccttccaattgatttatcgttctgtcaatattgatccgaatacgaaaattttaagtgctgttattttgaaggtttcggaaccggaattcggaattgcagtagcagtggatgcctttataaatcaagttcttgtccttggcttcaaatactcgatgtgtttcttggctaatcctaatccctagctgcttgtgtgttgcgtgtgcaatttctgacccttttgtggtggtgtatatcaacagagaaatctctagctttttcagcggcgaagcgaatccatggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggt

SEQ ID NO: 9701 - protein, 202 aa, Hordeum vulgare
MSAKKGLSSTLRNLKFMQRAAVAQKVEDKADVEVEEVAAEVEVVMTPAANGGGVGSSVQVARKCVVVMEGNPHPGAVKGRMSFQNFNPSIDKLNDEASGRPTQSASPSNSQQDSANTSRVDDVSASRFRSFNVDSSESISLNELKRKEPELEMETPPLRKLPKTTGQNVDGRGSSQSNGRGSGKSNKHEKLDFNLLRKRKSK

SEQ ID NO: 9702 - protein, 95 aa, Hordeum vulgare
MAATTAEAALLVLLLVTLGGAAKAQPPRGTCGAQLSQLAPCARYSVPPMPGQALPAPGPECCSALGSVSRDCACGAIDIINSLPAKCGLPRVSCQ

SEQ ID NO: 9703 - protein, 69 aa, Hordeum vulgare
MASLKAVKPTGLEGQAKEPTKVSATKGPAKLSNTATKPAAAKGGIKKAESKPREPKKRVKSTKPAAAKN

SEQ ID NO: 9704 - protein, 414 aa, Hordeum vulgare
MGCGLSTPDNEGGGTRRKQGSVGDVVVFLPGLRTPTGVDLSQPLAGRLEKGAVERLSALRARVVDMTMQESASALKPRRKAAARHGSSTANLLQALEDYLPLLLGLVRDGGELRNSVEFVWTNQEDKAEETAMADAWYEVLSVLHLMAMVCLLQANSLLLPRAYGDGYGPRVSEESRRATVDVFLKASGYLDCAIRQVLPQIPTELRRQLPVDLAEGNLKALSLQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERIIGAPPPLPDFSLALTPEDYDLPPLDPLWNKEDGHQ

SEQ ID NO: 9705 - protein, 284 aa, Zea mays
MATAFDSPTSSPAAAPFHDDPFLHFDGSAPAAADGFPASPDAYAPSPFGMPHSNGDLHDDPFAAPADSNGGPILPPPTEMGREEGFLLREWCRQNAIHLEEKEKKEKELRSQIIVDAEEFKKAFVEKRKLNAETSKGQNRDREKLFLANQEKFHAGADKQYWKAISELIPHEIANIEKRGARKDKEKKPGIVVIQGPKPGKPTDMARMRQILLKLKHTPPPHMKPPPPPAAATGKDGAPAAAGKDGAKPATVANGSVPEMEKAAAEASVPAAAPPAATEPIAAA

SEQ ID NO: 9706 - protein, 70 aa, Hordeum vulgare
MASLKAVKPTGLEGQAKEPTKVSATKGPAKLSNTATKPAAAKGGIKKAESKPREPKKRQVKSTKPAAAKN

SEQ ID NO: 9707 - protein, 414 aa, Hordeum vulgare
MGCGLSTPDNEGGGTRRKQGSVGDVVVFLPGLRTPTGVDLSQPLAGRLEKGAVERLSALRARVVDMTMQESASALKPRRKAAARHGSSTANLLQALEDYLPLLLGLVKDSGELRNSVEFVWTNQEDKAEETAMADAWYEVLSVLHLMAMVCLLQANSLLLPRAYGDGYGPRVSEESRRATVDVFLKASGYLDCAIRQVLPQIPTELRRQLPVDLAEGNLKALSLQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERIIGAPPPLPDFSLALTPEDYDLPPLDPLWNKEDGHQ

SEQ ID NO: 9708 - protein, 290 aa, Oryza sativa
MAEHLASIFGTEKDRVNCPFYFKIGACRHGDRCSRLHNKPSVSPTLLLSNMYLRPDMITPGIDAQGNPIDPEKIQADFEDFYEDIFEELSKYGEIESLHVCDNFADHMIGNVYVQFREEDQAARALQALTGRYYSGRPIIVEFSPVSDFREATCRQYEENSCNRGGYCNFMHVKEIGRDLRKRLFGHLHRSRRSHSHGRSRSPSPYHYRRDYDRRSSSRSRDHDDYYRGGSHDYYRGGSRRSSERHRSSYDSDGSRRRHRSRTRSPVRDGSEERRAQIEQWNREREAAQV

SEQ ID NO: 9709 - DNA, 1029 bp, Brachypodium distachyon
gactactactcctcccgtcgtgctctgctcctcctccgttccgcgccggccgcctctaaaccctaaccctagggtcagggggttccgagagagagagagggtttggagctacggcggcggcggccatggcggcaaggaaggagctctcgagcactctcaggaacctcaagtttatgcagcgcgcggcggtcgcgcagaagatcgaggacaaaaccgaggtggatgttgaggtggaggcggaggtgctgacgccggcggcgaacggagggtttggctcatcggctcgagtcgccaggaagtgtgtagttgtcatggagggtaatccacacccaggagctgtgaagggtcgaatgtcattccaaaatttcaatccatctattgataaactaaatgaagaggcaagtggacaccaaacgcaatcagcttcacctagtaattctcaagaagacggtgcaaatcccagcagaacagatgatgtatcagcatcaagatttagaggcttcaatgtcgatagttcagaaagcatatctctgaatgaccttaagagaaaagagcccgagcttgagatggaaacaccacgatctcaaaagctgcccaagaccactggccagaatgtcgatggtgaatcgtcttcccaaagcaatggccgtgggtcccgcaagtcgaacaaacacgagaagcttgattggaatcttctcagacgtcggaagtcaaaatgagcttcaagttagcgttagccaagactcgctcctgtactccatcttgtactctgtatctgaccagcttttgtgcgctgtctcctaaattattatctacagtagcaggtagcctggttaatcctgcagtgctatagctgttgttaacttcatgagaagcgtagtgccgcatagcatattttagttggggagattctatgttggacaatttctctctcggttttgatgttggtttacacctttactttgctgtaagatgtaagactctgtaacacagccgtgtgtattacagttttgggaatgtgtttctggt

SEQ ID NO: 9710 - DNA, 963 bp, Triticum aestivum
  misc_feature (363)..(364): n is a, c, g, or t
  misc_feature (513)..(513): n is a, c, g, or t
  misc_feature (676)..(676): n is a, c, g, or t
  misc_feature (699)..(699): n is a, c, g, or t
  misc_feature (720)..(720): n is a, c, g, or t
  misc_feature (753)..(753): n is a, c, g, or t
  misc_feature (786)..(786): n is a, c, g, or t
  misc_feature (810)..(810): n is a, c, g, or t
  misc_feature (855)..(855): n is a, c, g, or t
  misc_feature (873)..(873): n is a, c, g, or t
  misc_feature (876)..(876): n is a, c, g, or t
aaaccctaaccctagattggattacggggggctgggagagggagagggtcggagcggcggcggcggcgagatgtcggcgaagaaggggctctcgagcacgctgcggaacctcaagtttatgcagcgggcggcggtggcgcagaagattgaggacaaggccgatgtggaggtggaggagccggcggccgaggtggtgatgacgccggcggccaacggtggaggggtcggctcgtcggtccaggtcgccaggaagtgtgtagttgtcatggagggtaatccgcttccaggagctgtaaagggtcgaatgtcattccaaaatttcaatccatccattgataaactaaatgacgaggcaagtggtcnnccaacacaatcagcttcacctagtaattctcaacaagacagtgcaaataccagcagagtggatgatatatcagcatcaagatttagaagcttcaatgttgatagttcagaaagcatatctctgaatgagttgaagagaaaagagcctgngctggagatggaaacaccaccatcgcgtaagctgccaaagacgactggccagaacgtggatggccagccgtcttcgcagagcaatggtcgtgggtctggcaagtcgaacaagcatgaaaagcttgactttaatcttctcagaaaacggaaatcaaaatgaggnccaggttagcattagccaagacnagctctgtgtactccatatgncaccatttgtactctgtatctgatcagccttgngcgttgttcactgaattatttctgtagtagcangtagccaggttaaacctgcagtgntatatctgttattaacttgagaagcctactgggtaacatggtatnttacattgggcgcttttnttntgtttttgatggtgctgtactccattatcacttgtaagatgtaagattttacagcagctgtgagaatttaaagttttggggtaaaac

SEQ ID NO: 9711 - DNA, 1072 bp, Triticum aestivum
  misc_feature (18)..(18): n is a, c, g, or t
ttcggcacgaggctgttntccggtgttcctcccgcgagacgagacggccgcctctaaaccctaaccctagattggattatcggggctgcgagagggagagggtcggagcggcggcggcggcgagatgtcggcgaagaaggggctctcgagcacgctgcggaacctcaagtttatgcagcgggcggcggtggcgcagaagattgaggacaaggccgatgtggaggtggaggaggcggcggccgaggtggtgatgacgccggcggccaacggagggggtgtcggctcgtcggtccaggtcgccaggaagtgtgtagttgtcatggagggtaatccgcttccaggagctgtaaagggtcgaatgtcattccaaaatttcaatccatccattgataaactaaatgacgaggcaagtggtcgcccaacacaatcagcttcacctagtaattctcaacaagacagtgcaaataccagcagagtggatgatatatcagcatcaagatttagaagcttcaatgttgatagttcagaaagcatatctctgaacgagttgaagagaaaagagcctgagctggagatggaaacaccaccatcgcgcaagctcccaaagacggccggccagagcgtggacggccagccgtcttcgcagagcaatggtcgtgggtctggcaagtcgaacaagcatgaaaagcttgacttcaatcttctcagaaaacggaaatcaaaatgaggtccgggttagcatcagccaaggctagctccgtgtactcttgtgtcgccatttctaccctgtacctgatcagcctttgtgcgttgttccctgaattatttatgccgtagcaggtagccaggtaaaaccggcagtggtatatctgttgttaacttagttggaaggtttactactgctttacatatcttattagttggggaggttctgtgttcttcaacacttttctctcttgtttcactgcattgctattacttcctgtaagatgtagtaagattctgcaacaccagcgagaatttcaaagtcataggaatgctttttgatcaggcgtgctcattaaaaaaaaaa

SEQ ID NO: 9712 - DNA, 620 bp, Secale cereale
gtaaaccacacacacacacagacacgaacgcattttcattgctgaagctagcagcgcgcgcaccgagccgccggcgacgacgacgatggcggcgaccgaggcccagctgctgcagccgcgcgccctggcggccctcctcgtcgtgctggtgctgatcacgctgggcggcgcggccgaggcgcagcagggcacctgcggcgcgcagctgagccagctggccccgtgcgcgcggtacagcgtgccgccgctgcctgggcaggcgctcccgacgcccgggccggagtgctgctccgcgctggggtccgtgtcccgcgactgcgcctgcggcgccatcgacatcatcaacagcctccccgccaagtgcggcctcccgcgcgtctcctgccagtgatcgctacctggctccatgcaagaagaggaagaactgaagaagacgatgatgaataagagctcgctcgatggtcggagcaaccatcttgagtagtcgtagtgcatagtagctgtccggttcgtctggactctagatcgaaatcctgtgatcattagaggctcttatgtctgttctctggtgaacgtcaccagattaataataatggaaccaatttgcactttaaaaaaaa

SEQ ID NO: 9713 - DNA, 516 bp, Triticum aestivum
agctagcagcgcgcgcaccgagccggcgactacgacgacgatggcggtgaccacggcccagctgccgcagccgcgcgccctggcggccctcctcgtcctggtgctgctcatcacgctgggcggcgcggcggaggcgcagccgccgctcggcacctgcggcgcgcagctgagccagctggccccgtgcgcgcggtacagcgtgccgccgctgccggggcaggcgctcccgacgcccgggccggagtgctgctccgcgctgggctccgtgtcccgcgactgcgcctgcggcgccatcgacatcatcaacagcctccccgccaagtgcggcctcccgcgcgtctcctgccagtgatcgctcgctgcctggctccatgcaagaagaggaggaactgaagaagacgacgatgaataagagatcgatggtcggagcaaccatcttgagtagtagtagcagtgcctagtagctgtcctgtccgtctagatcgatcccctgtgatcattacaggctctcgtgtc

SEQ ID NO: 9714 - DNA, 637 bp, Triticum aestivum
  misc_feature (14)..(14): n is a, c, g, or t
ccacgcgtccgcgncgcaaatcacacacacacacgaacgcattttcattcatttctcaagccagcagcagcgcgcgcaccgagccggcgacgacgatgatggcggtgaccacggcccagctgccgcaaccgcgcgccctggcggccctcctcgtcctggtgctgatcacgctgggcggcgcggccgaggcacagccgccgctcggcacctgcggcgcgcagctgagccagctggccccgtgcgcgcgctacagcgtgccgccgctgccggggcaggcgctcccggcgcccgggccggagtgctgctccgcgctggggtccgtgtcccgcgactgcgcctgcggcgccatcgacatcatcaacagcctccccgccaagtgcggcctcccgcgcgtctcctgccagtgatcgctcgctacctggctccatgcaagaagaggaagaactgaagaagacgatgatgaataagaagctcgatggccagagcaaccatctttagtagtagtagcagtgcctagtagctgtccggttcgtctagatctatctcccgtgatcattacaggctctcgtgtccgttgttggcctctgttgaaggtcagattaataataatggaaccaatttgcaccggcggtcaaaa

SEQ ID NO: 9715 - DNA, 940 bp, Brachypodium distachyon
tatcgaaagtggagataattggctatgtcaaagtttgttaaaacataggccatatgaggcggcccacaatggatacacacatacttaaatagtccgggctatgcactttttacttgtgtatgcatcacggattcatccttcaaagaatagatcatttcatcatctggactatgaaacaagactgactctcacacatgcgatctccagtgcgtaagattttatacctttcgaaccttcttattgccaccattgtgcgccactaactcatggaataatggacctcaaacatttcgaatagcaaagttcacgtccggtaacaggctatattgcaggcatccaattctgtaccaagctgcaccgtgccatcaatcacttgccacaataattcaggacacctttattcttgctaatctcggctttgtcttctgcacacttcagagatccgagaagagccctataaatacctcgcgccatctgtttccagttcatcaagtacacagcagcttaagcttccgagctttcccgagtgccggaacagagtagcattataagaatggcatccgtgaaggccgtgaagcccaccgggccagcagctcaggccaaggagcctgccaagcttagtgccaccaaggagcctgcaaagctcagtgccaccgcgaaaaagccagcagccgccaagggcggcatcaagaaggctgagtcgaaacctcgggagcctaagaagagggtgaagagcagcaagccggcagcagtcaaaaactgacaacggcagcaagagaaatggaacttgcatagtgatttccatgatgctatgaatatatatgaatcccatctttcccttcctctgtctcctatgatgtcattatcctgcctagacaggccttgatggtgtgcttaaccccatgtgatgatattacaaataagatgtatagttgtacca

SEQ ID NO: 9716 - DNA, 1831 bp, Triticum aestivum
aagcagaattattagaggcgcaaaggcttgcgtgcggtctcaaggaaccccgaaaaggccgagaagaaaagaagataaaaggtagttgagtagtcttgcacgcgtccatgggttgcggcttgtcgacgccggacaacgacggcgggggcggcggcgcgcggaggaaacaggggagcgtcggcgacgtcgtcgtcttcctcccggggctccgggcgcccatgggcgtggacttgtcccaggcgctcgcggggcgcctggacaagagcgccgtggagaggctgtcggccctgagagcgcgcgtcgtcgacatggcaatgcaagaatcggcggtggccctgaagcccaggcggaaggccgccgcacggcacggatcaagcactgctaacctccttcaggctctcgaagactacctgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctccttccaagggcttacggcgatggttacgggccacgggtctctgaagagagcagacgtgccactgtcgacgttttcttgaaagcatctggctacttggactgcgcaattcgacaagtgctcccacagataccatcagaactaaggagacaacttccagtagacctggctgaaggcaacctcaaagctcttagcatgcaagctctgggtcagggtgttgacatgcagcttgggctagcaatcgatagcccaaaggccacactagctgtaaaaaggcgcttagcttgtgagatggtcaaatattggcaccaggttcaggagagcattccagatcttcctgtgtccgacggatgggggaaaaaacatctactatttgtcaaatggaagtacgtcgaagcgaagtctgcagcatactacttccatggtttgattcttgacgaaggaaacagtgagaaatctcacggaatggcaatagcagcattggaagcttcggaggaatttctgaaagaaagcaaaagggcctctgaagttttccatgcaactcctccaacatctaggagccccactccatttggaacagctaagtatctgtttgacaagatcccgaaagaggcttcaagcaaggtccggatcaaccaggacctatataccccagaaagggtcattggagcaccacccccgttgccggatttctcgttggcactaacacctgaagactatgatcttcctccattagacccactttggaacaaagaagacggccaccagtaagtgtacattcagcattcagcaagagtgtcttctgatgggaaggctctggcgctactgagaaagcaacgaccaggattctgccatgcggaggccggacacgacgcaaaggaagtgtacaaagatatgttccgacaaaaaaaatttgatgtcggcaaactggaagcaaattttagaaaggcctgaagatatctgaagagcatttttacagttaaatcttctctgacaatggaaacacattgtcaaaagcttgctttccaacaattcctgtaaaaattatatttccaatgagcgccatggttcctttttcttaggattttctgaacatggcttagttttggggccattctgagcctattaatgtggtaaatttgccaaacatgatcctgatcttcattcaatgcttgagacagaagcagcaacgatgaaatttaaactactcaacacatacagaagctctgaactgtgtaagtttg

SEQ ID NO: 9717 - DNA, 1770 bp, Triticum aestivum
aagcagaattatcagaggcgcaaaggcttgcgtgcggtctgaaggaaccccgaaaaggccgagaagaaaacaagataaaaggtggtagagtggacttgtcgacgcgtccatgggttgcggcttgtcgacgccggacagcgatggcggcggcggcggcgcgcggaggaaacagggcaacgtcggcgacgtcgtcgtcttcctcccggggctccgggcgcccatgggcgtggacttgtcccaggcgctcgcggggcgcctggacaagggcgccgtggagaggctgtcggccctgagagcgcgcgtcgtcgacatggcaatgcaagaatcggcggtggcgctcaagcccaggcggaaggccgccgcacggcacggatctagcactgctaacctcctgcaggcgctggaggactacttgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctcctgccaagggcttacggcgatggttacgggccacgggtctctgaagagagcagacgtgccaccgtcgacgttttcttgaaagcatctggctacttggactgcgcgattcgacaagtgctcccacagataccatcagaactaaggagacaacttccagtagacctggctgaaggaaatctcaaagctcttagcctgcaagctctgggtcagggtgttgacatgcagcttgggctggcaatcgatagcccaaaggccacacaagctgtaaaaaggcgcttagcttgtgagatggtcaaatattggcatcaggttcaggagagcattccagatcttcctgtgtctgacggatggggaaaaaagcatctactatttgtcaagtggaagtatgtcgaagcaaagtctgcagcatactacttccatggtttgattcttgacgaaggaaacagcgagaaatctcatggaatggcaatagcagcattggaagcttcggaggaatttctgaaagaaagcaaaagggcctctgaagccttccatgcaactcctccaacatctaggagccccactccatttggaacagccaagtatctgtttgacaagatcccgaaagaggcttcaagcaaggtccggatcaaccaggacctgtatactccagaaagggtcattggagcaccacccccgttgccggatttctcattggcactaacacctgaagactatgatcttcctccattagacccactttggaacaaagaagatggtcaccagtagtgtatattcagccttcagcaagagtgtcttctgatgggaaggctctggcactactgagaaagcaacgaccaggattctgccatgcggaggccgaacacggtgcaaaggaagtgtacaaagatatgttccgaccgaaaatttgacgtcggcaaattggaagcaaattttacaaaggcctgaagatatctgaagagcatttttacagttaaatcttctctgacaatggaaacacattgtcaaaagctttccaacaattcctgtaaaaattatatttccaatgagcgtcatggttcctttttcttaggattttctgaccatggcttagttttgtggccattctgagcctattaatgtggtaaatttaccaaacatgatcctgattttcattcaatgcttgagacagaagcagc

SEQ ID NO: 9718 - DNA, 1781 bp, Triticum aestivum
agcagcagcagaagcagaattattagaggcgcaaaggcttgcgtgcggtctcaaggaaccccgaaaaggccgagaagaaaacaagataaaaggtggtagagtggacttgtcgacgcgtccatgggttgcggcttgtcgacgccggacagcgatggcggcggcggcggcgcgcggaggaaacaggggagcgtcggcgacgtcgtcgtcttcctcccggggctccgggcgcccatgggcgtggacttgtcccaggcgctcgcggggcgcctggacaagagcgccgtggagaggctgtcggccctgagagcgcgcgtcgtcgacatggcaatgcaagaatcggcggtggcgctcaagcccaggcggaaggccgccgcacggcacggatcaagcactgctaacctccttcaggctctcgaagactacttgccacttctgctaggattggtgaaagaaggtagtgagttgaggcacagcgtgcagtttgtgtggactaaccaagaggacaaggccgaggagacggccatggcggatgcatggtacgaggtgctgtccgtgctgcatttgatggccatggtctgcttgctgcaggccaactccctgctcctgccaagggcttacggcgatggttacgggccacgggtctctgaagagagcagacgtgccactgtcgacgttttcttgaaagcatctggctacttggactgcgcaattcgacaagtgctcccacagataccatcagaactaaggagacaacttccagtagacctggctgaaggaaatctcaaagctcttagcctgcaagctctgggtcagggtgttgacatgcagcttgggctggcaatcgatagcccaaaggccacacaagctgtaaaaaggcgcttagcttgtgagatggtcaaatattggcaccaggttcaggagagcattccagatcttcctgtgtctgacggatggggaaaaaagcatctactatttgtcaagtggaagtatgtcgaagcaaagtctgcagcatactacttccatggtttgattcttgacgaaggaaacagcgagaaatctcatggaatggcaatagcagcattggaagcttcggaggaatttctgaaagaaagcaaaagggcctctgaagccttccatgcaactcctccaacatctaggagccccactccatttggaacagccaagtatctgtttgacaagatcccgaaagaggcttcaagcaaggtccggatcaaccaggacctgtatactccagaaagggtcattggagcaccacccccgttgccggatttctcattggcactaacacctgaagactatgatcttcctccattagacccactttggaacaaagaagatggtcaccagtagtgtatattcagccttcagcaagagtgtcttctgatgggaaggctctggcactactgagaaagcaacgaccaggattctgccatgcggaggccgaacacggtgcaaaggaagtgtacaaagatatgttccgaccgaaaatttgacgtcggcaaattggaagcaaattttacaaaggcctgaagatatctgaagagcatttttacagttaaatcttctctgacaatggaaacacattgtcaaaagctttccaacaattcctgtaaaaattatatttccaatgagcgtcatggttcctttttcttaggattttctgaccatggcttagttttgtggccattctgagcctattaatgtggtaaatttaccaaacatgatcctgattttcattcaatgcttgagacagaagcagc

SEQ ID NO: 9719 - DNA, 1781 bp, Brachypodium distachyon
gtccgacgtttcagacttccagtcaagattagagagaaagaagcagagctagaggtggggtgagtcttgcttgtggtctgaagaaatccaaaaggttggataaaagaaaggaagaataaaggtgagcagcccgcggcgcatccatgggttgcgggtcgtcgaggcaggtcgatggcgacggtccgcggagaaagccggggagcgtcggcgacgtggtcgtgttccttccggggctccgggcgccgaggagcgtagacttctcccaggcgctcgcggggcgcctggataagagcgcggtggagagattgtcggctctgagagcgcgggtcgtcgaactggcaatgcaagaatcggcggccgccctgaagccgaagcggaagaccgcggcgcggcacggatctaccactgctaatctcctgcaggctctggaagactacttaccggttctgctagggttggtgaaggaaggtagtgagttgaggcacatagtgcagtttgtctgggctaaccaagaggacaatgctgaggaaacggctatggaagatgcatggtacgaggtgctgtctgtactgcagttgatggccatggtctgcctgttgcaggccaattcgctgcttcttccaagggcatatggtgatggttatgggccaagggtttctgaagagagcagacgggccactgtagacgttttcttgaaggcagctggctacttagactgtgcaattcgacaagtactcccacatatgccatcagaactaaggaggcaacttccagtagacctcgctgaaggaaacctcaaagcacttagcttgcaggctctgggtcagggggttgacatgcagcttggcctggcaattgatagcccaaaggccactctagcagtaaaaaggcgcttagcttgtgagatggtcaaatattggcaccaagttcaggagagcattcccgagcttcctgtttctgacggatgggggaaaaagcatctcctgtttgtcaagtggaagtatgtcgaagcaaaggctgcagcatactatttccatggtttgatccttgatgaaggaaacagtgaaaaatttcacggaatggcgatagcagccttgcaagcttcagaggaatttctcaaagaaagcaaaagggcttctgaagccttccatgcaactcctccagcgtcaaggagccccactccattcggaacagctaagtatatgtttgacaagatccctaaagatgcttcaagcaaggtccggatcaaccaggacctgtatactcaagaaagggtcattggagccccacctccattgccggatttctcactggccttaacacctgaagactatgatcttcctccgttagactcagtttggaataaagacaaccatcaataaacgaaggagtgccttttgacgaaacagtctggctctagtgagaaagcaagaaccaggatgctgccatgtcgaagctgaacatggtgaaaatgaactgtacaaaatatgttccgaccaaaaattgatgtctacaaatgcaagcaaagtttagaaaggcctgaagataaaatgaagagcattttacaattcaatattcttctgacaatggaagtacattgtcaaaaggtttccatcttgtaaaaagtatttccagtgagagccatggatcctttttcttaggattttctgacaatggctagttttgggtctatcataaacatattcatgtggtaaaattaccaaatttggtcatgcttcaaggactattgagtataaatggcagagacaaacgtgggaatg

SEQ ID NO: 9720 - DNA, 2741 bp, Oryza sativa
gagatcgctagctagtttgtctccgtcgaagaagtaggcgtcgtcgagggctcgagagatcttttttcctccgatggcctccgtgcagctgaccagctgtgctgtgtggtgtactggtgtgtgggcttaataattgtggggtagatttgcatttgcatcagcacgatcacaaagcttctcccctttaaataggacaagtcatacacaggagtagcctagtaaacatctctctctgcctctctctccatctgactgctcgaccagcagcaataggctctggtttcctcttcttgcaagttgcatgctccctagtccctagacttgaacagttgagcccttcctgattttgtggttctagaccacctctggcttgcagcgagaagcaacgttcgctcgcatgacgttccagctccaagattagttggaggaactgttctaaacacagaataatactacctctttcgatgcgaaaagtatgccaatttggccgtacattacgccaagttgtgctcttgctctgatgttgatcggtcccctacgaaccaagggataagagttttgcttccttttgtccctccactgtgtttgcgttcggtgtggtgctgcgcgccagcctgcagaagaagaagaagaagaagaagaagagaagatagtggtggtgggttcaatcagagcggttcttggtgtctgaagaaacgcacaaagccgaagtggaaggaagaataaagggtgaggtgagctaagtcgtaggctgtctgccgcgcgcgtaccatgggttgtgggctgtcgagggagaaggacgccggcggcggcccacggcggcggccggggagcgtcggcgacgtggtcgtgttcctcccggggctccgggtgccgaggagcgtggacttctcccaggcgctcgccggtcgcctcgacgaggcctcgtcgaggctgtcgtcgctgcgggcgcgggtcgtcgacatggcaatgcaagaatcggcggcggcgctgaagccgaagcggcgggcggcggcgcggcacggttcgagcactgctaatctcctacaggctctggaagactatctgccagtgctgctaggattggtgaaggaaggtagcgaattgcggcacggagtgcacttcgtctggactaaccaagaggataatgctgaggaaacggccatggcagatgcatggtatgaagtgttgtccgttctgcatttgatggccatggtctgcttgttgcaggccaattctctgcttcttcccaggtcatacggtgatggttatgcgccaagggtttctgaagagagcagacgagctactgttgatgttttcttgaaggcatctggctacctagactgcgcaattagacaagtactaccccaaatatcgtcggagttaaggagacaacttccagtagatctggctgaaggaaatctcaaagctcttagcctgcaagctctgggtcagggagtcgacatgcaacttggtctggcaattgatagcccaaaggccactctagcggtaaaacggcgcttagcttgcgagatggtcaaatattggcatcaaattcaggagagcattccagaaattccggtatccgatggatgggggaaaaagcatttattgtttgttaagtggaagtatgttgaagcaaaggctgcagcatactatttccatggtttgattctagacgagggaaacacagagaaatctcatggaatggcagtagctgccttgcaagcttcagaagaatttctgaaagaaagcaaaagggcttctgaagccttccatgcaactcctccaacatcaaggagccccactcctttcggaacagctaagtacatgcttgacaagattccaaaagatgcttcaagcaaggtcaagatcaatcaggacctgtatacgcaagagagggtcattggaacaccgcctccattgccggattttgcgttggctctaaaacctgacgactacgatcttcctccattagatccactttggaacaaagaagacagccgtcagtagcagtatattcagcaagaatgtgaatgttgtctttcagaggttcaggctctagtataccatgtcgaagccagacgtggtacgaatgaagtgtacaaaatttgtcccaacaaattgtggtgtcagcaaaatttaaacaaggcctggagataatctcaagagcattgtacaggcgaatcttattctgacaaaggaaatgctttgccaaaaaaaaaagaagaaaaaaactaaccatttcaaaagattccaatatgactcgtggatccattttctcaggattcccttcagaatggcttggttttgatctatactgagtactgtgaaaactgtcacattttgatcctgctgcagcgactatatcatctagacagtttccagtgttctgagatacaactacacaagcgaacaaaacgaaacttgacacgctcgtttcaaaagcctttgtctgatgttctacaatcggtccaaaaggcaagtatgcgtgccaaataacacaaagaaaaccacgcgaaatggcgcatatatagtttgcctactgccgtgagcacatatatggctacaatttacagactccaaattataaagaaacatcattattgtattatgttatttacatgttactcttaatcatacacgattgctgtttacatcaattctattctttaccactaggtttgtttctgttcaataatattgctatcaggtattcaggcaggaacatattcctttcc

SEQ ID NO: 9721 - DNA, 1651 bp, Pennisetum glaucum
gagggagagacgagagggatttgatggtgtagtactgtgctgggtggtggcttgtggccggacgaatcccggaaaggccgccggaaagggggaggggaggacaaaggtaaaacaggccccgctgtgaagagccatggggtgcggggcgtccagccagaaggacgccgccggcgggccacggagacggccggggagcgtcggcgacgtggtcgtgttcctcccgggcctccgggtgccgaggagcgtcgacctcgcccaggcgctcggcgggggcctggacgggagcatcgtggagcggctgtcggcgctgagagcgcgcgtcgtcgagatggcaatgcaagagtcggcggcggcgctgaagccgaagcggaagacggcggcacggcacgggtctagtacagccaatctcctacaggctcttgaagactacttgccagttctgctaggattggtaaaagaaggcagtacgttgaggcatgccgtgcaattcacttggactaaccaagaggataaagctgaggagacggccatggcagatgcctggtacgaggtgctgtccgtgctgcatttgatggccatggtctgcttgctgcaggccaacaccctgcttctccccaggtcctacggcgatggctatgcaccaagagtttctgaagagagcagaagggccactgttgatgttttcttgaaggcagctggatacttagactgtgcaattcgacatgtacttccacaaattccaccggaattaaggaggcaacttccagtagacctcgttgaaggaaatctcaaagctttaagcctgcaagctctgggtcagggggttgacatgcagcttggtttggctatcgatagtccaaaggctactttagcagtaaaacggcggttagcttgtgaaatggtcaagtattggcaacaagttcaggaaagtattccagagcttcctggttctgatggatgggggaaaaagcaccgtctgtttatcaagtggaaatatgttgaagcaaaggctgcagcatactactttcatggtttgattcttgatgagggaaatacagagaaatcccacggaatggcaatagccgcacttcaagcttcagaagaatttctgaaagaaagcaaaagggtttcggaagccttccatgcatctcctccaacatcgaggagccctactccattcggaacagcaaaatatatgtttgacaagatcccaaaagatgcttcaagcaaggtccgaatcaaccaggacctgtatacccaagaaaaggtcataggaactccacctcccttaccagattttgcattggcgctaacacctgaagactatgatcttccttcattagatccactttggaacaaagaagacagacgtcattaggtgtatatgcaacagaatggtttcttcagaagaacacttggcgttagagaaacgagaagcacaaagatctgccatgccaaagctgagcatggtaacaaatgaagtgtacaaagtatgtttgaacaaaatctcgtggtaaaaaaatccatccagttgttaggaaggcctgaagataatctgaagagcattgtacaggcgatttttcttctgacaaaggaaatgctttgtcaaggggttcatttaacaatctcgatcctgattcctgattttccc

SEQ ID NO: 9722 - DNA, 1948 bp, Zea mays
tttctctctcgaaatccgttgtatgatatgatgacgaggaaaccccaaaaaatagaagaaagaattccaaaaccctccctctcctgttcagtatcttctgcggctccgccgtggattcttcgtgcgataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacttggcccaggcgctcggcggctgcctggccaggagcgccgtggaccggctgtcggctctgcgatcgcgggtcgtcgacatggcaatgcgagagtcggcggcggcgctcaagcccaggcggagggcggcggcacggcacgggtctagtacagccaatcttctacaggccctcgaagactacttgccggctctgctaggactggtaaaagaaggtagcgtcttgaggaacaaagtgcacttcacctggagtaaccaggaggataatgctgaggagacggccatgccagacgcctggtacgaggtgctgtccatgctgcatctgatggccatggtctgcctgctgcaggccaacgccctgcttctcccgaggtcatacggcgatggctatgccccaagggtttctgaagagagtcgacgggctactgttgatgtcttcttgaaggcagctggatacctagactgtgcagttcggcatgtactcccgaagatgccactggagctaaggagacaacttccagtagacctggctgaaggaaatctcaaagctctaagcctccaagccctgggtcagggggttgacatgcagcttggtttggctattgatagtccaaaggccactttagcagtaaaacggcgcttagcctgtgagatggtcaaatattggcaacaagttcaagagagcattccagagcttcctatctctgatggatggggtaaaaagcaccggctctttataaagtggaaatatgttgaagctaaggctgcagcatactatttccacggtttgattcttgacgagggaaataccgaaaaatcccatggaatggcaatagctgcactccaagcttcagaggaatttctaaaagaaagcaaaagggtttcagaagccttccatgcaactcctccaacatcgaggagtcccaatccattcggaacagcaaaatatctgtttgacaagatcccaagagatgcttccagcaaggttcgaatcaaccaggacctgtatactcaagaaaaggtcattggagcgccacccccattaccagattttgcattggcgctaacacctgaagaatatgatcttcctccactagatccactttggaacaaagaagacacaagccattaagtgtatatgcagcagaatggttgcttctggcaaaaatattggctctggagagaaaggaaggaccaagatctgccatgtcaagagctgatgtgtaatgaatgaagtgtacaaagtattttcaaacaaaaatacatgttcacaaatttacgcaaggcctgaagacaatctgaagagctttgtacaggcgattcttcttctgacaagggaaatgctatgtcaaagggttccttgatcattgtgcatcttgatgcttgcattttgtcaaaaacagattttcagcaatttatgtagaactgtaaactagcctctgatcgaaagtggcagccttcaaatttttttttgccataaaacatttacatcggcaccttaaaacatgccgtgggacaatcagtttcatctgagcacttaggtgaacaggattttcaaataatcagtggatactgtggcaaagtcagcttccagccattcagtgcatgcatatacagtcataaaattttagttttgaacttctgaatgcaaaaaaaaatctccatatgatttctcttgatcaact

SEQ ID NO: 9723 - DNA, 2106 bp, Zea mays
gtagccgcctctcctcctccttctccttcttccccctctcaaggctcccctcctccacagcctgcagcccagctcacgaggaccaggaggagaagaagttgcatagccgcccatctgcatccacactccaacagttgagtccctctctccctaccacccccccccccccccccagttgccttatctcctcacgtcctagctacaaccatacctgcgtgcgccggcagcgagaaaggaccagctaccggccgtgacgttcttctcaccgtacgtcgccgagggattagataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacttggcccaggcgctcggcggctgcctggccaggagcgccgtggaccggctgtcggctctgcgatcgcgggtcgtcgacatggcaatgcgagagtcggcggcggcgctcaagcccaggcggagggcggcggcacggcacgggtctagtacagccaatcttctacaggccctcgaagactacttgccggctctgctaggactggtaaaagaaggtagcgtcttgaggaacaaagtgcacttcacctggagtaaccaggaggataatgctgaggagacggccatgccagacgcctggtacgaggtgctgtccatgctgcatctgatggccatggtctgcctgctgcaggccaacgccctgcttctcccgaggtcatacggcgatggctatgccccaagggtttctgaagagagtcgacgggctactgttgatgtcttcttgaaggcagctggatacctagactgtgcagttcggcatgtactcccgaagatgccactggagctaaggagacaacttccagtagacctggctgaaggaaatctcaaagctctaagcctccaagccctgggtcagggggttgacatgcagcttggtttggctattgatagtccaaaggccactttagcagtaaaacggcgcttagcctgtgagatggtcaaatattggcaacaagttcaagagagcattccagagcttcctatctctgatggatggggtaaaaagcaccggctctttataaagtggaaatatgttgaagctaaggctgcagcatactatttccacggtttgattcttgacgagggaaataccgaaaaatcccatggaatggcaatagctgcactccaagcttcagaggaatttctaaaagaaagcaaaagggtttcagaagccttccatgcaactcctccaacatcgaggagtcccaatccattcggaacagcaaaatatctgtttgacaagatcccaagagatgcttccagcaaggttcgaatcaaccaggacctgtatactcaagaaaaggtcattggagcgccacccccattaccagattttgcattggcgctaacacctgaagaatatgatcttcctccactagatccactttggaacaaagaagacacaagccattaagtgtatatgcagcagaatggttgcttctggcaaaaatattggctctggagagaaaggaaggaccaagatctgccatgtcaagagctgatgtgtaatgaatgaagtgtacaaagtattttcaaacaaaaatacatgttcacaaatttacgcaaggcctgaagacaatctgaagagctttgtacaggcgattcttcttctgacaagggaaatgctatgtcaaagggttccttgatcattgtgcatcttgatgcttgcattttgtcaaaaacagattttcagcaatttatgtagaactgtaaactagcctctgatcgaaagtggcagccttcaaatttttttttgccataaaacatttacatcggcaccttaaaacatgccgtgggacaatcagtttcatctgagcacttaggtgaacaggattttcaaataatcagtggatactgtggcaaagtcagcttccagccattcagtacatgcatatacagtcataaaattttagtttgaacttctgaatgcaaaaaaaatctccatatgatttctctgatcaact

SEQ ID NO: 9724 - DNA, 2026 bp, Zea mays
aaccctgtaggcctctcccttcttctgctctccctcccttctcaaggcttcctcctgcagtccagctcaccaggaccaggaggaacaaagaagttgcatcgaacacagctgagttcctccctcttccctgaaatgcgcccggcagctagaaaggagcagctagcgggcgggctgcccatacgtcgttgagcaccgcggagacggccgggagcagggggggcgggagggatagtggcggcctctgctgctgctggtcgaggcttcgattccgggcgggggctggtggtctcgagaatcccggagggaagggagcgagcgcaaagatagatacctaagcgggccgcttccgctgcacagccacaggcatggggtgcggggcgtcgagccacaaggacgccggggcgcgccggagacggcctgggagcgtcggcgacgtggtcgttttcctcccgggcctccgggtgccgagggccgtcgacttcgcccaggcgctcggcggctgcctggccagggctatagtcgagcggctgtcggctctgaggtcgcgggtcgtcgagatggcaatgcaagaatcggcggcggcgctcaagcccaggcggaaggcggctgcacggcacgggtctagtacagccaatcttctacaggccctcgaagactacttgccagttctgctgggactagcacaacaaggtagcgtcttgagacacaaagtgcagttcacctggagtaaccaagaggataatgctgaggagacagccatttcagatgtctggtacgaggtgctgtccgtgctgcacttgatggccatggtctgcttgctgcaggccaacaccctgcttctcccaaggtcatacggcgatggctacgccccaagagtttctgaagagagtagacgggccactgttgatgtcttcttgaaggcagctggatacctagactgcgcaattcgtcatgtacttccgaagatgccactggaactaaggagacaacttccagtcgacctggctgaaggaaatctcaaagctctaagcctgcaagcctttgggtcagggggttgacatgcagctcggcttggctattgatagtccaaaggccactttagcagtcaaaaggcgcttagcctgtgagatggtcaaatattggcaacaagttcaagagagcattccagagcttccagtctctgatggatggggaaaaaagcaccggctatttgtaaagtggaagtatgttgaagccaaggctgcagcatactatttccacggtttgattcttgacgagggaaataccgagaaatcccatggaatggcaatagctgcactacaagcttcagaagaatttctgaaagaaagcaaaatggtttcggaagccttccatgcaactcctccaacatcgaggagtccgaatgcattcggaacagcaaaatatctgtttgacaagatcccaagagatgcttccagcaaggtccgaatcaaacaggacctgtatactcaagaaaaggtcattggagcaccacccccattaccagattttgcattggcgctaacacctgaagattatgatcttcctccactagatccactttggaacaaagaagatacacaccattaagtgtctatacagcagattggttgcttctggcaaaaaattggctctggagagaaaggaggaccaagatctaccatgtcaaaggtcgaacatggtaacaaatgaagtgtacaaaatattttcaaacaaaattacatgtcaacaaaattaagcaaggcttgaagataatctgaagagctctgtacaggcaattttcttctgacaagggaaatgatatgtcaaagggttcattgatcattgtcgatcctgattcctgatgcttttattttttcaacaacagattttcagcattcgaaatggaactggaatcagcctctgatcgaagtggaaacctttttttagtcgtaaacatttacattggcaccttaaaatatactctggaacaatcagtctcagctgaacagtttataatacatgaact

SEQ ID NO: 9725 - DNA, 2025 bp, Zea mays
aaccctgtaggcctctcccttcttctgctctccctcccttctcaaggcttcctcctgcagtccagctcaccaggaccaggaggaacaaagaagttgcatcgaacacagctgagttcctccctcttccctgaaatgcgcccggcagctagaaaggagcagctagcgggcgggctgcccatacgtcgttgagcactgcggagacggccgggagcagggggggcgggagggatagtggcggcctctgctgctgctggtcgaggcttcgattccgggcgggggctggtggtctcgagaatcccggagggaagggagcgagcgcaaagatagatacctaagcgggccgcttccgctgcacagccacaggcatggggtgcggggcgtcgagccacaaggacgccggggcgcgccggagacggcctgggagcgtcggcgacgtggtcgttttcctcccgggcctccgggtgccgagggccgtcgacttcgcccaggcgctcggcggctgcctggccagggctatagtcgagcggctgtcggctctgaggtcgcgggtcgtcgagatggcaatgcaagaatcggcggcggcgctcaagcccaggcggaaggcggctgcacggcacgggtctagtacagccaatcttctacaggccctcgaagactacttgccagttctgctgggactagcacaacaaggtagcgtcttgagacacaaagtgcagttcacctggagtaaccaagaggataatgctgaggagacagccatttcagatgtctggtacgaggtgctgtccgtgctgcacttgatggccatggtctgcttgctgcaggccaacaccctgcttctcccaaggtcatacggcgatggctacgccccaagagtttctgaagagagtagacgggccactgttgatgtcttcttgaaggcagctggatacctagactgcgcaattcgtcatgtacttccgaagatgccactggaactaaggagacaacttccagtcgacctggctgaaggaaatctcaaagctctaagcctgcaagccttgggtcagggggttgacatgcagctcggcttggctattgatagtccaaaggccactttagcagtcaaaaggcgcttagcctgtgagatggtcaaatattggcaacaagttcaagagagcattccagagcttccagtctctgatggatggggaaaaaagcaccggctatttgtaaagtggaagtatgttgaagccaaggctgcagcatactatttccacggtttgattcttgacgagggaaataccgagaaatcccatggaatggcaatagctgcactacaagcttcagaagaatttctgaaagaaagcaaaatggtttcggaagccttccatgcaactcctccaacatcgaggagtccgaatgcattcggaacagcaaaatatctgtttgacaagatcccaagagatgcttccagcaaggtccgaatcaaacaggacctgtatactcaagaaaaggtcattggagcaccacccccattaccagattttgcattggcgctaacacctgaagattatgatcttcctccactagatccactttggaacaaagaagatacacaccattaagtgtctatacagcagattggttgcttctggcaaaaaattggctctggagagaaaggaggaccaagatctaccatgtcaaaggtcgaacatggtaacaaatgaagtgtacaaaatattttcaaacaaaattacatgtcaacaaaattaagcaaggcttgaagataatctgaagagctctgtacaggcaattttcttctgacaagggaaatgatatgtcaaagggttcattgatcattgtcgatcctgattcctgatgcttttattttttcaacaacagattttcagcattcgaaatggaactggaatcagcctctgatcgaagtggaaacctttttttagtcgtaaacatttacattggcaccttaaaatatactctggaacaatcagtctcagctgaacagtttataatacatgaact

SEQ ID NO: 9726 - DNA, 1988 bp, Sorghum bicolor
gttcgtcgtgctttgtgtcgtgcgcgtccgcgtgcagactactgcagagacgggggagcagggatagtggcggacggtctctgctgttggtggtggaggcttcgattccgggcgcgggcggggtggcttgtggtctcaagaatcccggaaaggccgccggaaaggcagcgggcgggcgcaaagataactaataggcaggccactggacaggcatggggtgcggggcgtcgagccagaaggacgccgggccgccccggagacggctggggagcgtcggcgacgtggtcgtcttcctgccgggcctccgggcgccgaggaccgtcgacttcgcccacgcgctcgccggctgcggcgtggccaggagcgtcgtggaccggctgtcggctctcaggtcgcgggtcgtcgagatggcaatgcaagagtcggcggcggcgctcaagcccaggcggaggacggcggcacggcacgggtccagtacagccaatcttctacagacccttgaagactacttgccagttcttctaggactagtaaaagatggtagcatcttgaggcacaaagtgcagttcacctggagtaaccaagaggatagtgccgaggagacggccatttcagatgcctggtacgaggtgctgtccgtgctgcatttgatggccatggtctgcttgctgcaggccaacaccctgcttctccccaggtcatacggcgatggctacgccccaagagtttctgaagagagtagacgggccactgttgatgtcttcttgaaggcagctgggtacctagactgcgcaattcggcatgtacttccgaagatgccgctggaactaaggagacaacttccagtagacctggctgaaggaaatctcaaagctctatgcctgcaagccttgggtcagggggttgacatgcagctcggtttggctattgatagtccaaaggccactttagcagtaaaacggcgcttggcctgtgagatggtcaaatattggcaacaagttcaagagagcattccagagcttcctgtctctgatggatgggggaaaaagcaccggctgtttgtaaagtggaaatatgtggaagcgaaggctgcagcatactatttccatggtttgattcttgacgagggaaataccgagaaatcccatggaatggcaatagctgcactccaagcttcagaggaatttctgaaagaaagcaaaagggtttcggaagccttccatgcaactcctccaacatcgaggagtcccaatccatttggaacagcaaaatatctgtttgacaagatcccaagagatgcttccagcaaggtccgaatcaaccaggacctgtatactcaagaaaaggtcattggagcaccacccccattaccagattttgcattggcgctaacacctgaagactatgaccttcctccactagatccactttggaacaaagaagacacgcaccattaagtgtatatgcagcagaatggttgcttctggcaagaaattggctctggagagaaaggaaggaccaagatccaccatgtcaaagtcgaacatggtaacaaatgaagtgtacaaaatattttcaaacaaaattacatgtcaacaaaattaagcaaggcctgaagataatctgaagagctttgtacaggcgattcttcttctgacatgggaaatgctatgtcaaagggttcattgatcattttcgatcctgattcctgatgcttgcattttgtcaacaacggattttcagcatttcatatggaactggaaccagcctctggtcgaaagtggcaaccttcaatttttttagtcataaacatttacattgccaccttaaaacataccctggaacaatcagtttcaccggagcagtttatattagatgaacatgatttccaaataatcagtgtggccaaaaagttaccaccttccaaccaatcagtgcatgcataaacagtcataaaatttcagttctaattttagaatacaaaaaaa

SEQ ID NO: 9727 - DNA, 1431 bp, Sorghum bicolor
cgtcgttggcgtcggcgcctgcgtttcgttcctcttcttccctccatcagcagcatcacctcgctgcgctcgggttccatttccatttgcttcgtctcggtcacctcagatcagatcaagggacgggacgccagcccacctgccaccctcctccttcgctccctccctcccatcccagatcccccaccccagccatggccaccgccttcgagtccccgacctcctcccccgccgccgcgcccttccacgacgaccctttcctccacttcgacggctcggcccccgccgccgacggcttcccggcctccccggacgcctatgcgccctcccccttcggcatgccccactccaacggcgacctccacgacgaccctttcgccgcacccgctgactccaacggtgggcccatcctcccgccgcccaccgagatggggcgcgaggagggattcctgctccgcgagtggcgccgacaaaatgctatccaccttgagaaaaaggagaagaatgagaaggagctgaggagccaaatcatcgttgatgctgaagagtttaagaaagcttttgttgagaagagaaagctcaatgttgagacaagcaagggccaaaaccgtgacagggagaagcttttcctagcaaaccaggaaaagttccatgctggtgcggataagcagtactggaaggcgatatcagaacttatcccacatgagattgctaacatcgagaagagaggggcaaggaaagataaggagaaggaaaagaagcctgggatcgtggtgatccagggcccaaagcctgggaagccaacagacatggcacggatgcggcagatattgctgaagctgaagcacactcccccaccacacatgaagccacccccgccacctgctgcagccactggaaaggatggagcaccagctgctgctggaaaggatggagctaagccagcagcccctgccaatggcagtgtccctgagatggaaaaggccgccgcggtggcaccagtgcctgcagcagcaccaccagcagcaactgagccgattgcagctgcctaatctaatcatttatggtaggaggatgtgaaaaatctcttatttagagttgttgcagaggcggtggtggtgaaactgaaaacgtgtgaatttccggcatggtggagacatgcactgtgtatttgttaaggcacctcgattcatttacattactatatatttttattgcattttgtagagaagggcatgtgtatcctggttcatggtaataataaggttgtattaggaggatgtatgttttggtggctgtattatgtttcttcttccaagtgttggaaattttcctttgttataaaaactgattgtattgttctgctactatctgctgcatatatggagtatatttttgtgcattttgatctatctgagctagggatgcttg

SEQ ID NO: 9728 - DNA, 1348 bp, Saccharum officinarum
gacaagagcgactcttcttccaacatcagactcacctcgctcgccgctcgcgttccattgggatttgcttcggctcacctcagatcgagggacgctaggccacctgccactcacctccctcccatcccagatcccccagccatggccaccgccttcgagtccccgacctcctcccccgccgccgcgcccttccacgacgaccctttcctccacttcgacggctcggcccccgcccccgccgacgtcttcccggcctccccggacgcctacgcgccctcccccttcggcatgccccactccaacggcgacctccacgacgaccctttcgccgcacccgctgactccaacggtgggcccatcctcccgccgcccaccgagatgggacgcgaggagggattcctgctccgcgagtggcgccgacaaaatgctatccaccttgaggaaaaggagaagaaggagaaggagctgaggagccaaatcattgttgatgctgaagagtttaagaaagcttttgttgagaagagaaagctcgatgctgagacaagcaagggccaaaaccgtgacagggagaagcttttcctagcaaaccaggaaaagttccatgctggtgcggataagcagtactggaaggcgatttcagaacttatcccacatgagattgctaacatcgagaagagaggggctaggaaagacaaggagaaggagaagaagcctgggatcgtggtgatccaaggcccaaagcctgggaagccaacagacatggcacggatgcggcagatattgctgaagctgaagcacactcccccatcacacatgaagccacctccgccacctgctgcagccaccggaaaggatggagcaccagctgctgctggaaaggatggagctaagccagcagcccctgccaatggcagtgtccctgagatggaaaaggccgctgtggcggcaccagcgccggcagcagcaccaccaacagcaactgagtcgatcgcagctgcctaatctaatcatttatggtaggaggatgtgaaaaatctcttattagagttgttgcagaggcggtggtggtgaaactgaaaaacgtgtgaatttccggcatggtggagacatgcactgtgtatttgttaaggcacctcgattcatttacattactatatattgttattgcattttgtagagaaggggcatgtgtatcctggttcatggtaataataaggttgtattaggaggatgtatgttttggtggctgtattatgtttcttcttccaagtgtttggaaattttcctttgttattaaaactgattgtattgttatgctactatctgctgcatatatggagtatatttt

SEQ ID NO: 9729 - DNA, 1276 bp, Saccharum officinarum
  misc_feature (1235)..(1235): n is a, c, g, or t
cctcagatcgagggacgctaggccacctgccactcacctccctcccatcccagatcccccagccatggccaccgccttcgagtccccgacctcctcccccgccgccgcgcccttccacgacgaccctttcctccacttcgacggctcggcccccgcccccgccgacgtcttcccggcctccccggacgcctacgcgccctcccccttcggcatgccccactccaacggcgacctccacgacgaccctttcgccgcacccgctgactccaacggtgggcccatcctcccgccgcccaccgagatgggacgcgaggagggattcctgctccgcgagtggcgccgacaaaatgctatccaccttgaggaaaaggagaagaaggagaaggagctgaggagccaaatcattgttgatgctgaagagtttaagaaagcttttgttgagaagagaaagctcgatgctgagacaagcaagggccaaaaccgtgacagggagaagcttttcctagcaaaccaggaaaagttccatgctggtgcggataagcagtactggaaggcgatttcagaacttatcccacatgagattgctaacatcgagaagagaggggctaggaaagacaaggagaaggagaagaagcctgggatcgtggtgatccaaggcccaaagcctgggaagccaacagacatggcacggatgcggcagatattgctgaagctgaagcacactcccccatcacacatgaagccacctccgccacctgctgcagccaccggaaaggatggagcaccagctgctgctggaaaggatggagctaagccagcagcccctgccaatggcagtgtccctgagatggaaaaggccgctgtggcggcaccagcgccggcagcagcaccaccaacagcaactgagtcgatcgcagctgcctaatctaatcatttatggtaggaggatgtgaaaaatctcttattagagttgttgcagaggcggtggtggtgaaactgaaaaacgtgtgaatttccggcatggtggagacatgcactgtgtatttgttaaggcacctcgattcatttacattactatatattgttattgcattttgtagagaaggggcatgtgtatcctggttcatggtaataataaggttgtattaggaggatgtatgttttggtggctgtattatgtttcttcttccaagtgtttggaaattttcctttgttattaaaactgattgtattgntatgctactatctgctgcatatatggagtatatttttgttc

SEQ ID NO: 9730 - DNA, 1305 bp, Panicum virgatum
tcgactcgacgcggcatcccattccctcctccgacagctcagctcaagatcaccttctcttccctgcagctgcagtccagcagcaggatccagatcccgaggggccatggccaccgccttcgactcccccacctcctcccccgccgccgcgcccttccatgacgacgccttcctccacttggacggctcggccgccgcagccgacgccttcccggcctccccggacccctacgcgccctcgcccttcggcatgccccaggccaacggcggcctccacgacgaccccttcgccgactccgacggtgggcccatcctcccgccgcccaccgagatgggtcgcgaggagggattcctgctccgcgagtggcgccgtcaaaatgcaatcctccttgaggaaaaggaaaagaaggagaaggagctgaggagccaaatcatccttgacgctgaagaatttaagaaagcttttgtcgagaagcggaagctcaatgttgagacaagcaagggccaaaaccgtgacagggagaagcttttcctagcgaaccaggagaagttccatgctggtgcggataagcagtactggaaggcgatatcagaacttatcccacacgagattgccaacatcgagaagagaggggcgaggaaagataaggagaaggagaagaagcctgggatcgtggtgatccagggcccaaagcctgggaagccgacggacatgtcacggatgcggcagatattgctgaagctgaagcacactcctccgccacacatgaagccgcctccgccacctgcagcagctgctgggaaggacggtgccccggctgccgctgcaaaggatggagctaagccagcagcacctgccaacggaagtgttccagagatggagaaggccgcggcagcggcgcctgcaccagcaactgaacctatcgcggctgcctaagctaattgtttgcggtaggaggatagagttgttgcagaggaggtggtgttggtgaaactgaaagctcatctgaatagccgccggcatggcggaggcacctactgtgtattttgttaaggcacctttgattcattacattattattacaatattgttattgcattttgtagagaggtgggatgtgcattctggtactaataaggtaaatgaggctgtagtaggaggatgtgtggctatggtttcgtcttccaagtgtttgggattttcctttgttcaaattggttgtattattacgtgactataaatctgctgcatatatatatcattggtgtttcatctatctttatatatatatattcttatttctc

SEQ ID NO: 9731 - DNA, 1281 bp, Panicum virgatum
tcccttcccttctccgacagctcagctcaagatcaccttcccctccagtcccggatccagatcccgaggggccatggccaccgccttcgactccccgacctcctccccggccgccgcgcccttccatgacgacgccttcctccacgtggacggctcggccgcctcagccgacggcttcccggcctccccagacccctacgccttcagctccgacgcaccctcgccctttggcatgccccaggccaacggcggcctccacgacgacccgttcgccgactccgacggtgggcccgtcctcccgccgcccaccgagatgggtcgcgaggagggattcctgctccgcgagtggcgccgtcaaaatgcaatcctccttgaggaaaaggaaaagaaggagaaggagctgaggagccaaatcatccttgacgccgaagaatttaagaaagcttttgtcgagaagcagaagctcaatgttgagacaagcaagggacaaaaccgtgacagggagaagcttttcctagcgaaccaggagaagttccacgccggtgcggataagcagtactggaaggcaatatcagaacttatcccacacgagattgctaacatcgagaagagaggggcgaggaaagataaggagaaggagaagaagcctgggatcgtggtgatccagggcccaaagcctgggaagccgacggacatgtcacggatgcggcagatattgctgaagctgaagcacactcctccgccacacatgaagccacctccgccacctgcagcagctgctgggaaggacggtgccccggctgccgctggaaaggatggagctccggctgccgctgccaaggatggagctaagccagcagcccctgccaacggcagtgttccagagatggagaaggccgcggcggcagcagcgcccgcaccagcagctgagcctatcgcggctgcctaagctaatcatttgcggtaggaggatagagttgttgcagaggaggtggtgttggtgaaactgaaagcgcgtctgaatcgctggcatggccggaggcacctagtgtgtattttgttaaggcacctttgattcattacattactacaatattgttattgcattttgtagagaggtgggatgtgtattctggtacaaataaggtaaatgaggctgtattatggtttcgtcttccaggtgtttgggattttcctttgttcgaattggttgtattattacgtgactatatctgctgcatatatatgtactttatgcttccttggtgtttaaaaaaaaaa

SEQ ID NO: 9732 - DNA, 1375 bp, Setaria italica
aggtcagatcaagctgcgcacacccaccaggccaccaccaccttgccgaggatccagatcccgagggggccaagccatggccaccgccttcgactcccccacctcctcccccgccgccgccgcgcccttccatggcggcgacgccttcctccacttcgacggctcggccgacgtccacgcctccgccgacggattcccggcctccccggacccctacgccttccgctccgacgcgccgccctcgcccttcggcatgccccaggccaacggcggcgccgtccacgacgacgaccccttcgcccctgactccaacggtgggcccatcctcccgccgcccaccgagatgggccgcgacgaggggttcctgctccgcgagtggcgccgtcaaaatgcaatcctccttgaggaaaaggaaaagaaggagaaggagctgaggagccaaatcatccttgatgctgaagaatttaagaaagctttcgttgagaagcggaagctcaaccttgagaccagcaagggtcaaaaccgtgacagggagaagcttttcctagcgaaccaggagaagttccacgccggcgcggataagcagtactggaaggcgatatcagaacttatcccacacgagattgctaacattgagaagagaggggcgaggaaagataaggagaaggagaagaagcctgggatcgtggtgatccagggcccaaagcctgggaagccgacggacatggctcggatgcggcagatattgctgaagctgaagcacactcccccgccacacatgaagccacctccaccacctgcagcagccgccggcaaggatggtgcgccagctgctgctggaaaggacggagctccagctgctgctgcaaaggatggagcaaagccagcagcccctgcgaacggcagcgtccctgagatggaaaaggccgcgggggcagcacctgcaccagcaactgagcctatcgcagctgcctgagctaatcatttgcggtaggaggatagagttgtttcagaggaggcggtggtgaaagtgtctgaattgctggcatggctgaggcacctactgtgtattttgttggggcaccttgattcattacattacattactactatatattgttattgcattttgtagagaggtgggatgtgtgtatcctggtattaataaggtaaaatgaggatgtgtgtactatgttcctgtcttccaagtgtcttgagattttgttcaaactggttgtattacgtgacgatctgctgcatatgtatattttgtgcttccttggtttttcgatcaatttcatttaccgtctattttatctgtctgtattgctcctaaccatctgtgctgtaacatttcatctattctatatcttgc

SEQ ID NO: 9733 - DNA, 1269 bp, Pennisetum glaucum
gggagcacaaaatatacatatgcagcagatagatagtcacgtagtacaaccagtttgaacaaaatctcaaaacacctgcaagacaggaacacagtacacaacatcctcatttaccttattaataacaggatacacacgtcccacatctctacaaaatgcaataacaatatatagtagtaatgtaatgtaatgaatcaaggtgcctcaacaaaatacacagtaggtgccctctcagccatgccagcaattcagacactttcaccaccaccaccacctctgcaacaactctatcctcctaccgcaaacaattagctcaggcagctgcgataggttcagttgctggtgcaggtgccgccacggcagcggccgcggccttttccatctcagggacgctgccattggcaggggctgctggctttgctccatcctttgcagcagcagcagcagcagcagcagctggagctccatccttgccggcggcagcatccttgccagctgctgctgcaggtggcggaggtggcttcatgtgtggcggtggagtgtgcttcagcttcagcaatatctgccgcatccgtgccatgtcagtcggctttccaggctttggtccctggacaacaacgatcccaggcttcttctccttctccttatctttcctcgcacctctcttctcaatgttggcaatctcatgcgggataagttctgatatcgccttccagtactgcttatccgcgccggcatggaacttctcctggttcgctaggaaaagcttctccctgtcacggttttgacccttgctggtctccaggttgagcttccgcttctcaacaaaagctttcttaaattcttcagcatcaaggatgatttgggtcctcagctccttctcgttcttttccttttcctcaaggagaattgcattttgacggcgccactcgcggagcaggaatccctcgtcgcggcccatctcggtgggcggcgggaggatgggcccaccgttggagttagcagcggcgaaggggtcgtcgtggacggcgccgttggcctgtggcatgccgaagggcgacggcgcgtcggagcggaaggcgtaggggtccggggagggcgggaatccgtcggccgaggggtggacgtcggcggaggcgtcgaagtggaggaaggcgtcgtcgtggaagggcgcggcggcgggggaggacgtgggggagtcgaaggcggtcgccatggcttgggccctcgggatctggatcctcctggccgcggcctcgctgggggtgg

SEQ ID NO: 9734 - DNA, 1459 bp, Triticum aestivum
  misc_feature (265)..(266): n is a, c, g, or t
  misc_feature (268)..(268): n is a, c, g, or t
  misc_feature (270)..(271): n is a, c, g, or t
  misc_feature (273)..(274): n is a, c, g, or t
  misc_feature (277)..(278): n is a, c, g, or t
  misc_feature (280)..(281): n is a, c, g, or t
tatggagaacaaccgagaaacaggttagatttgtatatacccaaagataatagaagaccctgtcccgtggtggcctttgtaactggtggggcctggattattggttacaaggcatggggtgcccttcttggcaggcggttggctgagagaggaatcatagttgcttgcattgattacagaaattttcctcaaggaacaataagtgacatggttagcgatgcttctcaggggatctcattcgtgtgtaacaacattgctagttatnnangnnannctnntnngatctacttgatgggtcagtcagcaggagcacatatttcagcatgtgccctaatggaacaggcagtaaaagagtctagcggacagcccatttcttggagtgttacacaaatcaaggcatactttggtttatctggaggatacaacatccataatttggtcgaccatttccatcagcgtggtctgaaccgttcaatatttctcagtataatggagggagaagaagcattgtcacgttattctcctgaaattgttgtcaaggagtcgagtacccggaccatagctctacttcctcgtatctttcttatgcatggaacagatgattattcaataccatcgtctgccagtcgaacttttgtagacgtccttcaacaagttggtgcccaggccacattattattgtacgaagggaaaacacatacagatatatttatacaggatcctcttaggggtggaagggatcctttggttgaagatgtcttttctgttatttatgccgatgatgcaactcgccaaaatgcagcttctgcgccaactccaaggcgcctggtttttgagtggcaattgcagttggcccgttggattagtcccttctagaagacgacaccgcggagatgatgattcttagggtctcggcgattggcgtttgtgttactgtatttgccaatcgaacccaaacaaacacacgtaaaatgggggaaagcagtgaaacatcaagcaagataagatgaagcagatggcagaactacacgtcttatttgtaatattcgtcccatggattgcacacacactgtcagcgcctgtcgaggcatgatcgacatcatgggagacagaggaagggaaaggcgggattcatatataattcatagcaccatgaagatagcatgcaagctccatttcttctgctgccgttgtcagttttttgctgctgctggcttggagctcttcacctgcctcttcttaggctcccgtggctttgactcagccttcttgatgccgcccttggcggctgctggcttggtcgccgtggcactgagctttgcaggccccttggtggcactaaccttggtaggctccttggcctgcccttcaagtccggttggcttcacggccttcagggatgccattcttatatgctgctctgttccggcactggaaggctcagaagcttaagctgtcg

SEQ ID NO: 9735 - DNA, 565 bp, Triticum aestivum
ttgaggggggtataggatcatgtaggcgaattggtaccgggccccccctttttttttggcagaactacacgtcttatttgtaatattcgtcacatggattgcgcacacactgtcagcgcctgtcgaggcatgatcgacatcatgggagacagaggaagggaaaggcgggattcatatataattcatagcaccatgaagatagcatgcaagctccatttcttctgctgccgttgtcagttttttgctgctgctggcttggagctcttcacctgcctcttcttaggctcccgtggctttgactcagccttcttgatgccacccttggcggctgctggcttggtcgccgtggcactgagctttgcaggccccttggtggcactaaccttggtaggctccttggcctgcccttcaagtccggttggcttcacggccttcagggatgccattcttatatgctgctctgttccggcactggaaggcttagaaacttaagctgtcgtgtgcttgatgaactggggaatggatggaccatggtattataggccgcttcttgggtctcccaagt

SEQ ID NO: 9736 - DNA, 1296 bp, Triticum aestivum
attattattgtacgaagggaaaacacatacagatatatttatacaggatcctcttaggggtggaagggatcctttggttgaagatgtcttctctattatttacgccgatgatgcaactcgccgaatacagcttctgcgccaactccaaggcgcctggtttttgagtggcaattgcagttagccggggggattagtcccttctaatagatgacacggcggagatgttacttcttaggatctcctgcgattggtgttcatgttattgtatttgccaaccgaacccgaacaaacgcacgtaaaatgggagagtgcagtgaaacatcaagcaggataagatgaagcagatggcagaactacacgtcttatttgtaatattctcacatggattgtgagtacaccctgtctaggcgtgatcgacatcatgggagacagaggaagggaaaggtgggattcatatataagtcatagcaccatggagatagctacgcaagctccatttctcctgctgccgttgtcagttttttgctgctgctggcttggtgctcttcacctgcctcttcttaggctcccgtggctttgactcagccttcttgatgccacccttggcggctgctggcttggtcgccgtggcactgagctttgcaggtcccttggtggcactaaccttggtaggctccttggccttcccgtcaagtccggttggcttcacggccttcagggatgccattcttatatgctgctctgttccggcactggaaggcttagaaacttaagctgtcgtgtgcttgatgaactggggaatggatggaccaaggtatttataggccgcttcttgggtctcccaagtgtgcagagtacaaatcctacatgaagcaagaataaaggcgtcctgaattattgtagcaagtgattgatggcacggtgcagttggatgctttcttacagaattggatgccttgtagcctggtaggaggtgcaactcaccggacgtgaagttttccattcgaaatgtttgaggtatattattccctgagtcattaacgcataatggcaccaggaagcttccgaaagaataaatcttgtacaagaaggtttgctgcctggtttctgttggtgtctggatgatctccccctccgacgtaggggactcggtatagcttgtgttgcgtttggcaagttgctatgatgtcttttttgttttttgctggttctatgggatttgtaataatttagttgcatgtgtccttgagaagggtggtttgtgctctgtttcgtactctttccgtcccataatgt

SEQ ID NO: 9737 - DNA, 559 bp, Triticum aestivum
ctcgtgccgaattcggcacgaggacagttctaagccttccagtgccggaacagagcagcatataagaatggcatccctgaaggccgtgaagccaaccggacttgaagggcaggccaaggagcctaccaaggttagtgccgccaaggggcctgcgaagctcagtgccacggcgaccaagccagcagccgccaagggtggcatcaagaaggccgagtcaaagccacgggagcctaagaagaggcaggtgaagagctccaagccagcagcagcaaaaaactgacaacggcagcagaagaaatggagcttgcatgctatcttcatggtgctatgaattatatatgaatcccgcctttcccttcctctgtctcccatgatgtcgatcatgcctcgacaggcgctgacagtgtgtgcgcaatccatgtgacgaatattacaaataagacgtgtagttctgccatctgcttcatcttatcctgcttgatgtttcactgctttctcccattttacgtgtgtttgtttggccttgattggcaaatacaataacacaaacaccaatcac

SEQ ID NO: 9738 - DNA, 1826 bp, Brachypodium distachyon
  misc_feature (636)..(637): n is a, c, g, or t
  misc_feature (639)..(640): n is a, c, g, or t
  misc_feature (643)..(644): n is a, c, g, or t
  misc_feature (646)..(647): n is a, c, g, or t
tcttcgccactcaatgcagcctccttcctccggcggcgacgcgcgcgaggcggacgcgctcctcgcgcggagcgactccgcgggccgccgccgccgcgcgtcgcctgtgcagtccgcgtccccggcgccccaaggctggggtggccccaggaggcagtcgtcgttccgcgatgacgttggccacgccgcctccgagacgtacctcgtgacgcgcctcaccttcaccctactccagtacctcgggttaggttaccgatggatgacacaacttcttgcccttgcagtatatgcgattttacttatgccaggttttttgcaagttggatattattatttcttttcaagtcaggttcgtagaagtatagtttatggagaacaaccaagaaataggttggatttgtatatacccaaagataacactagaccctgtccagtgatggcctttgtaaccggtggggcttggattattggttacaaagcatggggtgcccttcttggcaggcggttggctgagagaggaatcatagttgcttgcattgattacagaaattttccccaaggaacaataagcgacatggttgctgatgcttctcagggaatttcatttgtgtgtaacaacatcgctagttatggagnnannctnntnngatctacttgatgggtcagtcagcaggagcacatattgcagcatgtgccctcatggagcaggcagtaaaagagtctagtggacagcccatttcttggagtgttacacaaatcaaagcatacttcggtttatctggaggatacaacatctataatttggtcgaccatttccatcagcgtggtctttatcgttcaatatttctcagcataatggatggagaggaatcgttgtcacgttattctcctgaaattgttgtcaaggagtctagtcctcagactatagctttactgcctcctattgttcttatgcatgggactgacgattattcaataccatcatctgccagtcaaacttttgtagacgtccttcaacaagttggtgctcaagcaaggttactgttgtacgaaggcaaaacacatactgatatctttttacaggatcctcttaggggtggaaaggatcctttggttgaagatgtcttgtctgttattcacactgatgatgcaacacgccgaaatatagcttcagcacccactccaaggcgcctggtttttgagtggcaattgcagttggcccgtcgaattagtcccttctagaagacgacaccgcggagatgatgattcttagggtctcggcgattggcgtttgtgttactgtatttgccaatcgaacccaaacaaacacacgtaaaatgggggaaagcagtgaaacatcaaagcaggaaaagatgaagctgatggtacaactatacatcttatttgtaatatcatcacatggggttaagcacaccatcaaggcctgtctaggcaggataatgacatcataggagacagaggaagggaaagatgggattcatatatattcatagcatcatggaaatcactatgcaagttccatttctcttgctgccgttgtcagtttttgactgctgccggcttgctgctcttcacctgcctcttcttaggctcccgaggtttcgactcagccttcttgatgccgcccttggcggctgctggctttttcgcggtggcactgagctttgcaggctccttggtggcactaagcttggcaggctccttggcctgagctgctggcccggtgggcttcacggccttcacggatgccattcttataatgctactctgttccggcactcgggaaagctcggaagcttaagctg

SEQ ID NO: 9739 - DNA, 1919 bp, Setaria italica
tctcgctcactggtgttcgtcgtggtttatttcttcggttgtgcgcgcgtgcagagactgcagagacggggagcggaggtagtagtggtggcggtggcccttgctgggtggaggtggaggcttcgattcgggcggtggctcgtggcctgacgaatcccggaaaggccgccggaaaggggaggacaaaggtaaacaggccgctgtgaagccatggggtgcggggcgtcgagccagaaggacgccgccggcgggccccggagacggccggggagcgtcggcgacgtggtcgtgttcctcccgggcctccgggtgccgaggagcgtcgacctcgcccaggcgctcggcgggcgcctggacaggagcattgtggagcggctgtcggctctgagagcgcgcgtcgtcgagatggcaatgcaagagtcggcggtggcgctgaagccaaggcggagggcggcggcacggcacggatctagtacagccaatctcctacaggctcttgaagaatacttgcccgttctgctaggattggtaaaagaaggtagtatgttgaggcacgccgtgcaattcacttggactaaccaagaggataatgctgaggagacggccatggcagatgcctggtacgaggtgctgtccgtgctgcatttgatggccatggtctgcttgctgcaggccaacaccctgcttctccccaggtcatacggcgatggctatgcaccaagagtttctgaagagagcagaagggtcactgttgatgttttcttgaaggcagctggatacttagactgcgcaattcggcatgtacttccacagattccaccggaactaaggaggcaacttccagtagacctcgttgaaggaaatctcaaagctttaagcctgcaagctctgggtcagggggtggacatgcagcttggtttggctatcgatagtccaaaggccactttagcagtaaaacggcgcttagcctgtgaaatgatcaagtattggcaacatgttcaggaaagcattccagatcttcctggctctgatggatgggggaaaaagcaccggctgtttgtcaagtggaaatatgttgaagcaaaggctgcagcatactattttcatggtttgattcttgatgagggaaatacagagaaatcccatggaatggcaatagccgcacttcaagcttcagaagaatttctgaaagaaagcaaaagggtttcggaagccttccatgcaactcctccaacatcgaggagccctactccattcggaacagcaaaatatatgtttgacaagatcccaaaagatgcttcaagcaaggtccgaatcaaccaggacctgtatacccaagaaaaggtcataggaactccgcctcccttaccagattttgcattggcgctaacacctgaagactatgatcttcctccattagatccactttggaacaaagaagacagacgtcattaggtgtatatgcaacagaatggtttcttcagacgaaaagcttggcgttagagagaaacaagaagcaccaagatctgccatgcgaaagctgagcatggtaaaagtgtacaaagtatgtttgaaccaaatttcgtatcaaaaaaaaatccaaccaattgttaggaaggcctgaagataatctgaagagcattgtacaggcgatttttcttctgataagggaaatgctttgtcaaagggttcatttaacattcttgatcctgattcctgatgttcctgatgcttgcattttctcgacaagggcatagctttgggcccgttctgatttatgtgtggtccctcaatagctttgccagattcaatgatatttcaagaactgtaaccttcagagtttcataatttgattgggaaccagcctgggaccaaaagtggcagctttcaacttgtatttcataatgtctgtcataaac

SEQ ID NO: 9740 - DNA, 1519 bp, Panicum virgatum
accaaatcctgcgcgtccgtactcctgcttcccctccgaccacggcggcgctgctctccgcaggtcggaagatgttggatcttccgctacaaatccaggcattgacgataaagtttagtttctctttctgttaagtttcaatatttcattcacagtttggcgagttgttatttccccccccccccccaaatttaagcagctgctgttttgaaggtttcttctccgggaaaaattcaaatcccggaaccgactggggttgcagtacccgcagatgctgctaactatcaagttcccggacctataaattactcgacttgtgatttcgtttgttaaatcctagctattgcgttcgacgtgcctgtgatttctgacccgtgatgaattggaaccgcagaaatctctaggagacgaatcgaatcgagcaggttaccaggtagcggaggaaccaggcggccatggctgagcacctggcgtccatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctcagcaagcacggcgagatcgagagcctccacgtctgcgacaacctcgccgaccacatgatcggcaacgtctatgtgcagttccgcgaggaggagcaggccgcccgcgcgctgcaggcgctgcagggccgctactactcgggccgccccatcatcgccgagttctcgccggtcaccgacttccgggaggccacctgccgccagttcgaggagcacagctgcaaccgcggcgggtactgcaacttcatgcacgtcaagcaggtcggccgggacctgcggcggaagctgttcggccacctgcaccggacccgccggagccgcagccggagcagccgcagcccgagcccgtaccgctaccgccggagctcgtcgcggtcgagggaccgcgacgacgactacgactactactaccactaccgtagtggcagtggcagccggaggagcagcgagaggcaccgcagccacgacagcgacgggagccgccgccggcgcgggcggtcgaggagccggagcccggtgagggaaggcagcgaggagcggagggcgcggatcgagcagtggaatcgcgagagggaggccgcgcaggtgtgagcagagcagctgctgtgggcatgccaggctgcagtttaccgcagtgatggtgttcgcttggtttgtgaaaatttcatcttgtactagtagttagtcatgtcgtaaattgaactcaaaattcgggggttttaattgttaccaaattgaacctgtggttgttattgaacttgctctggatgtatcgatagaacctaattgcttgtttcagt

SEQ ID NO: 9741 - DNA, 1513 bp, Zea mays
gaagcatccaggcatccagcaaatccagcgggtccgtactcatctgcttcacctccgggctccggctacggcggcactcttctctggcaaccggtcggaagatgttggatcttccgcttcaaatcgacgcataaaggatgcagattagttttgttcgcgtcaaatttattttgctcggtgtagttctgtccattaattaattatttgtactggatttaaggtgctgctattttgaaggttttttctcccggaaattttcacatcccgaaacgactggaaattgaagtagccatttgatgctgttacctgggttcataagttgttagacttgttgttatttgtttgttaatcctatagctattgcatattgtgtgcctgatcaggaccacagaaacctctaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcaggcgctgcagggccgctactactcgggccgacccatcatcgccgagttctcgccggtgacggacttccgggaggccacctgccgccagttcgaggagcacagctgcaaccgcggcggatactgcaactttatgcacgtcaagcaggtcggccgggacctgcggcggaagctgtttggccacctgcatcgctccctccggagccacagccgaggcagccgcagcccgagcccataccgccgccgcggtagctcgtccaggtccagggaccgcgacgattaccacgactactactaccactactaccgtagtggcagtggcagccgcaggagcagcgagagacaccgcagccacgacagcgacgggagccgccgtcgacgcgggcggtcgaggagccggagccggagcccggtgagggaaggcagcgaggagcggagggcaaagattgagcagtggaaccgcgagcgggaggcagctcaggtgtaagcaagttccccttccctagttgccatgttggttgctgcagtgttattggccttgctagttgccatgttgctgttgctgaagcctgttatcatgtattgtggtgtggttcaggcagggtaaggccataaattgagcctgaaattggactgtgatctcttttgctgtggacgggttaccattaaacttgatttggatgtgctgatggaatct

SEQ ID NO: 9742 - DNA, 1550 bp, Panicum virgatum
accaaatcctgcgcgtccgtactctgcttcccctccggccacggcggcgctgctctccggtcggaagatgttggatcttccgctacaaatccaagcattgaggataaagattagtttccctttctgttaaatttctctcacagtttggcgagctgttaatttccccccaaatttaagcagctgctgttttgaaggtttcttctccgggaaaaaaatttcaaatcccgaaaccgaccgaggttgcagtagccgcagatgctgctacccatcaagttcccgggcccataaattatactcgacttgtgatttcgtttgtcaatcctagctattgcattctgcgtgcatgtggtttctgacccgtgaattggaaccgcagaaatctctaggcgacgaatcgaatcgaatcgagcaggtaccaggtagaggaggaaccaggcggccatggctgagcacctggcgtccatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctgagcaagcacggcgagatcgatagcctccacgtctgcgacaacctcgccgaccacatgatcgggaacgtgtacgtgcagttccgcgaggaggagcaggccgcccgcgcgctgcaggggctgcagggccgctactactcgggccgccccatcatcgccgagttctcaccggtcacggacttccgggaggccacctgccgccagttcgaggagcacagctgcaaccgcggcggctactgcaacttcatgcacgtgaagcaggtcggccgggacctgcggcggaagctgttcggccacctgcaccggtcccgccggagccacagccggagcagccgcagcccgagcccgtaccgccaccgccggagctcgtcgcggtcgagggaccgcgacgacgactacgactactactaccactaccgtagtggcagtggcagccggaggagcagcgagaggcaccgcagccacgacaacgacgggagccgccgccggcgcgggcggtcgaggagccggagcccggtgagggaaggcagcgaggagcggagggcgcggatcgagcagtggaaccgcgagagggaggccgcgcaggtgtgagcagagcagctgctgtggctatgctcggctgcagttcgccgcagtgatgatgtccgcttggttagtttgcaaggtcgctgaaaatttcatcttgtactagtagttagtcaggatcatgtcgtaaattgaactcaaaattcgggggtttcaattgtgaccatagtgtacttgtggttgtcattgaacttgctctggatgtatcgatggaacctaatttccagtttcagtatgagcttgtgctgatgatcggtgct

SEQ ID NO: 9743 - DNA, 1164 bp, Brachypodium distachyon
gagatctctagcttttctgtccagtcgccgccatggccgagcacctggcctcaatcttcggcacggagaaggaccgcgtgaactgcccgttctacttcaagatcggcgcgtgccggcacggcgaccgctgctcccgcctgcacaacaaaccgtccgtctcgccgacgctgctgctgtgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgtggtagagagcctgcacgtctgcgacaacctcgccgaccacctgatcggcaacgtgtacgtgcagttcagggaggaggaccaggccgccagggccctgcaggcgctgcaggggcgcttctactcgggccgccccatcattgctgagttctcgccggtcaccgacttccgggaggccacctgccggcaatttgaggagcacaattgcaaccgtggagggtactgcaacttcatgcatgtgaaggagatcggcagggatctgaggaagaggctgtatgggcacctgcatcgttccaggagaagccacagcaggagccccagcccgtaccatcgccacccgagggaccgtgatcgcaggagctcatcgcggtccagggacaaccgtggcggcgactactacggtggcagcctggaccgtggcgactacggggactactaccaccacagcaggaggaggagcagcgagaggcaccgcaactacgacagtgacgatgggagcaggcgacgccggcacaggagccggactaggagccccgtcagagagggcagcgaggagcggagggcaaagatcgagcagtggaatcgcgagagggaggcggcgcaagcttgagtcggtcttgtctcatttcaggttgcattgttcagttcaccggacgccttggttcttactgtgtgagcttgtactggtagatgaagttagaatgtgggcttagtggatttactggggtgtctaatgtgacatcttcactcttcagaatcttcagtgtgatccttactgaactacctttggatgtcttgttggaaccaattttcctactcggtgatcaaattgtgaatgttcttgagcttggtgc

SEQ ID NO: 9744 - DNA, 1013 bp, Brachypodium distachyon
tatcaagttctttccccttcttgaatgaattatctggcacgctcttagtttaatcctggctgcaattccttttgtgtaccttctgattcgtgttgtgggactgcagagatctctagcttttctgtccagtcgccgccatggccgagcacctggcctcaatcttcggcacggagaaggaccgcgtgaactgcccgttctacttcaagatcggcgcgtgccggcacggcgaccgctgctcccgcctgcacaacaaaccgtccgtctcgccgacgctgctgctgtgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgtggtagagagcctgcacgtctgcgacaacctcgccgaccacctgatcggcaacgtgtacgtgcagttcagggaggaggaccaggccgccagggccctgcaggcgctgcaggggcgcttctactcgggccgccccatcattgctgagttctcgccggtcaccgacttccgggaggccacctgccggcaatttgaggagcacaattgcaaccgtggagggtactgcaacttcatgcatgtgaaggagatcggcagggatctgaggaagaggctgtatgggcacctgcatcgttccaggagaagccacagcaggagccccagcccgtaccatcgccacccgagggaccgtgatcgcaggagctcatcgcggtccagggacaaccgtggcggcgactactacggtggcagcctggaccgtggcgactacggggactactaccaccacagcaggaggaggagcagcgagaggcaccgcaactacgacagtgacgatgggagcaggcgacgccggcacaggagccggactaggagccccgtcagagagggcagcgaggagcggagggcaaagatcgagcagtggaatcgcgagagggaggcg

SEQ ID NO: 9745 - DNA, 1455 bp, Cenchrus ciliaris
  misc_feature (759)..(759): n is a, c, g, or t
  misc_feature (908)..(908): n is a, c, g, or t
  misc_feature (920)..(920): n is a, c, g, or t
  misc_feature (993)..(993): n is a, c, g, or t
  misc_feature (1138)..(1138): n is a, c, g, or t
  misc_feature (1174)..(1174): n is a, c, g, or t
  misc_feature (1303)..(1303): n is a, c, g, or t
  misc_feature (1306)..(1306): n is a, c, g, or t
  misc_feature (1396)..(1396): n is a, c, g, or t
  misc_feature (1411)..(1411): n is a, c, g, or t
gcgtactctgcttcccttccgaccacggcggcgccgctctccgttatcaggtcggaagatgttggatcttccgctacaaattcaagcattgaggataaagattagtttcctttctgttaaatttctttcactgttaagctacttgttaatttcccctcaaatttaagcggatgctgttttgaaggtttattctccgagaaaaattcagatcccgaaaccgactgggattgcagtagccactgatgctgttatctgtcaagttctccaactcctacaattatagtcgatttgttatttgtctgctaataatccttgctaattgcgtcctgtgtgcgccttgaatttctgaacctgcagaaatttccaggcgacgaatcaaatcgagcaggtagaggaggaatcaggcggccatggctgagcacctggcttccatctttggcacggagaaggaccgcgtgaactgccccttctacttcaagatcggcgcgtgccggcacggcgaccggtgctcccgcgtgcacaacaagccgtccatctcgccgacgctgctgctctgcaacatgtaccagcgcccggacatgatcaccccgggcgtggacgcgcagggcaaccccatcgacccggagcagatccaggaggacttcgaggatttctacgaggatatcttcgaggagctgagcaagcacggcgagatcgagagcctccacgtctgcgacaacctcgccgaccacatgattgggaacgtgtacgtgcagttcngggaggaggagcaggcggcgcgcgcgctgcaggcgctgcagggacgctactactcgggccgccccatcatcgccgagttctcgccggtgacggacttccgggaggccacctgccgccagttcgaggagcacagctgcaaccgcggcggntactgcaacttnatgcacgtgaagcagatcgggagggacctgcggcggaagctgttcggccacctgcacaggtaccgccggagcnacagccggagcagccgcagcccgagcccgtaccgccaccgccggagctcgtccaggtccagggaccgcgacgacgactacgactactactaccagtaccgtagtggcagtgccagccggaggagcagcgagaggcaccgcagccncgacagcgacgggagccgccgccggcgcgggcggtntaggagccggagcccagtgagggagggcagcgaggagaggagggcgcggatcgagcagtggaaccgcgagagggaggccgcgcaggtgtgaccgtgtgaagcagagctgtggttgctgacactgtcatnttntgctggtagttagtgaggaccaggtcgtaattgaattcagaaattcgtgtaatcgtgaccaaattgaacttgctgttgttgctgaactcnttttggatgtatttntggaacccagttgcatgtttgattatgagcttgggcgatgatga

SEQ ID NO: 9746 - DNA, 1075 bp, Pseudoroegneria spicata
cgggggcgccgccatggccgagcacctcgcgtcaatcttcggcaccgagaaggaccgcgtgaactgcccgttctacttcaagataggcgcgtgccggcatggcgaccgctgctcccgcctgcacaacaagccgtccgtctcgccgacgcttctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaaccttgccgaccacctgattggcaacgtgtacgtgcagttcagggaggaggaccaggccgccaaggccctccaggcgctgcaggggaggttctactcgggccgccccatcattgctgagttctcgccggtcaccgacttccgggaggccacctgccggcagttcgaggagcacaattgcaaccgtggagggtactgcaacttcatgcatgtcaaggagattggcagggacctgaggaagaggctgtatgggcacctgcataggtccaggaggagccacagcaggagcagccggagcctgagcccctaccgtcaccacgccagggaccatgatcgctcctcacggtctagggaccgcggcgactattatggaggcagcttggaccgtggagactacggcgactactaccaccatagccggaggagcagtgagaggaaccgcaactatgacagtgatgggagcaggcggcgccggcgacacaggtctaggactaggagccctgtcagagagggcagcgaggagaggagggcgaagatcgagcagtggaaccgcgaaagggagatggcgcaggcctgagatctccggtctgtctgcaggttgcagtgttgccttgttcaccggatgttctgcttgcttgtctgatcttgtaatggtggatggagttagaatgtggtctttagtgaacttactcagatgcctgatgtaacattttcagtgtggttcttgttgaactttctcttcggatgtgttgatgga

SEQ ID NO: 9747 - DNA, 1485 bp, Sorghum bicolor
atccaccaaatccagccagtccgtactcggctgcttctcctccggcccgtgcctacggcggcgctgctctctggtaaccggtcggaagatgttggatcttccgctacaaatcgacgcataaaggatacagattagtttaatttacgtcaaatttatttcactccgtgtagttctgtacgttgatttattaatttcgcctggatttaagctgctgctattttgaaggtttcttctcttctccgggaaaatttcagatcccggaaacaactggaattgaagtagccactgatgctgttgccgtgttcttgagctcataaattgctatttgttaatgctcaaattgtgtgcctgaccacagaaatctctaggcgacgaatcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcaggggaaccccatcgacccggagcggatccaggaggacttcgaggacttctacgaggacatcttcgaggagctgagcaagcacggcgagatcgagagcctccacgtgtgcgacaacctcgcggaccacatgatcgggaacgtgtacgtgcagttccgcgaggaggagcaggcggcgcgcgcgctgcaggctctgcagggccgctactactcgggccgccccatcatcgccgagttctcccccgtgacggacttccgggaggccacctgccgccagttcgaggagcacagctgcaaccgcggcggatactgcaacttcatgcacgtcaagcaggtcggacgggacctgcggcggaagctgttcggccacctgcatcgctcccaccggagccatagccgcggcagccgcagcccgagcccgtaccgccgccacggtagctcgtccaggtccagggaccgtgacgatgaccatgactattactaccactaccgtagcggtagtggcagccgcaggagcagcgagagacaccgcagccacgacagcgacgggagccgccgtcggcgcgggcgatccaggagccggagcaagagcccgtggagggaaggcagcgaggagcggagggcaaagattgagcagtggaaccgcgagcgggaggcagcgcaggtgtaggcaggttcccctgtgactctgccggctgcagcctgcaggttgctgcagtactgttggcattgctagtctgacaggctgctgaagctgtcatcatgtattttagttatgtattgtagttttaggccttgtttagttcgtaaaattttttgtttttggctactgtagcatttcgtttttatttgacaaacattgtccaatcatggagtaactaggcttaa

SEQ ID NO: 9748 - DNA, 1286 bp, Triticum aestivum
ccctgctccaccttctgctccccctccggctacggcggcgctgatctccgagatctctagcttgcgaatccagggtgcgccgccatggccgagcacctcgcgtcgatcttcggcacggagaaggaccgcgtgaactgcccgttctacttcaagatcggcgcgtgccggcacggcgaccgctgctcccgcctgcacaacaagccgtctgtctcgcccacgctgctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaacctcgccgaccacctcattggcaacgtctacgtgcagttcagggaggaggaccaggccgccaaggccctccaggcgctgcaggggaggttctactcgggccgccccatcattgctgagttctcgcccgtcaccgacttcagggaggccacctgccggcagtttgaggagcacaactgcaaccgcggagggtactgcaacttcatgcatgtcaaggagataggcagggacctgaggaagaggctgtatgggcacctgcataggtccgggaggagccacagcaggagcagccggagcccgagcccctaccgtcaccatgccagggaccgtgatcgctcctcacggtctagggaccgcggcgactactatggaggtagcttggaccgtggcgactatggtgactactaccaccatagccggaggagcagcgagaggaaccgcaactatgacagtgatgggagcaggtgccggcgacacaggtccaggactaggagccccgtcagggagggcagcgaggagaggagggcgaagattgagcagtggaaccgtgaaagggaggcgcctgccaggcagggcagcgaagagaggagggcgaagatcgatcagtggaaccgtgagagggagactgctcaggcgtgagatctcctgtctgactgcaggttgaagtgttgccttgttcaccggatgttctgcttgcttgtctgatcgtgtaatggtagatggagttagaatttggtcctagtgaacttgcttggatgcctgatgtaacatcttcagtgttgttcttgttgaacttcctctatggatttgttgatggaacatatttggtgttggacttgttattgttatgattattatagtgtgttccctgaatgttcctttgctctaaaaaaaaa

SEQ ID NO: 9749 - DNA, 1656 bp, Saccharum officinarum
  misc_feature (597)..(597): n is a, c, g, or t
  misc_feature (615)..(615): n is a, c, g, or t
  misc_feature (1077)..(1077): n is a, c, g, or t
  misc_feature (1079)..(1079): n is a, c, g, or t
  misc_feature (1085)..(1085): n is a, c, g, or t
  misc_feature (1088)..(1088): n is a, c, g, or t
  misc_feature (1099)..(1099): n is a, c, g, or t
  misc_feature (1154)..(1154): n is a, c, g, or t
  misc_feature (1158)..(1158): n is a, c, g, or t
  misc_feature (1311)..(1311): n is a, c, g, or t
  misc_feature (1411)..(1411): n is a, c, g, or t
cggttccgtactcatcttcttcccctccgggctcgggctccggctacggcggcgctgctctctggtcggaagatgttggatcttccgctacaaatcgacgcataaaggatacagattagttttatttacgtcagatttcttttactcggtgtagttctgtgcattcattaaatcaatttcgcctggatctaagctgctgctattttgaaggtttcttctccggggaaaatttcagatcccggaaacgactggaattgaagtagccactgatgctgttatctagctagttcttgctcataagttgcttgtagttatttgtttgtttgttaatcctagctgttgcatattgtgtgcctgaatcgaatcgagtcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcagggnaaccccatcgacccggancggatccaggaggacttcgaggacttctacgaggacatcttcgaggagctgagcaagcacggcgagatcgagagcctccacgtgtgcgacaacctcgcggaccacattatcgggaacgtgtacgtgcagttccgcgaggaggagcaggcggccgcgccctgcaggcgctgcagggccgctactactcgggccgccccatcatcgccgagttttcgccggtgacggacttccgggaggccacttgccgccagttcgaggagcacagctgcaaccgcggcggatactgcaacttcatgcacgtcaagcaggtcggccgggacctgcggcggaagctgttcggccacctgcatggctcccaccggagtcacagccggggcagccgcagccccagcccgtaccgccgccgcggtagctcgtccaggtccagggaccgcgacgatgaccacgactattactactacnantaccgnagnggcagtggcanccgcaggagcagcgagagacaccgcagccacgacagcgacgggagccgccgtcgncgcnggcggtcgaggagccggagcaggagcccggtgagggaaggcagcgaggagaggagggcaaagattgagcagtggaaccgcgagcgggaggcagcgcaggttctcctgtgactccggctgcagcctgctggttgccgcagtgttgttgccttgntggtattgctagtttgccaacaagttgctgaatctgtcgtcaggtcgtaaattgaatctaaaaattgaattatgacctcttctgctgtggactagctggntgtgattcaacctttgatttggatgtgctgacgaaatctagttgttgtgagtaacttgctcagatggtcaagtggcgcctaatggttgcattgagcttgtgtccaaacaaagaaagaaaaagaatcgaagcatctttgatgatcttcaaagatcgcatggagaaggattttcagacaaatgtcttctcacagcacagtgagaatcgtacttgtcctcgtgttctaaaaataatcgcctttacaag

SEQ ID NO: 9750 - DNA, 1247 bp, Triticum aestivum
cccacgcgtccgaaaacaaaaacaaatctgccctgctccaccttctgcttcccctccggcgacggcggcgctgatctccgagatctgtagcttctctccgggggggcgaacccagggggcgccgccatggccgagcacctcgcgtctatcttcggcacggagaaggaccgcgtgaactgcccgttctacttcaagatcggcgcgtgccggcacggcgaccgctgctcccgcctgcacaacaagccgtccgtctcgcccacgctgctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaacctcgccgaccacctgattggcaacgtgtacgtgcagttcagggaggaggaccaggccgccaaggccctccaggcgctgcaggggaggttctactcgggccgccccatcatcgctgagttctcgcccgtcaccgacttccgggaggccacctgccggcagttcgaggagcacaactgcaaccgtggagggtactgcaacttcatgcatgtcaaggagattggcagggacctgaggaagaggctctatgggcacctgcataggtccaggaggagccacagcaggagcccgagcccctaccgtcaccacgccagggaccgtgatcgctcctcacggtctagggaccggggcgactactatggaggcagcctggaccgtggtgactacggcgactactaccaccacagccggaggagcagcgagaggaatcgcaactatgacagcgatgggagcaggcggcgccggcgacacaggtctaggactaggagcccggtcagggagggcagcgaggagaggagggcaaagattgagcagtggaaccgtgaaagggaggcgcctgccaggcagggcagcgaggagaggagggcgaagatcgagcagtggaaccgcgaaagggagactgctcaggcgtgagatctcctgtctgactgcaggttgcagtgttgccttgttcaccggatgttctgcttgcttgtctgatcttgtaatggtagatggagttggattgtggtcctagtgaacttacttggatgcctgatgtaacatcttcagtgttgttcttgttgaacttcctctatggatttgttgatggaaca

SEQ ID NO: 9751 - DNA, 1614 bp, Avena sativa
atctcccgtgctcctcctgcctcctctccggcgacggcggcggcgctgatttccggtcgggagataggatcttcctccctcgcaaatcgaagagaaaataagttatggattagttttactgccgttaattttcgtttacttaatcgccgttcgttcatcgatttgacctggaatttaagtgcctgctattttgaaggtttcctcagttctacgggaattggaattgcagtgtctactactcatgatgttctatcaagttcttttccaacctcttttgaattatctggcatgccgttggttaatcctagtggtaattttgcgtatataattcctgattcttgtggttggactgcagatctctagtttttctgcgaggggacgaacaggtggcagcatccagccgccgccatggctgagcacctcgcgtcgatcttcggcacggagaaggaccgcgtgaactgcccgttctacttcaagatcggcgcgtgccgccacggcgaccgctgctcccgcctgcacaaccgcccctctgtctcgccgaccctgctgctctgcaacatgtaccagcgcccggacatgatcaccccgggcttcgacccgcagggcaaccccatcgaacccagcaagatccagggtgacttcgaggacttctatgaggacatcttcgacgagctcagcaagtacggcgaggtggagaacctgcacgtctgcgacaacctcgctgaccacctcatcggcaacgtgtatgtctcgttcagggaggaggaccaggccgccaaggccctccaggcgctgcaggggaggttctactccggccgtcccatcattgctgagttctcgccggtcaccgacttccgcgaggccacctgcaggcagttcgaggagcacaactgcaaccgtggtgggtactgcaacttcatgcatgtgaaggagatcggcagggacctgaggaagaggttgtatgggcacctgcataggtcccggaggagccacagcaggagcagcaggagcccgagcccttaccattaccactcgagggaccgtgatcggtcgtcccggttgtcaagggaccgtggcgactactatggcggcagcttggaccgcggcgactatggggattaccaccaccatagccgtaggagcagcgagaggaatcgcaactatgacagtgatgggagcaggcggcgacggcacagaagccggactagaagccctgtcagggagggcagcgaggagaggagggcgaagattgagcagtggaaccgtgaaagggaggcgcaggcctaagagttcaggtcttattgcaggttgcagtgctgccttgttcaccaaatgtctgcctgtctgaacttgtattggtagatgagttagaatgtgttcttagtgatcttacttggatgcatgatgtagcctattcagtgtttttcttgttgaacttcatttggatgtgtccatggaacctatttggtgatgaacttgttatgattaaggttttctctggatgttcctttttctgcattatgtgcgttgcttgctcccagcttgtcccagtccctttactctcttgtatgatagacagaatttagagtgtgttcttaatgaacttactcagat

SEQ ID NO: 9752 - DNA, 1810 bp, Hordeum vulgare
atgtgtaggttcgaacggtttgtgttgcccgtgcccacgtattacgctcgtcccttttctctcggtccgaacggattggattgatgatgctttcgtgtgtcttctctgtcgattcttatcaggtcgggagataggttcttccccccctcgcgaatcgaagagataaatgaagttatggattagtcttactctcgtttagttccgttttctttcgatttggtccggaatttaagtgcctgctaattttgaaggtttccacagttccaccggaattgggatgaattgcagtatcaagttcttgttccccctccttcgaattatctggaatgttatccgttgatcttggctgcagcttcgtgtgtatgatttgtgtttcgtgtggtggaactgcagagatctatctagcttttctgcgagggaactaatccagggggcgccgccatggccgagcacctcgcgtcgatcttcggcaccgagaaggaccgcgtgaactgcccgttctacttcaagatcggcgcgtgccggcacggcgaccgctgctcccgcctgcacaacaagccgtccgtctcgccgacgctgctgctctgcaacatgtaccagcgccccgacatgatcaccccgggggtggacgcgcagggcaaccccatcaaccccgtcaagatccagggcgacttcgaggacttctacgaggacatcttcgacgagctcagcaagcacggcgaggtcgagaacctgcacgtctgcgacaacctcgccgaccacctgattggcaacgtctacgtgcagttcagggaggaggaccaggctgccaaggccctccaggcgctgcaggggaggttctactcgggccgccccatcattgccgagttctcgccggtcaccgacttccgggaggccacctgccggcagttcgaggagcacaactgcaaccgtggaggatactgcaacttcatgcatgtcaaacagattggcagggacctgaggaagaggctgtatgggcacctgcatagctccaggaggagccacagcaggagcagccggagcccaagcccctaccgtcaccacgccagggaccgtgatcgctcctcacggtctaaggaccgtggcgattactatggaggcagcctggaccgtggtgactatggcgactactaccaccatagccggaggagcagcgagaggaatcgcaactatgacagcgatgggagcaggcgccggcgacacaggtctagaactaggagcccggtcagggagggcagcgaggagaggagggcgaagattgagcagtggaaccgtgaaagggatgcgcctgccaggcagggcagcgaggagaggagggcgaagatcgagcagtggaaccgtgaaagggagacggctcaggcctgagatctccggtctgactgcaggttacagtgttgccttgttcacaggatgttctgcttgcttatctgatcttgtaatgttagatggagttagattgttgccctagtgaacttactcagatgcctcatgtagaacctcttcagtgtggttcttgttgaacttctttttggatgtgttgatggaacatatttggtgttgaatttgttattgttatgattatagtgtgttccctcaaaatgttcctttgcccacatactttgtttcagtctaaatgcattgggggttgtatttttgtaccactcgacatcaacttaggttcaatcaaatttcctgccagtttgaaaggcagagagtttagcactcagggctaaatgagaaactataacatgtaatctagtgtgtcagctcgccgcattgttaaatttat

SEQ ID NO: 9753 - protein, 197 aa, Brachypodium distachyon
MAARKELSSTLRNLKFMQRAAVAQKIEDKTEVDVEVEAEVLTPAANGGFGSSARVARKCVVVMEGNPHPGAVKGRMSFQNFNPSIDKLNEEASGHQTQSASPSNSQEDGANPSRTDDVSASRFRGFNVDSSESISLNDLKRKEPELEMETPRSQKLPKTTGQNVDGESSSQSNGRGSRKSNKHEKLDWNLLRRRKSK

SEQ ID NO: 9754 - protein, 200 aa, Triticum aestivum
  misc_feature (98)..(98): Xaa can be any naturally occurring amino acid
  misc_feature (148)..(148): Xaa can be any naturally occurring amino acid
MSAKKGLSSTLRNLKFMQRAAVAQKIEDKADVEVEEPAAEVVMTPAANGGGVGSSVQVARKCVVVMEGNPLPGAVKGRMSFQNFNPSIDKLNDEASGXPTQSASPSNSQQDSANTSRVDDISASRFRSFNVDSSESISLNELKRKEPXLEMETPPSRKLPKTTGQNVDGQPSSQSNGRGSGKSNKHEKLDFNLLRKRKSK

SEQ ID NO: 9755 - protein, 200 aa, Triticum aestivum
MSAKKGLSSTLRNLKFMQRAAVAQKIEDKADVEVEEAAAEVVMTPAANGGGVGSSVQVARKCVVVMEGNPLPGAVKGRMSFQNFNPSIDKLNDEASGRPTQSASPSNSQQDSANTSRVDDISASRFRSFNVDSSESISLNELKRKEPELEMETPPSRKLPKTAGQSVDGQPSSQSNGRGSGKSNKHEKLDFNLLRKRKSK

SEQ ID NO: 9756 - protein, 101 aa, Secale cereale
MAATEAQLLQPRALAALLVVLVLITLGGAAEAQQGTCGAQLSQLAPCARYSVPPLPGQALPTPGPECCSALGSVSRDCACGAIDIINSLPAKCGLPRVSCQ

SEQ ID NO: 9757 - protein, 103 aa, Triticum aestivum
MAVTTAQLPQPRALAALLVLVLLITLGGAAEAQPPLGTCGAQLSQLAPCARYSVPPLPGQALPTPGPECCSALGSVSRDCACGAIDIINSLPAKCGLPRVSCQ

SEQ ID NO: 9758 - protein, 134 aa, Triticum aestivum
TRPRRKSHTHTNAFSFISQASSSARTEPATTMMAVTTAQLPQPRALAALLVLVLITLGGAAEAQPPLGTCGAQLSQLAPCARYSVPPLPGQALPAPGPECCSALGSVSRDCACGAIDIINSLPAKCGLPRVSCQ

SEQ ID NO: 9759 - protein, 69 aa, Brachypodium distachyon
MASVKAVKPTGPAAQAKEPAKLSATKEPAKLSATAKKPAAAKGGIKKAESKPREPKKRVKSSKPAAVKN

SEQ ID NO: 9760 - protein, 416 aa, Triticum aestivum
MGCGLSTPDNDGGGGGARRKQGSVGDVVVFLPGLRAPMGVDLSQALAGRLDKSAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSMQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEVFHATPPTSRSPTPFGTAKYLFDKIPKEASSKVRINQDLYTPERVIGAPPPLPDFSLALTPEDYDLPPLDPLWNKEDGHQ

SEQ ID NO: 9761 - protein, 416 aa, Triticum aestivum
MGCGLSTPDSDGGGGGARRKQGNVGDVVVFLPGLRAPMGVDLSQALAGRLDKGAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSLQALGQGVDMQLGLAIDSPKATQAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERVIGAPPPLPDFSLALTPEDYDLPPLDPLWNKEDGHQ

SEQ ID NO: 9762 - protein, 416 aa, Triticum aestivum
MGCGLSTPDSDGGGGGARRKQGSVGDVVVFLPGLRAPMGVDLSQALAGRLDKSAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSLQALGQGVDMQLGLAIDSPKATQAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERVIGAPPPLPDFSLALTPEDYDLPPLDPLWNKEDGHQ

SEQ ID NO: 9763 - protein, 412 aa, Brachypodium distachyon
MGCGSSRQVDGDGPRRKPGSVGDVVVFLPGLRAPRSVDFSQALAGRLDKSAVERLSALRARVVELAMQESAAALKPKRKTAARHGSTTANLLQALEDYLPVLLGLVKEGSELRHIVQFVWANQEDNAEETAMEDAWYEVLSVLQLMAMVCLLQANSLLLPRAYGDGYGPRVSEESRRATVDVFLKAAGYLDCAIRQVLPHMPSELRRQLPVDLAEGNLKALSLQALGQGVDMQLGLAIDSPKATLAVKRRLACEMVKYWHQVQESIPELPVSDGWGKKHLLFVKWKYVEAKAAAYYFHGLILDEGNSEKFHGMAIAALQASEEFLKESKRASEAFHATPPASRSPTPFGTAKYMFDKIPKDASSKVRINQDLYTQERVIGAPPPLPDFSLALTPEDYDLPPLDSVWNKDNHQ

SEQ ID NO: 9764 - protein, 413 aa, Oryza sativa
MGCGLSREKDAGGGPRRRPGSVGDVVVFLPGLRVPRSVDFSQALAGRLDEASSRLSSLRARVVDMAMQESAAALKPKRRAAARHGSSTANLLQALEDYLPVLLGLVKEGSELRHGVHFVWTNQEDNAEETAMADAWYEVLSVLHLMAMVCLLQANSLLLPRSYGDGYAPRVSEESRRATVDVFLKASGYLDCAIRQVLPQISSELRRQLPVDLAEGNLKALSLQALGQGVDMQLGLAIDSPKATLAVKRRLACEMVKYWHQIQESIPEIPVSDGWGKKHLLFVKWKYVEAKAAAYYFHGLILDEGNTEKSHGMAVAALQASEEFLKESKRASEAFHATPPTSRSPTPFGTAKYMLDKIPKDASSKVKINQDLYTQERVIGTPPPLPDFALALKPDDYDLPPLDPLWNKEDSRQ

SEQ ID NO: 9765 - protein, 414 aa, Pennisetum glaucum
MGCGASSQKDAAGGPRRRPGSVGDVVVFLPGLRVPRSVDLAQALGGGLDGSIVERLSALRARVVEMAMQESAAALKPKRKTAARHGSSTANLLQALEDYLPVLLGLVKEGSTLRHAVQFTWTNQEDKAEETAMADAWYEVLSVLHLMAMVCLLQANTLLLPRSYGDGYAPRVSEESRRATVDVFLKAAGYLDCAIRHVLPQIPPELRRQLPVDLVEGNLKALSLQALGQGVDMQLGLAIDSPKATLAVKRRLACEMVKYWQQVQESIPELPGSDGWGKKHRLFIKWKYVEAKAAAYYFHGLILDEGNTEKSHGMAIAALQASEEFLKESKRVSEAFHASPPTSRSPTPFGTAKYMFDKIPKDASSKVRINQDLYTQEKVIGTPPPLPDFALALTPEDYDLPSLDPLWNKEDRRH

SEQ ID NO: 9766 - protein, 413 aa, Zea mays
MGCGASSQKDAGAPRRRPVSVGDVVVFLPGLRVPRAVDLAQALGGCLARSAVDRLSALRSRVVDMAMRESAAALKPRRRAAARHGSSTANLLQALEDYLPALLGLVKEGSVLRNKVHFTWSNQEDNAEETAMPDAWYEVLSMLHLMAMVCLLQANALLLPRSYGDGYAPRVSEESRRATVDVFLKAAGYLDCAVRHVLPKMPLELRRQLPVDLAEGNLKALSLQALGQGVDMQLGLAIDSPKATLAVKRRLACEMVKYWQQVQESIPELPISDGWGKKHRLFIKWKYVEAKAAAYYFHGLILDEGNTEKSHGMAIAALQASEEFLKESKRVSEAFHATPPTSRSPNPFGTAKYLFDKIPRDASSKVRINQDLYTQEKVIGAPPPLPDFALALTPEEYDLPPLDPLWNKEDTSH

SEQ ID NO: 9767 - protein, 413 aa, Zea mays; identical to SEQ ID NO: 9766

SEQ ID NO: 9768 - protein, 230 aa, Zea mays
MGCGASSHKDAGARRRRPGSVGDVVVFLPGLRVPRAVDFAQALGGCLARAIVERLSALRSRVVEMAMQESAAALKPRRKAAARHGSSTANLLQALEDYLPVLLGLAQQGSVLRHKVQFTWSNQEDNAEETAISDVWYEVLSVLHLMAMVCLLQANTLLLPRSYGDGYAPRVSEESRRATVDVFLKAAGYLDCAIRHVLPKMPLELRRQLPVDLAEGNLKALSLQAFGSGG

SEQ ID NO: 9769 - protein, 413 aa, Zea mays
MGCGASSHKDAGARRRRPGSVGDVVVFLPGLRVPRAVDFAQALGGCLARAIVERLSALRSRVVEMAMQESAAALKPRRKAAARHGSSTANLLQALEDYLPVLLGLAQQGSVLRHKVQFTWSNQEDNAEETAISDVWYEVLSVLHLMAMVCLLQANTLLLPRSYGDGYAPRVSEESRRATVDVFLKAAGYLDCAIRHVLPKMPLELRRQLPVDLAEGNLKALSLQALGQGVDMQLGLAIDSPKATLAVKRRLACEMVKYWQQVQESIPELPVSDGWGKKHRLFVKWKYVEAKAAAYYFHGLILDEGNTEKSHGMAIAALQASEEFLKESKMVSEAFHATPPTSRSPNAFGTAKYLFDKIPRDASSKVRIKQDLYTQEKVIGAPPPLPDFALALTPEDYDLPPLDPLWNKEDTHH

SEQ ID NO: 9770 - protein, 414 aa, Sorghum bicolor
MGCGASSQKDAGPPRRRLGSVGDVVVFLPGLRAPRTVDFAHALAGCGVARSVVDRLSALRSRVVEMAMQESAAALKPRRRTAARHGSSTANLLQTLEDYLPVLLGLVKDGSILRHKVQFTWSNQEDSAEETAISDAWYEVLSVLHLMAMVCLLQANTLLLPRSYGDGYAPRVSEESRRATVDVFLKAAGYLDCAIRHVLPKMPLELRRQLPVDLAEGNLKALCLQALGQGVDMQLGLAIDSPKATLAVKRRLACEMVKYWQQVQESIPELPVSDGWGKKHRLFVKWKYVEAKAAAYYFHGLILDEGNTEKSHGMAIAALQASEEFLKESKRVSEAFHATPPTSRSPNPFGTAKYLFDKIPRDASSKVRINQDLYTQEKVIGAPPPLPDFALALTPEDYDLPPLDPLWNKEDTHH

SEQ ID NO: 9771 - protein, 285 aa, Sorghum bicolor
MATAFESPTSSPAAAPFHDDPFLHFDGSAPAADGFPASPDAYAPSPFGMPHSNGDLHDDPFAAPADSNGGPILPPPTEMGREEGFLLREWRRQNAIHLEKKEKNEKELRSQIIVDAEEFKKAFVEKRKLNVETSKGQNRDREKLFLANQEKFHAGADKQYWKAISELIPHEIANIEKRGARKDKEKEKKPGIVVIQGPKPGKPTDMARMRQILLKLKHTPPPHMKPPPPPAAATGKDGAPAAAGKDGAKPAAPANGSVPEMEKAAAVAPVPAAAPPAATEPIAAA

SEQ ID NO: 9772 - protein, 286 aa, Saccharum officinarum
MATAFESPTSSPAAAPFHDDPFLHFDGSAPAPADVFPASPDAYAPSPFGMPHSNGDLHDDPFAAPADSNGGPILPPPTEMGREEGFLLREWRRQNAIHLEEKEKKEKELRSQIIVDAEEFKKAFVEKRKLDAETSKGQNRDREKLFLANQEKFHAGADKQYWKAISELIPHEIANIEKRGARKDKEKEKKPGIVVIQGPKPGKPTDMARMRQILLKLKHTPPSHMKPPPPPAAATGKDGAPAAAGKDGAKPAAPANGSVPEMEKAAVAAPAPAAAPPTATESIAAA

SEQ ID NO: 9773 - protein, 286 aa, Saccharum officinarum; identical to SEQ ID NO: 9772

SEQ ID NO: 9774 - protein, 276 aa, Panicum virgatum
MATAFDSPTSSPAAAPFHDDAFLHLDGSAAAADAFPASPDPYAPSPFGMPQANGGLHDDPFADSDGGPILPPPTEMGREEGFLLREWRRQNAILLEEKEKKEKELRSQIILDAEEFKKAFVEKRKLNVETSKGQNRDREKLFLANQEKFHAGADKQYWKAISELIPHEIANIEKRGARKDKEKEKKPGIVVIQGPKPGKPTDMSRMRQILLKLKHTPPPHMKPPPPPAAAAGKDGAPAAAAKDGAKPAAPANGSVPEMEKAAAAAPAPATEPIAAA

SEQ ID NO: 9775 - protein, 291 aa, Panicum virgatum
MATAFDSPTSSPAAAPFHDDAFLHVDGSAASADGFPASPDPYAFSSDAPSPFGMPQANGGLHDDPFADSDGGPVLPPPTEMGREEGFLLREWRRQNAILLEEKEKKEKELRSQIILDAEEFKKAFVEKQKLNVETSKGQNRDREKLFLANQEKFHAGADKQYWKAISELIPHEIANIEKRGARKDKEKEKKPGIVVIQGPKPGKPTDMSRMRQILLKLKHTPPPHMKPPPPPAAAAGKDGAPAAAGKDGAPAAAAKDGAKPAAPANGSVPEMEKAAAAAAPAPAAEPIAAA

SEQ ID NO: 9776 - protein, 299 aa, Setaria italica
MATAFDSPTSSPAAAAPFHGGDAFLHFDGSADVHASADGFPASPDPYAFRSDAPPSPFGMPQANGGAVHDDDPFAPDSNGGPILPPPTEMGRDEGFLLREWRRQNAILLEEKEKKEKELRSQIILDAEEFKKAFVEKRKLNLETSKGQNRDREKLFLANQEKFHAGADKQYWKAISELIPHEIANIEKRGARKDKEKEKKPGIVVIQGPKPGKPTDMARMRQILLKLKHTPPPHMKPPPPPAAAAGKDGAPAAAGKDGAPAAAAKDGAKPAAPANGSVPEMEKAAGAAPAPATEPIAAA

SEQ ID NO: 9777 - protein, 87 aa, Pennisetum glaucum
MCGGGVCFSFSNICRIRAMSVGFPGFGPWTTTIPGFFSFSLSFLAPLFSMLAISCGISSDIAFQYCLSAPAWNFSWFARKSFSLSRF

SEQ ID NO: 9778 - protein, 291 aa, Triticum aestivum
  misc_feature (89)..(94): Xaa can be any naturally occurring amino acid
YGEQPRNRLDLYIPKDNRRPCPVVAFVTGGAWIIGYKAWGALLGRRLAERGIIVACIDYRNFPQGTISDMVSDASQGISFVCNNIASYXXXXXXIYLMGQSAGAHISACALMEQAVKESSGQPISWSVTQIKAYFGLSGGYNIHNLVDHFHQRGLNRSIFLSIMEGEEALSRYSPEIVVKESSTRTIALLPRIFLMHGTDDYSIPSSASRTFVDVLQQVGAQATLLLYEGKTHTDIFIQDPLRGGRDPLVEDVFSVIYADDATRQNAASAPTPRRLVFEWQLQLARWISPF

SEQ ID NO: 9779 - protein, 132 aa, Triticum aestivum
MDCAHTVSACRGMIDIMGDRGRERRDSYIIHSTMKIACKLHFFCCRCQFFAAAGLELFTCLFLGSRGFDSAFLMPPLAAAGLVAVALSFAGPLVALTLVGSLACPSSPVGFTAFRDAILICCSVPALEGLET

SEQ ID NO: 9780 - protein, 59 aa, Triticum aestivum
LLLYEGKTHTDIFIQDPLRGGRDPLVEDVFSIIYADDATRRIQLLRQLQGAWFLSGNCS

SEQ ID NO: 9781 - protein, 92 aa, Triticum aestivum
SCRIRHEDSSKPSSAGTEQHIRMASLKAVKPTGLEGQAKEPTKVSAAKGPAKLSATATKPAAAKGGIKKAESKPREPKKRQVKSSKPAAAKN

SEQ ID NO: 9782 - protein, 214 aa, Brachypodium distachyon
  misc_feature (208)..(209): Xaa can be any naturally occurring amino acid
  misc_feature (211)..(212): Xaa can be any naturally occurring amino acid
MQPPSSGGDAREADALLARSDSAGRRRRASPVQSASPAPQGWGGPRRQSSFRDDVGHAASETYLVTRLTFTLLQYLGLGYRWMTQLLALAVYAILLMPGFLQVGYYYFFSSQVRRSIVYGEQPRNRLDLYIPKDNTRPCPVMAFVTGGAWIIGYKAWGALLGRRLAERGIIVACIDYRNFPQGTISDMVADASQGISFVCNNIASYGXXLXXST

SEQ ID NO: 9783 - protein, 414 aa, Setaria italica
MGCGASSQKDAAGGPRRRPGSVGDVVVFLPGLRVPRSVDLAQALGGRLDRSIVERLSALRARVVEMAMQESAVALKPRRRAAARHGSSTANLLQALEEYLPVLLGLVKEGSMLRHAVQFTWTNQEDNAEETAMADAWYEVLSVLHLMAMVCLLQANTLLLPRSYGDGYAPRVSEESRRVTVDVFLKAAGYLDCAIRHVLPQIPPELRRQLPVDLVEGNLKALSLQALGQGVDMQLGLAIDSPKATLAVKRRLACEMIKYWQHVQESIPDLPGSDGWGKKHRLFVKWKYVEAKAAAYYFHGLILDEGNTEKSHGMAIAALQASEEFLKESKRVSEAFHATPPTSRSPTPFGTAKYMFDKIPKDASSKVRINQDLYTQEKVIGTPPPLPDFALALTPEDYDLPPLDPLWNKEDRRH

SEQ ID NO: 9784 - protein, 284 aa, Panicum virgatum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRTRRSRSRSSRSPSPYRYRRSSSRSRDRDDDYDYYYHYRSGSGSRRSSERHRSHDSDGSRRRRGRSRSRSPVREGSEERRARIEQWNREREAAQV

SEQ ID NO: 9785 - protein, 287 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYYRSGSGSRRSSERHRSHDSDGSRRRRGRSRSRSRSPVREGSEERRAKIEQWNREREAAQV

SEQ ID NO: 9786 - protein, 284 aa, Panicum virgatum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIDSLHVCDNLADHMIGNVYVQFREEEQAARALQGLQGRYYSGRPIIAEFSPVTDFREATCRQFEEHSCNRGGYCNFMHVKQVGRDLRRKLFGHLHRSRRSHSRSSRSPSPYRHRRSSSRSRDRDDDYDYYYHYRSGSGSRRSSERHRSHDNDGSRRRRGRSRSRSPVREGSEERRARIEQWNREREAAQV

SEQ ID NO: 9787 - protein, 295 aa, Brachypodium distachyon
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGVVESLHVCDNLADHLIGNVYVQFREEDQAARALQALQGRFYSGRPIIAEFSPVTDFREATCRQFEEHNCNRGGYCNFMHVKEIGRDLRKRLYGHLHRSRRSHSRSPSPYHRHPRDRDRRSSSRSRDNRGGDYYGGSLDRGDYGDYYHHSRRRSSERHRNYDSDDGSRRRRHRSRTRSPVREGSEERRAKIEQWNREREAAQA

SEQ ID NO: 9788 - protein, 292 aa, Brachypodium distachyon
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGVVESLHVCDNLADHLIGNVYVQFREEDQAARALQALQGRFYSGRPIIAEFSPVTDFREATCRQFEEHNCNRGGYCNFMHVKEIGRDLRKRLYGHLHRSRRSHSRSPSPYHRHPRDRDRRSSSRSRDNRGGDYYGGSLDRGDYGDYYHHSRRRSSERHRNYDSDDGSRRRRHRSRTRSPVREGSEERRAKIEQWNREREA

SEQ ID NO: 9789 - protein, 284 aa, Cenchrus ciliaris
  misc_feature (117)..(117): Xaa can be any naturally occurring amino acid
  misc_feature (195)..(195): Xaa can be any naturally occurring amino acid
  misc_feature (243)..(243): Xaa can be any naturally occurring amino acid
  misc_feature (255)..(255): Xaa can be any naturally occurring amino acid
MAEHLASIFGTEKDRVNCPFYFKIGACRHGDRCSRVHNKPSISPTLLLCNMYQRPDMITPGVDAQGNPIDPEQIQEDFEDFYEDIFEELSKHGEIESLHVCDNLADHMIGNVYVQFXEEEQAARALQALQGRYYSGRPIIAEFSPVTDFREATCRQFEEHSCNRGGYCNFMHVKQIGRDLRRKLFGHLHRYRRSXSRSSRSPSPYRHRRSSSRSRDRDDDYDYYYQYRSGSASRRSSERHRSXDSDGSRRRRGRXRSRSPVREGSEERRARIEQWNREREAAQV

SEQ ID NO: 9790 - protein, 293 aa, Pseudoroegneria spicata
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSSRSLSPYRHHARDHDRSSRSRDRGDYYGGSLDRGDYGDYYHHSRRSSERNRNYDSDGSRRRRRHRSRTRSPVREGSEERRAKIEQWNREREMAQA

SEQ ID NO: 9791 - protein, 286 aa, Sorghum bicolor
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRSHRSHSRGSRSPSPYRRHGSSSRSRDRDDDHDYYYHYRSGSGSRRSSERHRSHDSDGSRRRRGRSRSRSKSPWREGSEERRAKIEQWNREREAAQV

SEQ ID NO: 9792 - protein, 314 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSGRSHSRSSRSPSPYRHHARDRDRSSRSRDRGDYYGGSLDRGDYGDYYHHSRRSSERNRNYDSDGSRCRRHRSRTRSPVREGSEERRAKIEQWNREREAPARQGSEERRAKIDQWNRERETAQA

SEQ ID NO: 9793 - protein, 145 aa, Saccharum officinarum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHIIGNVYVQFREEEQAAAPCRRCRAATTRAAPSSPSFRR

SEQ ID NO: 9794 - protein, 312 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSPSPYRHHARDRDRSSRSRDRGDYYGGSLDRGDYGDYYHHSRRSSERNRNYDSDGSRRRRRHRSRTRSPVREGSEERRAKIEQWNREREAPARQGSEERRAKIEQWNRERETAQA

SEQ ID NO: 9795 - protein, 292 aa, Avena sativa
MAEHLASIFGTEKDRVNCPFYFKIGACRHGDRCSRLHNRPSVSPTLLLCNMYQRPDMITPGFDPQGNPIEPSKIQGDFEDFYEDIFDELSKYGEVENLHVCDNLADHLIGNVYVSFREEDQAAKALQALQGRFYSGRPIIAEFSPVTDFREATCRQFEEHNCNRGGYCNFMHVKEIGRDLRKRLYGHLHRSRRSHSRSSRSPSPYHYHSRDRDRSSRLSRDRGDYYGGSLDRGDYGDYHHHSRRSSERNRNYDSDGSRRRRHRSRTRSPVREGSEERRAKIEQWNREREAQA

SEQ ID NO: 9796 - protein, 314 aa, Hordeum vulgare
MAEHLASIFGTEKDRVNCPFYFKIGACRHGDRCSRLHNKPSVSPTLLLCNMYQRPDMITPGVDAQGNPINPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKQIGRDLRKRLYGHLHSSRRSHSRSSRSPSPYRHHARDRDRSSRSKDRGDYYGGSLDRGDYGDYYHHSRRSSERNRNYDSDGSRRRRHRSRTRSPVREGSEERRAKIEQWNRERDAPARQGSEERRAKIEQWNRERETAQA

SEQ ID NO: 9797 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 9798 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 9799 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 9800 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 9801 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 9802 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 9803 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 9804 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 9805 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 9806 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 9807 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 9808 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 9809 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 9810 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 9811 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 9812 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 9813 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat
